United States Patent 12,508,308 (INFLUENZA mRNA VACCINES) - sequence listing, part 50

SEQ ID NO: 193451 - RNA, 1701 nt, Artificial Sequence
  derived and/or modified sequence opt5 from hemagglutinin__InfluenzaA__AGU01878
augaaggccauccugguggucaugcucuacacccuggcuacagccaacgcggacacgcuuugcauuggcuaucacgcuaauaacagcaccgauacaguugacaccgugcuggagaaaaaugugacagucacccauuccgugaaccuccuggaagauaagcacgacgggaaacuuuguaagcugagaggaguugcuccccuccaucugggcaaaugcaauaucgccggguggauucugggaaacccugagugugaaucucucagcacagccuccucuuggagcuacaucguggagaccuccggcucugauaaugggacgugcuauccgggagacuucauugauuacgaggagcugcgggagcagcuuagcuccgucagcucuuuugaacgcuucgagaucuuucccaagaccuccagcuggccuaaccacgacucuaauaagggcgugacagccgcuuguccccaugccggcgcgaaaggguucuauaagaaccugaucuggcucguuaaaaagggaaauuccuacccuaaacugagcauuucuuauaucaacgauaagggcaaggaagugcuuguccugugggggauucaccaccccuccaccacagccgaccaacagagccucuaccagaaugcugauaccuacguguuugugggaacguccagauauucuaaaaaguucaaaccugagaucgccauucggccgaagguccgcgaccaggagggcagaaugaacuacuauuggacacugguugaacccggggauaaaaucaccuuugaggcuacaggaaaucugguggugccucgguacgccuucgcgauggaacgcaacgccggcagcggcauuaucaucuccgacacccccguccaugacugcaacaccacaugucaaacgccuaagggggcuauuaauaccagccuccccuuucagaacauccacccgauuacaaucggaaaaugcccuaaguaugugaagucuaccaaacugagacuugccacaggccugcggaauguucccuccauucagagccgcggacucuucggggcuaucgccggcuuuaucgaagggggauggaccggcaugguggauggcugguacggguaucaucaccagaacgaacaaggaucuggcuacgccgcugaccuuaagagcacgcagaaugcgauugauaaaaucacaaacaaggucaauuccgugauugagaaaaugaacacccaguucaccgccguugggaaggaguuuaaucaccuugaaaagagaaucgagaaccugaauaaaaagguggacgauggauuccucgacauuuggacauacaacgcugaacugcugguccuccuggagaaugaacggacccuugauuaucaugacucuaacgugaaaaaucuguacgagaagguccgcaaccagcucaaaaacaaugccaaggagaucggcaacggguguuucgaauuuuaucacaagugcgauaauacauguauggagagcgugaaaaacggcacguacgacuauccuaaguacuccgaagaggccaaacugaauagagaagagaucgauggaguuaagcuggagagcacccggauuuaucaaauccuggcuauuuacucuacagccgcguccagccucgugcuggucgugucucugggcgcuaucuccuucuggaugugcagcaacgggucccuccagugccgcauuuguaucuga

SEQ ID NO: 193452 - RNA, 1701 nt, Artificial Sequence
  derived and/or modified sequence opt5 from hemagglutinin__InfluenzaA__AGU01879
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugagaaacuguguaaacuuagagggguugcuccccugcaucucggaaagugcaacaucgccggcuggauucuggggaauccugaaugugagucucugagcacagccuccucuuggagcuacaucguggaaaccuccggaucugacaacggcacgugcuauccgggggauuuuauugacuacgaggagcuccgggaacagcugagcuccgucagcucuuucgagcgcuuugaaaucuuccccaagaccuccagcuggccuaaucacgauucuaacaagggagugacagccgcuuguccccaagccggcgcgaaaggcuuuuauaagaaucuuaucuggcugguuaaaaaggggaacuccuacccuaaacucagcaagucuuauauuaaugacaagggaaaagaggugcugguccuuuggggcauccaucaccccuccaccacagccgaucagcagagccuguaccagaacgcugacaccuacguguucguggggacguccagauauucuaagaaauuuaagccugagauugccauccggccgaaaguccgcgaucaagaaggaagaaugaauuacuauuggacacucguugagcccggcgacaagauuaccuucgaagcuacagggaaccugguggugccucgguacgccuuugcgauggagcgcaacgccggaagcggcaucauuaucuccgauacccccguccacgacugcaauaccacaugucagacgccuaaaggcgcuaucaacaccagccugcccuuccagaauauucauccgaucacaauugggaagugcccuaaguaugugaaaucuaccaagcucagacuggccacaggacuucggaacguucccuccauccagagccgcggccuguuuggggcuauugccggauucaucgaaggcggguggaccggaaugguggacggcugguacggcuaucaccaucaaaaugagcaggggucuggauacgccgcugaucucaaaagcacgcagaacgcgaucgacaagauuacaaauaaagucaacuccgugaucgagaagaugaauacccaguuuaccgccguuggcaaggaauuuaaccaccuggagaaaagaauugaaaaucuuaacaagaaaguggaugacggguuccuggauaucuggacauacaaugcugagcuccugguccugcucgaaaacgagcggacccuggacuaucacgauucuaaugugaagaaccuuuacgagaaaguccgcaaccaacugaagaauaacgccaaggaaauuggaaauggcuguuucgaguucuaucauaaaugcgacaacacauguauggaaagcgugaagaaugggacguacgauuauccuaaauacuccgaggaagccaagcucaacagagaggagaucgacggcguuaaacuggaaagcacccggaucuaucagauucuugcuaucuacucuacaguggccuccagccugguccucgugguuucucugggagcgauuuccuuuuggaugugcagcaauggcucccugcagugccgcaucuguauuuga

SEQ ID NO: 193453 - RNA, 1701 nt, Artificial Sequence
  derived and/or modified sequence opt5 from hemagglutinin__InfluenzaA__AGU01881
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguuacaccccuccaucugggcaaaugcaacaucgccggguggauucugggaaauccugagugugaaucucucagcaccgccuccucuuggagcuacaucguggagacguccucuagcgacaacggaaccugcuauccgggggauuuuauuaauuacgaagaacugcgggagcagcuuuccagcgucucuuccuucgaacgcuuugagauguuccccaagacaagcucuuggccuaaccacgacuccaauaagggagugaccgcugccuguccccaagcuggcgccaagagcuuuuauaaaaaccugaucuggcucguuaaaaagggcaauucuuacccuaaacuguccaagagcuauaucaacgauaaggggaaagaagugcuuguccuguggggcauucaucaccccuccacaaccgcggaccagcagucucucuaccagaaugccgaugcuuacguguucgugggcacgagcagauauuccaagaaauuuaagccugagaucgccauucggccgaaaguccgcgaccaagaggggagaaugaacuacuauuggacacugaucgaacccggagauaagauuaccuucgaggcuacaggcaaccugguugugccucgguacgccuuugcgauggaacgcaaugccgggagcggaaucauuaucucugacacccccgugcacgauugcaacaccacaugucagacgccugagggcgcuaucaauaccucccuccccuuccagaacauucauccgaucacaauuggcaaaugcccuaaguaugucaagagcaccaaacugagacuugccacagggcugcggaaugugcccucuauccagagccgcggacucuuuggcgcuauugccggguucaucgaaggaggcuggaccgggaugguugacggaugguacggcuaucaccaucaaaacgagcagggcuccggguacgccgcugaccugaagucuacgcagaaugcgaucgauaaaauuacaaacaaggugaauagcgucaucgagaaaaugaacacccaguuuaccgccgugggaaaggaguucaaucaccuugagaagagaauugaaaaccugaauaaaaagguugacgauggcuuccucgacaucuggacauacaacgcugagcugcuggugcuccuggaaaaugagcggacccuugauuaucacgacuccaacgucaaaaaccuguacgagaaggugcgcaaucaacucaaaaacaaugccaaggaaauugggaacggauguuuugaguucuaucauaagugcgauaauacauguauggaaagcgucaaaaacggcacguacgacuauccuaaguacucugaggaagccaaacugaauagagagaagaucgauggggugaaacuugaguccacccggaucuaucagauucuggcuaucuacagcacaguugccucuucccucgugcuggucgugagccugggcgcgauuuccuuuuggaugugcucuaacggaagccuccagugccgcaucuguauuuga

SEQ ID NO: 193454 - RNA, 1701 nt, Artificial Sequence
  derived and/or modified sequence opt5 from hemagglutinin__InfluenzaA__AGU01883
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaagugcaacaucgccggguggauucugggaaauccugagugugaaucucugagcacagccuccucuuggagcuacaucguggagaccuccggcucugacaacgggacgugcuauccgggagauuuuauugacuacgaagaacuccgggagcagcugagcuccgucagcucuuucgaacgcuuugagaucuuccccaagaccuccagcuggccuaaucacgauucuaacaagggcgugacagccgcuuguccccaugccggcgcgaaaggguuuuauaagaaucuuaucuggcugguuaaaaagggaaacuccuacccuaaacucagcauuucuuauaucaauaacaaggaaaaggaggugcugguccuuuggggcauucaccaccccuccaccacagccgaccaacagagccuguaccagaaugcugauaccuacguguucguggggacguccagauauucuaaaaaguuuaaaccugagaucgccauucggccgaagguccgcgaccaggaaggaagaaugaacuacuauuggacacucguugagcccggcgauaaaaucaccuucgaagcuacagggaaccugguggugccucgguacgccuuugcgauggagcgcaaugccggaagcggcauuaucaucuccgacacccccguccaugauugcaacaccacaugucaaacgccuaagggcgcuauuaauaccagccugcccuuccagaacauccacccgauuacaaucgggaaaugcccuaaguaugugaagucuaccaaacucagacuggccacaggacuucggaauguucccuccauucagagccgcggccuguuuggggcuaucgccggauucaucgaaggcggguggaccggaaugguggacggcugguacggcuaucaucaccagaacgagcaagggucuggauacgccgcugaccucaagagcacgcagaaugcgauugauaaaaucacaaacaaggucaauuccgugauugagaaaaugaacacccaguuuaccgccguuggcaaggaguucaaucaccuggagaagagaaucgaaaaccuuaauaaaaagguggacgauggguuccuggacauuuggacauacaacgcugagcuccugguccugcucgaaaaugagcggacccuggauuaucaugacucuaacgugaaaaaccuuuacgagaagguccgcaaucagcugaaaaacaaugccaaggaaaucggaaacggcuguuuugaguucuaucacaagugcgauaauacauguauggaaagcgugaaaaacgggacguacgacuauccuaaguacuccgaggaagccaaacucaauagagaggagaucgauggcguuaagcuggaaagcacccggauuuaucaaauccuugcuauuuacucuacagccgcguccagccuggugcucgucgugucucugggagcuaucuccuuuuggaugugcagcaacggcucccugcagugccgcauuuguaucuga

SEQ ID NO: 193455 - RNA, 1701 nt, Artificial Sequence; identical to SEQ ID NO: 193084
  derived and/or modified sequence opt5 from hemagglutinin__InfluenzaA__AGU01884

SEQ ID NO: 193456 - RNA, 1701 nt, Artificial Sequence
  derived and/or modified sequence opt5 from hemagglutinin__InfluenzaA__AGU01885
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugagaaacuguguaaacuuagagggguugcuccccugcaucucggaaagugcaacaucgccggcuggauucuggggaauccugaaugugagucucugagcacagccuccucuuggagcuacaucguggaaaccuccggaucugacaacggcacgugcuauccgggggauuuuauugacuacgaggagcuccgggaacagcugagcuccgucagcucuuucgagcgcuuugaaaucuuccccaagaccuccagcuggccuaaucacgauucuaacaagggagugacagccgcuuguccccaagccggcgcgaaaggcuuuuauaagaaucuuaucuggcugguuaaaaaggggaacuccuacccuaaacucagcaagucuuauauuaaugacaagggaaaagaggugcugguccuuuggggcauccaucaccccuccaccacagccgaucagcagagccuguaccagaacgcugacaccuacguguucguggggacguccagauauucuaagaaauuuaagccugagauugccauccggccgaaaguccgcgaucaagaaggaagaaugaauuacuauuggacacucguugagcccggcgacaagauuaccuucgaagcuacagggaaccugguggugccucgguacgccuuugcgauggagcgcaacgccggaagcggcaucauuaucuccgauacccccguccacgacugcaauaccacaugucagacgccuaaaggcgcuaucaacaccagccugcccuuccagaaugugcauccgauuacaaucgggaagugcccuaaguauguuaaaucuaccaagcucagacuggccacaggacuucggaacgugcccuccauucagagccgcggccuguuuggggcuaucgccggauucauugaaggcggguggaccggaauggucgacggcugguacggcuaucaccaucaaaaugagcaggggucuggauacgccgcugaucucaaaagcacgcagaacgcgaucgacaagaucacaaauaaagugaacuccguuauugagaagaugaauacccaguuuaccgccgugggcaaggaauuuaaccaccuggagaaaagaaucgaaaaucuuaacaagaaagucgaugacggguuccuggauauuuggacauacaaugcugagcuccuggugcugcucgaaaacgagcggacccuggacuaucacgauucuaaugucaagaaccuuuacgagaaagugcgcaaccaacugaagaauaacgccaaggaaaucggaaauggcuguuucgaguucuaucauaaaugcgacaacacauguauggaaagcguuaagaaugggacguacgauuauccuaaauacuccgaggaagccaagcucaacagagaggagauugacggcgugaaacuggaaagcacccggaucuaucagauccuugcuauuuacucuacagucgccuccagccuggugcucguugugucucugggagcgaucuccuuuuggaugugcagcaauggcucccugcagugccgcauuuguaucuga

SEQ ID NO: 193457 - RNA, 1701 nt, Artificial Sequence
  derived and/or modified sequence opt5 from hemagglutinin__InfluenzaA__AGU01887
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacagccgaccaacagucucucuaccagaaugcugaugccuacguguucgugggcaccagcagauauuccaagaaauuuaagccugagauugcuauccggccgaaaguccgcgaccaggaggggagaaugaacuacuauuggacgcugauugaacccggagauaagaucacauucgaggccaccggcaaccugguugugccucgguacgcguuugccguggaacgcaaugcugggagcggaauuaucaucucugacacacccguccauaacugcaauaccaccugucaaacaccugagggcgccauuaacacgucccuccccuuccagaauauccacccgauuaccaucggcaaaugcccuaaguauguuaagagcacaaaacugagacuugcuaccgggcugcggaacgugcccucuauucagagccgcggacucuuuggcgccaucgccggguucaucgaaggaggcuggacagggaugguggauggaugguacggcuaucaucaccagaaugagcaaggcuccggguacgcugcggaccugaagucuacccagaacgccauugacaaaaucacgaauaaggucaacagcgugauugagaaaaugaauacacaguuuaccgcuguuggaaaggaguucaaccaccuugagaagagaaucgaaaaucugaacaaaaagguggaugacggcuuccucgauauuuggaccuacaaugccgagcugcugguccuccuggaaaacgagcggacacuugacuaucaugauuccaacgugaaaaaucuguacgagaagguccgcaaccagcucaaaaauaacgccaaggaaaucgggaauggauguuuugaguucuaucacaagugcgacaacaccuguauggaaagcgugaaaaauggcacauacgauuauccuaaguacucugaggaagcuaaacugaacagagagaagaucgacgggguuaaacuugaguccacgcggauuuaucaaauccuggccauuuacagcaccguggcgucuucccucguccuggugguuagccugggcgcuaucuccuuuuggaugugcucuaauggaagccuccagugccgcauuuguaucuga

SEQ ID NO: 193458 - RNA, 1701 nt, Artificial Sequence
  derived and/or modified sequence opt5 from hemagglutinin__InfluenzaA__AGU01888
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaagugcaacaucgccggguggauucugggaaauccugagugugaaucucugagcacagccuccucuuggagcuacaucguggagaccuccggcucugacaacgggacgugcuauccgggagauuuuauugacuacgaggagcuccgggagcagcugagcuccgucagcucuuucgaacgcuuugagaucuuccccaagaccuccagcuggccuaaucacgauucuaacaagggcgugacagccgcuuguccccaagccggcgcgaaaggguuuuauaagaaucuuaucuggcugguuaaaaagggaaacuccuacccuaaacucagcaagucuuauauuaaugacaagggcaaagaagugcugguccuuugggggauccaucaccccuccaccacagccgaucagcagagccuguaccagaacgcugacaccuacguguucgugggaacguccagauauucuaagaaauuuaagccugagauugccauccggccgaaaguccgcgaucaagagggcagaaugaauuacuauuggacacucguugaacccggggacaagauuaccuucgaggcuacaggaaaccugguggugccucgguacgccuuugcgauggaacgcaacgccggcagcggcaucauuaucuccgauacccccguccacgacugcaauaccacaugucagacgccuaaaggggcuaucaacaccagccugcccuuccagaauauucauccgaucacaauuggaaagugcccuaaguaugugaaaucuaccaagcucagacuggccacaggccuucggaacguucccuccauccagagccgcgggcuguuuggagcuauugccggcuucaucgaagggggauggaccggcaugguggacggcugguacggguaucaccaucaaaaugaacagggaucuggcuacgccgcugaucucaaaagcacgcagaacgcgaucgacaagauuacaaauaaagucaacuccgugaucgagaagaugaauaccagauuuaccgccguugggaaggaguucaaccaccuggaaaaacggauugagaaucuuaacaagaaaguggaugacggauuccuggauaucuggacauacaaugcugaacuccugguccugcucgagaacgaacgcacccuggacuaucacgauucuaaugugaagaaccuuuacgagaaagucagaaaccagcugaagaauaacgccaaggagauuggcaauggguguuuugaguucuaucauaaaugcgacaacacauguauggaaagcgugaagaauggcacguacgauuauccuaaauacuccgaagaggccaagcucaaccgggaagagaucgacggaguuaaacuggagagcacccgcaucuaucaaauucuugcuaucuacucuacaguggccuccagccugguccucgugguuucucugggcgcgauuuccuuuuggaugugcagcaaugggucccugcagugcagaaucuguauuuga

SEQ ID NO: 193459 - RNA, 1701 nt, Artificial Sequence; identical to SEQ ID NO: 193450
  derived and/or modified sequence opt5 from hemagglutinin__InfluenzaA__AGU01889

SEQ ID NO: 193460 - RNA, 1701 nt, Artificial Sequence
  derived and/or modified sequence opt5 from hemagglutinin__InfluenzaA__AGU01890
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaaaugcaacaucgccggguggauucugggaaauccugagugugaaucucugagcacagccuccucuuggagcuacaucguggagaccuccggcucugacaacgggacgugcuauccgggagauuuuauugacuacgaggagcuccgggagcagcugagcuccgucagcucuuucgaacgcuuugagaucuuccccaagaccuccagcuggccuaaucacgauucuaacaagggcgugacagccgcuuguccccaagccggcgcgaaaggguuuuauaagaaucuuaucuggcugguuaaaaagggaaacuccuacccuaaacucagcaagucuuauauuaaugacaagggcaaagaagugcugguccuuugggggauccaucaccccuccaccacagccgaucagcagagccuguaccagaacgcugacaccuacguguucgugggaacguccagauauucuaagaaauuuaagccugagauugccauccggccgaaaguccgcgaucaagagggcagaaugaauuacuauuggacacucguugaacccggggacaagauuaccuucgaggcuacaggaaaccugguggugccucgguacgccuuugcgauggaacgcaacgccggcagcggcaucauuaucuccgauacccccguccacgacugcaauaccacaugucagacgccuaaaggggcuaucaacaccagccugcccuuccagaauauucauccgaucacaauuggaaagugcccuaaguaugugaaaucuaccaagcucagacuggccacaggccuucggaacguucccuccauccagagccgcgggcuguuuggagcuauugccggcuucaucgaagggggauggaccggcaugguggacggcugguacggguaucaccaucaaaaugaacagggaucuggcuacgccgcugaucucaaaagcacgcagaacgcgaucgacaagauuacaaauaaagucaacuccgugaucgagaagaugaauacccaguuuaccgccguugggaaggaguucaaccaccuggaaaagagaauugagaaucuuaacaagaaaguggaugacggauuccuggauaucuggacauacaaugcugaacuccugguccugcucgagaacgaacggacccuggacuaucacgauucuaaugugaagaaccuuuacgagaaaguccgcaaccaacugaagaauaacgccaaggagauuggcaauggguguuuugaguucuaucauaaaugcgacaacacauguauggaaagcgugaagaauggcacguacgauuauccuaaauacuccgaagaggccaagcucaacagagaagagaucgacggaguuaaacuggagagcacccggaucuaucagauucuugcuaucuacucuacaguggccuccagccugguccucgugguuucucugggcgcgauuuccuuuuggaugugcagcaaugggucccugcagugccgcaucuguauuuga

SEQ ID NO: 193461 - RNA, 1701 nt, Artificial Sequence
  derived and/or modified sequence opt5 from hemagglutinin__InfluenzaA__AGU92645
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaacacucucuaccgccagcuccuggucuuacaucguggagacgagcuccucugacaacgggaccugcuauccgggcgauuuuauugacuacgaagaacugcgggagcagcuuagcuccgucagcucuuucgaacgcuuugagaucuuccccaagacauccagcuggccuaaucacgauucuaacaagggagugaccgccgcuuguccccaugccggcgcgaaaggcuuuuauaagaaucugaucuggcucguuaaaaaggggaacuccuacccuaaacugagcaagucuuauauuaaugacaagggaaaagaagugcuuguccuguggggcauccaccaccccuccacaaccgccgaucaacagagccucuaccagaacgcugacacguacguguucguggggacauccagauauucuaagaaauuuaagccugagauugagacccggccgaaaguccgcgaucaggaaggaagaaugaauuacuauuggacacugguugagcccggcgacaagaucaccuucgaagccaccgggaaccugguggugccucgguacgcuuuugccauggagcgcgaugcgggaagcggcauuaucauuuccgacacacccguccaugacugcaacacgaccugucaaacaccuaaaggcgccaucaauaccagccuccccuuccagaacauccacccgauuacaaucgggaagugcccuaaguaugugaaaucuaccaagcugagacuugcuacgggacugcggaauguucccuccauucagagccgcggccucuuuggggccaucgcuggauucauugaaggcggguggacaggaaugguggauggcugguacggcuaucaucaccagaacgagcaagggucuggauacgccgccgaccugaaaagcacccagaaugcuaucgauaagaucaccaacaaagucaauuccgugauugagaagaugaacacacaguuuaccgcgguuggcaaggaguucaaucaccuugagaaaagaaucgaaaaccugaauaagaaaguggacgauggguuccucgacauuuggacauacaacgccgagcugcugguccuccuggaaaaugagcggacgcuugauuaucaugacucuaacgugaagaaucuguacgagaaaguccgcaaccagcucaagaacaaugcuaaggaaaucggaaacggcuguuuugaguucuaucacaaaugcgauaauaccuguauggaaagcgugaagaacgggacauacgacuauccuaaauacuccgaggaagccaagcugaauagagaggagauugauggcguuaaacuugaaagcacccggaucuaucaaauccuggccauuuacucuacagcugccuccagccucgugcuggucgugucucugggagcgaucuccuuuuggaugugcagcaacggcucccuccagugccgcauuuguaucuga

SEQ ID NO: 193462 - RNA, 1701 nt, Artificial Sequence
  derived and/or modified sequence opt5 from hemagglutinin__InfluenzaA__AGU92667
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaacacucucuaccgccagcuccuggucuuacaucguggagacgagcuccucugacaacgggaccugcuauccgggcgauuuuauugacuacgaagaacugcgggagcagcuuagcuccgucagcucuuucgaacgcuuugagaucuuccccaagacauccagcuggccuaaucacgauucuaacaagggagugaccgccgcuuguccccaugccggcgcgaaaggcuuuuauaagaaucugaucuggcucguuaaaaaggggaacuccuacccuaaacugagcaagucuuauauuaaugacaagggaaaagaagugcuuguccuguggggcauccaccaccccuccacaaccgccgaucaacagagccucuaccagaacgcugacacguacguguucguggggacauccagauauucuaagaaauuuaagccugagauugccacccggccgaaaguccgcgaucaggagggaagaaugaauuacuauuggacacugguugaacccggcgacaagaucaccuucgaggcuaccgggaaccugguggugccucgguacgccuuugcgauggaacgcgaugccggaagcggcauuaucauuuccgacacacccguccaugacugcaacacgaccugucaaacaccuaaaggcgcuaucaauaccagccuccccuuccagaacauccacccgauuacaaucgggaagugcccuaaguaugugaaaucuaccaagcugagacuugccacgggacugcggaauguucccuccauucagagccgcggccucuuuggggcuaucgccggauucauugagggcggguggacaggaaugguggauggcugguacggcuaucaucaccagaacgaacaagggucuggauacgccgcugaccugaaaagcacccagaaugcgaucgauaagaucaccaacaaagucaauuccgugauugagaagaugaacacacaguuuaccgccguuggcaaggaguucaaucaccuugagaaaagaaucgagaaccugaauaagaaaguggacgauggguuccucgacauuuggacauacaacgcugaacugcugguccuccuggagaaugaacgggcccuugauuaucaugacucuaacgugaagaaucuguacgagaaaguccgcaaccagcucaagaacaaugccaaggagaucggaaacggcuguuuugaguucuaucacaaaugcgauaauacguguauggaaagcgugaagaacgggaccuacgacuauccuaaauacuccgaagaggcuaagcugaauagagaagagauugauggcguuaaacuugagagcacacggaucuaucaaauccuggccauuuacucuaccgcggcuuccagccucgugcuggucgugucucugggagccaucuccuuuuggaugugcagcaacggcucccuccagugccgcauuuguaucuga

SEQ ID NO: 193463 - RNA, 1701 nt, Artificial Sequence
  derived and/or modified sequence opt5 from hemagglutinin__InfluenzaA__AGU92678
augaaggccauccuggugguccuccuguacaccuucgcuacagccaacgcggacacgcuuugcauuggccaccaugcuaauaacagcaccgauacaguugacaccgugcuggagaaaaaugugacagucacccacuccgugaaccuccuggaagauaagcauaaugggaaacuuuguaagcugagaggaguugcuccccuccaccugggcaaaugcaacaucgccggguggauucugggaaauccugagugugaaacacucucuaccgccagcuccuggucuuauaucguggagacgagcuccucugacaacgggaccugcuacccgggcgauuuuauugacuaugaagaacugcgggagcagcuuagcuccgucagcucuuucgaacgcuuugagaucuuccccaagacauccagcuggccuaaucaugauucuaacaagggagugaccgccgcuuguccccacgccggcgcgaaaggcuuuuacaagaaucugaucuggcucguuaaaaaggggaacuccuauccuaaacugagcaagucuuacauuaaugacaagggaaaagaagugcuuguccuguggggcauccaccaucccuccacaaccgccgaucaacagagccucuaucagaacgcugacacguacguguucguggggacauccagauacucuaagaaauuuaagccugagauugccacccggccgaaaguccgcgaucaggagggaagaaugaauuauuacuggacacugguugaacccggcgacaagaucaccuucgaggcuaccgggaaccugguggugccucgguaugccuuugcgauggaacgcgaugccggaagcggcauuaucauuuccgacacacccguccacgacugcaacacgaccugucaaacaccuaaaggcgcuaucaauaccagccuccccuuccagaacauccauccgauuacaaucgggaagugcccuaaguacgugaaaucuaccaagcugagacuugccacgggacugcggaauguucccuccauucagagccgcggccucuuuggggcuaucgccggauucauugagggcggguggacaggaaugguggauggcugguauggcuaccaccaccagaacgaacaagggucuggauaugccgcugaccugaaaagcacccagaaugcgaucgauaagaucaccaacaaagucaauuccgugauugagaagaugaacacacaguuuaccgccguuggcaaggaguucaaucaucuugagaaaagaaucgagaaccugaauaagaaaguggacgauggguuccucgacauuuggacauacaacgcugaacugcugguccuccuggagaaugaacggacgcuugauuaccacgacucuaacgugaagaaucuguaugagaaaguccgcaaccagcucaagaacaaugccaaggagaucggaaacggcuguuuugaguucuaccauaaaugcgauaauaccuguauggaaagcgugaagaacgggacauaugacuacccuaaauauuccgaagaggccaagcugaauagagaagagauugauggcguuaaacuugagagcacccggaucuaccaaauccuggcuauuuauucuacagccgcguccagccucgugcuggucgugucucugggagcuaucuccuuuuggaugugcagcaacggcucccuccagugccgcauuuguaucuga

SEQ ID NO: 193464 - RNA, 1701 nt, Artificial Sequence
  derived and/or modified sequence opt5 from hemagglutinin__InfluenzaA__AGU92711
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaacaaggcaacagcuacccuaagcuguccaaaagcuauauuaaugacaaggggaaggaagugcuuguccuguggggaauccaccaccccuccaccucugccgaucagcagagccucuaccagaacgcugacgccuacguguucgugggcuccagcagauauucuaaaaaguuuaaaccugagauugcuauccggccgaagguccgcgaucaagaggggagaaugaauuacuauuggacacugguugaacccggagacaaaauuaccuucgaggccacgggcaaccugguggugccucgguacgcguuugccauggaacgcaacgcuggguccggaaucauuaucagcgauacacccguccaugacugcaauaccacaugucagaccccuaagggcgccaucaacaccucucuccccuuccagaauauucacccgaucacaauuggcaaaugcccuaaguauguuaagagcacgaaacugagacuugcuaccgggcugcggaacgugcccuccauccagucucgcggacucuuuggcgccauugccggguucaucgagggaggcuggacagggaugguggacggaugguacggcuaucaucaccaaaaugaacagggcagcggguacgcugcggaucugaaguccacccagaacgccaucgacgagauuacaaauaaagucaacagcgugaucgagaagaugaauacccaguuuacggcuguuggaaaagaguucaaccaccuugagaagagaauugaaaaucugaacaagaaaguggaugacggcuuccucgauaucuggacauacaaugccgagcugcugguccuccuggaaaacgagcggacccuugacuaucaugauucuaaugugaagaaccuguacgagaaaguccgcucccaacucaagaacaaugccaaagaaauugggaacggauguuuugaguucuaucacaagugcgacaauaccuguauggaaagcgugaagaacggcacauacgauuauccuaaauacucugaggaagcuaagcugaauagagaggagaucgacgggguuaaacuugaauccacccggaucuaucagauucuggccaucuacagcacaguggcguccucucucguccuggugguuagccugggcgcuauuuccuuuuggaugugcucuaacggaagccuccagugccgcaucuguauuuga

SEQ ID NO: 193465 - RNA, 1701 nt, Artificial Sequence
  derived and/or modified sequence opt5 from hemagglutinin__InfluenzaA__AGU92722
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccgacaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcuccagcagauauucuaagaaauuuaagccugagauugcuauccggccgaaaguccgcgaccaggaggggagaaugaacuacuauuggacacugguugaacccggagauaagauuaccuucgaggccacgggcaaucugguggugccucgguacgcguuugccauggaacgcaacgcuggguccggaaucauuaucagcgacacacccguccaugacugcaacaccacaugucaaaccccuaaaggcgccaucaauaccucucuccccuuccagaacauucacccgaucacaauuggcaagugcccuaaguaugugaaaagcacgaagcugagacuugcuaccgggcugcggaauguucccuccauccagucucgcggacucuuuggcgccauugccggguucaucgagggaggcuggacagggaugguggauggaugguacggcuaucaucaccagaacgaacaaggcagcggguacgcugcggaccugaaauccacccagaaugccaucgaugagauuacaaacaaggucaauagcgugaucgagaaaaugaacacccaguuuacggcuguuggaaaggaguucaaucaccuugagaagagaauugaaaaccugaauaaaaagguggacgauggcuuccucgacaucuggacauacaacgccgagcugcugguccuccuggaaaaugagcggacccuugauuaucaugacucuaacgugaaaaaucuguacgagaagguccgcucccagcucaaaaacaacgccaaggaaauugggaauggauguuuugaguucuaucacaagugcgauaacaccuguauggaaagcgugaaaaauggcacauacgacuauccuaaguacucugaggaagcuaaacugaacagagaggagaucgaugggguuaaacuugaauccacccggaucuaucaaauucuggccaucuacagcacaguggcguccucucucguccuggugguuagccugggcgcuauuuccuuuuggaugugcucuaauggaagccuccagugccgcaucuguauuuga

SEQ ID NO: 193466 - RNA, 1701 nt, Artificial Sequence; identical to SEQ ID NO: 193465
  derived and/or modified sequence opt5 from hemagglutinin__InfluenzaA__AGU92733

SEQ ID NO: 193467 - RNA, 1701 nt, Artificial Sequence
  derived and/or modified sequence opt5 from hemagglutinin__InfluenzaA__AGU92744
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccgacaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcuccagcagauauucuaagaaauuuaagccugagauugcuauccggccgaaaguccgcgaccaggaggggagaaugaacuacuauuggacacugguugaacccggagauaagauuaccuucgaggccacgggcaaucugguggugccucgguacgcguuugccauggaacgcaacgcuggguccggaaucauuaucagcgacacacccguccaugacugcaacaccacaugucaaaccccuaaaggcgccaucaauaccucucuccccuuccagaacauucacccgaucacaauuggcaagugcccuaaguaugugaaaagcacgaagcugagacuugcuaccgggcugcggaauguucccuccauccagucucgcggacucuuuggcgccauugccggguucaucgagggaggcuggacagggaugguggauggaugguacggcuaucaucaccagaacgaacaaggcagcggguacgcugcggaccugaaauccacccagaaugccaucgaugagauuacaaacaaggucaauagcgugaucgagaaaaugaacacccaguuuacggcuguuggaaaggaguucaaucaccuugagaagagaauugaaaaccugaauaaaaagguggacgauggcuuccucgacaucuggacauacaacgccgagcugcugguccuccuggaaaaugagcggacccuugauuaucaugacucuaacgugaaaaaucuguacgagaagguccgcucccagcucaaaaacaacgccaaggaaauugggaauggauguuuugaguucuaucacaagugcgauaacaccuguauggaaagcgugaaaaauggcgcuuacgacuauccuaaguacucugaggaagccaaacugaacagagaggagaucgaugggguuaaacuugaauccacacggaucuaucaaauucuggcgaucuacagcaccguggcuuccucucucguccuggugguuagccugggcgccauuuccuuuuggaugugcucuaauggaagccuccagugccgcaucuguauuuga

SEQ ID NO: 193468 - RNA, 1701 nt, Artificial Sequence
  derived and/or modified sequence opt5 from hemagglutinin__InfluenzaA__AGU92755
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaaggaguuuaaaccugagauugcuauccggccgaagguccgcgaucaggaagggagaaugaauuacuauuggacacugguugagcccggagacaaaauuaccuucgaagccacgggcaaccugguggugccucgguacgcguuugccauggagcgcaacgcuggguccggaaucauuaucagcgauacacccguccaugacugcaauaccacaugucaaaccccuaagggcgccaucaacaccucucuccccuuccagaauauucacccgaucacaauuggcaaaugcccuaaguauguuaagagcacgaaacugagacuugcuaccgggcugcggaacgugcccuccauccagucucgcggacucuuuggcgccauugccggguucaucgaaggaggcuggacagggaugguggacggaugguacggcuaucaucaccagaaugagcaaggcagcggguacgcugcggaucugaaguccacccagaacgccaucgacgagauuacaaauaaagucaacagcgugaucgaaaagaugaauacccaguuuacggcuguuggaaaagaguucaaccaccuugaaaagagaauugagaaucugaacaagaaaguggaugacggcuuccucgauaucuggacauacaaugccgaacugcugguccuccuggagaacgagcggacccuugacuaucaugauucuaaugugaagaaccuguacgaaaaaguccgcucccagcucaagaacaaugccaaagagauugggaacggauguuuugaguucuaucacaagugcgacaauaccuguauggagagcgugaagaacggcacauacgauuauccuaaauacucugaagaggcuaagcugaauagagaggaaaucgacgggguuaaacuugaguccacccggaucuaucaaauucuggccaucuacagcacaguggcguccucucucguccuggugguuagccugggcgcuauuuccuuuuggaugugcucuaacggaagccuccagugccgcaucuguauuuga

SEQ ID NO: 193469 - RNA, 1701 nt, Artificial Sequence
  derived and/or modified sequence opt5 from hemagglutinin__InfluenzaA__AGU92766
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaacacucucuaccgccagcuccuggucuuacaucguggagacgagcuccucugacaacgggaccugcuauccgggcgauuuuauugacuacgaagaacugcgggagcagcuuagcuccgucagcucuuucgaacgcuuugagaucuuccccaagacauccagcuggccuaaucacgaaucuaacaagggagugaccgccgcuuguccccaugccggcgcgaaaggcuuuuauaagaaucugaucuggcucguuaaaaaggggaacuccuacccuaaacugagcaagucuuauauuaaugauaagggaaaagaggugcuuguccuguggggcauccaccaccccuccacaaccgccgaccaacagagccucuaccagaacgcugaugccuacguguucguggggacguccagauauucuaagaaauuuaagccugagauugcuacacggccgaaaguccgcgaccaggaaggaagaaugaauuacuauuggacccugguugagcccggcgauaagaucacauucgaagccaccgggaaccugguggugccucgguacgcguuugccauggagcgcgacgcuggaagcggcauuaucauuuccgauacccccguccaugacugcaacacaacgugucaaaccccuaaaggcgccaucaauacaagccuccccuuccagaacauccacccgauuaccaucgggaagugcccuaaguaugugaaaucuacaaagcugagacuugcuaccggacugcggaauguucccuccauucagagccgcggccucuuuggggccaucgccggauucauugaaggcggguggacgggaaugguggacggcugguacggcuaucaucaccagaacgagcaagggucuggauacgcugcggaucugaaaagcacacagaaugccaucgacaagaucaccaacaaagucaauuccgugauugagaagaugaacacccaguuuacagcuguuggcaaggaguucaaucaccuugagaaaagaaucgaaaaccugaauaagaaaguggaugacggguuccucgauauuuggaccuacaacgccgagcugcugguccuccuggaaaaugagcggacacuugacuaucaugauucuaacgugaagaaucuguacgagaaaguccgcaaccagcucaagaacaaugccaaggaaaucggaaacggcuguuuugaguucuaucacaaaugcgacaauacguguauggaaagcgugaagaacgggaccuacgauuauccuaaauacuccgaggaagcuaagcugaauagagaggagauugacggcguuaaacuugaaagcacacggaucuaucaaauccuggccauuuacucuaccgcggcuuccagccucgugcuggucgugucucugggagccaucuccuuuuggaugugcagcaacggcucccuccagugccgcauuuguaucuga

SEQ ID NO: 193470 - RNA, 1701 nt, Artificial Sequence
  derived and/or modified sequence opt5 from hemagglutinin__InfluenzaA__AGU92777
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaacacucucuaccgccagcuccuggucuuacaucguggagacgagcuccucugacaacgggaccugcuauccgggcgauuuuauugacuacgaagaacugcgggagcagcuuagcuccgucagcucuuucgaacgcuuugagaucuuccccaagacauccagcuggccuaaucacgaaucuaacaagggagugaccgccgcuuguccccaugccggcgcgaaaggcuuuuauaagaaucugaucuggcucguuaaaaaggggaacuccuacccuaaacugagcaagucuuauauuaaugauaagggaaaagaggugcuuguccuguggggcauccaccaccccuccacaaccgccgaccaacagagcauuuaccagaacgcugauacguacguguucguggggacauccagauauucuaagaaauuuaagccugagaucgccacccggccgaaaguccgcgaccaggaaggaagaaugaauuacuauuggacacucguugagcccggcgauaagauuaccuucgaagcuaccgggaaccugguggugccucgguacgccuuugcgauggagcgcgacgccggaagcggcaucauuaucuccgauacacccguccaugacugcaacacgaccugucaaacaccuaaaggcgcuaucaauaccagccugcccuuccagaacauucacccgaucacaauugggaagugcccuaaguaugugaaaucuaccaagcucagacuggccacgggacuucggaauguucccuccauccagagccgcggccuguuuggggcuauugccggauucaucgaaggcggguggacaggaaugguggacggcugguacggcuaucaucaccagaacgagcaagggucuggauacgccgcugaucucaaaagcacccagaaugcgaucgacaagauuaccaacaaagucaauuccgugaucgagaagaugaacacacaguuuaccgccguuggcaaggaguucaaucaccuggagaaaagaauugaaaaccuuaauaagaaaguggaugacggguuccuggauaucuggacauacaacgcugagcuccugguccugcucgaaaaugagcggacgcuggacuaucaugauucuaacgugaagaaucuuuacgagaaaguccgcaaccagcugaagaacaaugccaaggaaauuggaaacggcuguuuugaguucuaucacaaaugcgacaauaccuguauggaaagcgugaagaacgggacauacgauuauccuaaauacuccgaggaagccaagcucaauagagaggagaucgacggcguuaaacuggaaagcacccggaucuaucaaauucuugcuaucuacucuacagccgcguccagccuggugcucgucgugucucugggagcuauuuccuuuuggaugugcagcaacggcucccugcagugccgcaucuguauuuga

SEQ ID NO: 193471 - RNA, 1701 nt, Artificial Sequence
  derived and/or modified sequence opt5 from hemagglutinin__InfluenzaA__AGU92788
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaacacucucuaccgccagcuccuggucuuacaucguggagacgagcuccucugacaacgggaccugcuauccgggggauuuuauugacuacgaagaacugcgggagcagcuuagcuccgucagcucuuucgaacgcuuugagaucuuccccaagacauccagcuggccuaaucacgauucugacaagggagugaccgccgcuuguccccaugccggcgcgaaaggcuuuuauaagaaccugaucuggcucguuaaaaagggcaauuccuacccuaaacugagcaagucuuauauuaacgauaagggaaaagaagugcuuguccuguggggcauccaccaccccuccacaaccgccgaccaacagagccucuaccagaaugcugaugccuacguguucguggggacguccagauauucuaagaaauuuaagccugagauugcuacacggccgaaaguccgcgacagagagggacggaugaacuacuauuggacccugguugaacccggcgauaagaucacauucgaggccaccgggaaucugguggugccucgcuacgcguuugccauggaaagagacgcuggaagcggcauuaucauuuccgacacccccguccaugauugcaacacaacgugucagaccccuaaaggcgccaucaacacaagccuccccuuccaaaauauccacccgauuaccaucgggaagugcccuaaguaugugaaaucuacaaagcugcggcuugcuaccggacugcgcaacguucccuccauucagagcagaggccucuuuggggccaucgccggauucauugagggcggguggacgggaaugcuggacggcugguacggcuaucaucaccagaaugaacaggggucuggauacgcugcggaucuuaaaagcacacaaaacgccaucgacaagaucaccaauaaagugaacuccgucauugagaagaugaauacccaguuuacagcugugggcaaggaguucaaccaccuggaaaaacggaucgagaaucucaacaagaaaguugaugacggguuccuggauauuuggaccuacaaugccgaacugcucgugcugcuugagaacgaacgcacacuggacuaucaugauucuaaugucaagaaccucuacgagaaagugagaaaucagcugaagaacaacgccaaggagaucggaaauggcuguuuugaguucuaucacaaaugcgacaacacguguauggagagcgucaagaaugggaccuacgauuauccuaaauacuccgaagaggcuaaacuuaaccgggaagagauugacggcgugaagcuggagagcacacgcaucuaucagauccucgccauuuacucuaccgcggcuuccagccugguucugguggucucucucggagccaucuccuuuuggaugugcagcaauggcucccugcaaugcagaauuuguaucuga

SEQ ID NO: 193472 - RNA, 1701 nt, Artificial Sequence
  derived and/or modified sequence opt5 from hemagglutinin__InfluenzaA__AGU92799
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaacacucucuaccgccagcuccuggucuuacaucguggagacgagcuccucugacaacgggaccugcuauccgggggauuuuauugacuacgaagaacugcgggagcagcuuagcuccgucagcucuuucgaacgcuuugagaucuuccccaagacauccagcuggccugaucacgacucuaauaagggagugaccgccgcuuguccccaugccggcgcgaaaggcuuuuauaagaaccugaucuggcucguuaaaaagggcaauuccuacccuaaacugagcaagucuuauauuaacgauaagggaaaagaagugcuuguccuguggggcauccaccaccccuccacaaccgccgaccaacagagccucuaccagaaugcugaugccuacguguucguggggacguccagauauucuaagaaauuuaagccugagauugcuacacggccgaaaguccgcgacagagagggacggaugaacuacuauuggacccugguugaacccggcgauaagaucacauucgaggccaccgggaaucugguggugccucgcuacgcguuugccauggaaagagacgcuggaagcggcauuaucauuuccgacacccccguccaugauugcaacacaacgugucagaccccuaaaggcgccaucaacacaagccuccccuuccaaaauauccacccgauuaccaucgggaagugcccuaaguaugugaaaucuacaaagcugcggcuugcuaccggacugcgcaacguucccuccauucagagcagaggccucuuuggggccaucgccggauucauugagggcggguggacgggaaugguggacggcugguacggcuaucaucaccagaaugaacaggggucuggauacgcugcggaucugaaaagcacacaaaacgccaucgacaagaucaccaauaaagucaacuccgugauugagaagaugaauacccaguuuacagcuguuggcaaggaguucaaccaccuugaaaaacggaucgagaaucugaacaagaaaguggaugacggguuccucgauauuuggaccuacaaugccgaacugcugguccuccuggagaacgaacgcacacuugacuaucaugauucuaaugugaagaaccuguacgagaaagucagaaaucagcucaagaacaacgccaaggagaucggaaauggcuguuuugaguucuaucacaaaugcgacaacacguguauggagagcgugaagaaugggaccuacgauuauccuaaauacuccgaagaggcuaagcugaaccgggaagagauugacggcguuaaacuugagagcacacgcaucuaucagauccuggccauuuacucuaccgcggcuuccagccucgugcuggucgugucucugggagccaucuccuuuuggaugugcagcaauggcucccuccaaugcagaauuuguaucuga

SEQ ID NO: 193473 - RNA, 1701 nt, Artificial Sequence
  derived and/or modified sequence opt5 from hemagglutinin__InfluenzaA__AGU92821
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaacacucucuaccgccagcuccuggucuuacaucguggagacgagcuccucugacaacgggaccugcuauccgggcgauuuuauugacuacgaagaacugcgggagcagcuuagcuccgucagcucuuucgaacgcuuugagaucuuccccaagacauccagcuggccuaaucacgauucuaacaagggagugaccgccgcuuguccccaugccggcgcgaaaggcuuuuauaagaaucugaucuggcucguuaaaaaggggaacuccuacccuaaacugagcaagucuuauauuaaugacaagggaaaagaagugcuuguccuguggggcauccaccaccccuccacaaccgccgaucaacagagccucuaccagaacgcugacacguacguguucguggggacauccagauauucuaagauguuuaaaccugagauugccacccggccgaagguccgcgauagagagggacggaugaauuacuauuggacacugguugaacccggcgacaaaaucaccuucgaggcuaccgggaaccugguggugccucgcuacgccuuugcgauggaaagagaugccggaagcggcauuaucauuuccgacacacccguccaugacugcaacacgaccugucagacaccuaagggcgcuaucaauaccagccuccccuuccaaaacauccacccgauuacaaucgggaaaugcccuaaguaugugaagucuaccaaacugcggcuugccacgggacugcgcaauguucccuccauucagagcagaggccucuuuggggcuaucgccggauucauugagggcggguggacaggaaugguggauggcugguacggcuaucaucaccagaacgaacaggggucuggauacgccgcugaccuuaagagcacccaaaaugcgaucgauaaaaucaccaacaaggucaauuccgugauugagaaaaugaacacacaguuuaccgccguuggcaaggaguucaaucaccuugaaaagcggaucgagaaccugaauaaaaagguggacgauggguuccucgacauuuggacauacaacgcugaacugcugguccuccuggagaaugaacgcacgcuugauuaucaugacucuaacgugaaaaaucuguacgagaaggucagaaaccagcucaaaaacaaugccaaggagaucggaaacggcuguuuugaguucuaucacaagugcgauaauaccuguauggagagcgugaaaaacgggacauacgacuauccuaaguacuccgaagaggccaaacugaaucgggaagagauugauggcguuaagcuggagagcacccgcaucuaucagauccuggcuauuuacucuacagccgcguccagccucgugcuggucgugucucugggagcuaucuccuuuuggaugugcagcaacggcucccuccaaugcagaauuuguaucuga

SEQ ID NO: 193474 - RNA, 1701 nt, Artificial Sequence
  derived and/or modified sequence opt5 from hemagglutinin__InfluenzaA__AGU92843
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcgacagcuacccuaaacuguccaagagcuauauuaacgauaaggggaaagaagugcuuguccuguggggaauccaccaccccuccaccucugccgaccaacagagccucuaccagaaugcugaugccuacguguucgugggcuccagcagauauucuaagaaauuuaagccugagauugcuauccggccgaaaguccgcgacagagaggggcggaugaacuacuauuggacacugguugaacccggagauaagauuaccuucgaggccacgggcaaucugguggugccucgcuacgcguuugccauggaaagaaacgcuggguccggaaucauuaucagcgacacacccguccaugacugcaacaccacaugucagaccccuaaaggcgccaucaauaccucucuccccuuccaaaacauucacccgaucacaauuggcaagugcccuaaguaugugaaaagcacgaagcugcggcuugcuaccgggcugcgcaauguucccuccauccagucuagaggacucuuuggcgccauugccggguucaucgagggaggcuggacagggaugguggauggaugguacggcuaucaucaccagaacgaacagggcagcggguacgcugcggaccugaaauccacccaaaaugccaucgaugagauuacaaacaaggucaauagcgugaucgagaaaaugaacacccaguuuacggcuguuggaaaggaguucaaucaccuugagaagcggauugaaaaccugaauaaaaagguggacgauggcuuccucgacaucuggacauacaacgccgagcugcugguccuccuggaaaaugagcgcacccuugauuaucaugacucuaacgugaaaaaucuguacgagaaggucagaucccagcucaaaaacaacgccaaggaaauugggaauggauguuuugaguucuaucacaagugcgauaacaccuguauggaaagcgugaaaaauggcacauacgacuauccuaaguacucugaggaagcuaaacugaaccgggaggagaucgaugggguuaaacuugaauccacccgcaucuaucagauucuggccaucuacagcacaguggcguccucucucguccuggugguuagccugggcgcuauuuccuuuuggaugugcucuaauggaagccuccaaugcagaaucuguauuuga

SEQ ID NO: 193475 - RNA, 1710 nt, Artificial Sequence
  derived and/or modified sequence opt5 from hemagglutinin__InfluenzaA__AGU92854
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccgacaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcuccagcagauauucuaagaaauuuaagccugagauugcuauccggccgaaaguccgcgacagagaggggcggaugaacuacuauuggacacugguugaacccggagauaagauuaccuucgaggccacgggcaaucugguggugccucgcuacgcguuugccauggaaagaaacgcuggguccggaaucauuaucagcgacacacccguccaugacugcaacaccacaugucagaccccuaaaggcgccaucaauaccucucucacaagccugcccuuccaaaacauucacccgaucacgauuggcaagugcccuaaguaugugaaauccaccaaacuucggcuggcuacagggcuccgcaauguucccucuauccagagcagaggacuguuuggcgccauugccggguucaucgagggaggcuggaccgggaugguggauggaugguacggcuaucaucaccagaacgaacagggcuccggguacgcugcggaccuuaagagcacacaaaaugccaucgaugagauuaccaacaaggucaauucugugaucgagaaaaugaacacgcaguuuacagcuguuggaaaggaguucaaucaccuggagaagcggauugaaaaccucaauaaaaagguggacgauggcuuccuggacaucuggaccuacaacgccgagcugcucguccugcuugaaaaugagcgcacccuggauuaucaugacuccaacgugaaaaaucucuacgagaaggucagaagccagcugaaaaacaacgccaaggaaauugggaauggauguuuugaguucuaucacaagugcgauaacacauguauggaaucugugaaaaauggcaccuacgacuauccuaaguacuccgaggaagcuaaacuuaaccgggaggagaucgaugggguuaagcuggaaagcacacgcaucuaucagauucucgccaucuacuccacgguggcgucuagccugguccuggugguuucccucggcgcuauuucuuuuuggaugugcagcaauggaucccugcaaugcagaaucuguauuuga

SEQ ID NO: 193476 - RNA, 1701 nt, Artificial Sequence
  derived and/or modified sequence opt5 from hemagglutinin__InfluenzaA__AGU92887
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugaugaccaacagagccucuaccagaacgccgaugcuuacguguucgugggcuccagcagauauucuaagaaauuuaagccugagauugccauccggccgaaaguccgcgacagagaggggcggaugaauuacuauuggacacugguugaacccggagauaagauuaccuucgaggcuacgggcaaccugguggugccucgcuacgccuuugcgauggaaagaaacgccggguccggaaucauuaucagcgacacacccguccaugacugcaauaccacaugucagaccccuaaaggcgcuaucaacaccucucuccccuuccaaaauauucacccgaucacaauuggcaagugcccuaaguaugugaaaagcacgaagcugcggcuugccaccgggcugcgcaacguucccuccauccagucuagaggacucuuuggcgcuauugccggguucaucgagggaggcuggacagggaugguggauggaugguacggcuaucaucaccagaaugaacagggcagcggguacgccgcugaccugaaauccacccaaaacgcgaucgaugagauuacaaauaaggucaacagcgugaucgagaaaaugaauacccaguuuacggccguuggaaaggaguucaaccaccuugagaagcggauugaaaaucugaacaaaaagguggacgauggcuuccucgacaucuggacauacaaugcugagcugcugguccuccuggaaaacgagcgcacccuugauuaucaugacucuaaugugaaaaaccuguacgagaaggucagaucccagcucaaaaacaaugccaaggaaauugggaacggauguuuugaguucuaucacaagugcgauaauaccuguauggaaagcgugaaaaacggcacauacgacuauccuaaguacucugaggaagccaaacugaaucgggaggagaucgaugggguuaaacuugaauccacccgcaucuaucagauucuggcuaucuacagcacaguggccuccucucucguccuggugguuagccugggcgcgauuuccuuuuggaugugcucuaacggaagccuccaaugcagaaucuguauuuga

SEQ ID NO: 193477 - RNA, 1701 nt, Artificial Sequence; identical to SEQ ID NO: 193461
  derived and/or modified sequence opt5 from hemagglutinin__InfluenzaA__AGU92898

SEQ ID NO: 193478 - RNA, 1701 nt, Artificial Sequence; identical to SEQ ID NO: 193462
  derived and/or modified sequence opt5 from hemagglutinin__InfluenzaA__AGU92909

SEQ ID NO: 193479 - RNA, 1701 nt, Artificial Sequence; identical to SEQ ID NO: 193464
  derived and/or modified sequence opt5 from hemagglutinin__InfluenzaA__AGU92931

SEQ ID NO: 193480 - RNA, 1701 nt, Artificial Sequence; identical to SEQ ID NO: 193465
  derived and/or modified sequence opt5 from hemagglutinin__InfluenzaA__AGU92942

SEQ ID NO: 193481 - RNA, 1701 nt, Artificial Sequence; identical to SEQ ID NO: 193465
  derived and/or modified sequence opt5 from hemagglutinin__InfluenzaA__AGU92953

SEQ ID NO: 193482 - RNA, 1701 nt, Artificial Sequence
  derived and/or modified sequence opt5 from hemagglutinin__InfluenzaA__AGU92964
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaacacucucuaccgccagcuccuggucuuacaucguggagacgagcuccucugacaacgggaccugcuauccgggcgauuuuauugacuacgaagaacugcgggagcagcuuagcuccgucagcucuuucgaacgcuuugagaucuuccccaagacauccagcuggccuaaucacgauucuaacaagggagugaccgccgcuuguccccaugccggcgcgaaaggcuuuuauaagaaucugaucuggcucguuaaaaaggggaacuccuacccuaaacugagcaagucuuauauuaaugacaagggaaaagaagugcuuguccuguggggcauccaccaccccuccacaaccgccgaucaacagagccucuaccagaacgcugacgccuacguguucguggggacguccagauauucuaagaaauuuaagccugagauugcuacacggccgaaaguccgcgauagagagggacggaugaauuacuauuggacccugguugaacccggcgacaagaucacauucgaggccaccgggaaccugguggugccucgcuacgcguuugccauggaaagagaugcuggaagcggcauuaucauuuccgacacccccguccaugacugcaacacaacgugucagaccccuaaaggcgccaucaauacaagccuccccuuccaaaacauccacccgauuaccaucgggaagugcccuaaguaugugaaaucuacaaagcugcggcuugcuaccggacugcgcaauguucccuccauucagagcagaggccucuuuggggccaucgccggauucauugagggcggguggacgggaaugcuggauggcugguacggcuaucaucaccagaacgaacaggggucuggauacgcugcggaccuuaaaagcacacaaaaugccaucgauaagaucaccaacaaagucaauuccgugauugagaagaugaacacccaguuuacagcugugggcaaggaguucaaucaccuggaaaaacggaucgagaaccucaauaagaaaguugacgauggguuccuggacauuuggaccuacaacgccgaacugcucgugcugcuugagaaugaacgcacacuggauuaucaugacucuaacgucaagaaucucuacgagaaagugagaaaccagcugaagaacaaugccaaggagaucggaaacggcuguuuugaguucuaucacaaaugcgauaauacguguauggagagcgucaagaacgggaccuacgacuauccuaaauacuccgaagaggcuaaacuuaaucgggaagagauugauggcgugaagcuggagagcacacgcaucuaucagauccucgccauuuacucuaccgcggcuuccagccugguucugguggucucucucggagccaucuccuuuuggaugugcagcaacggcucccugcaaugcagaauuuguaucuga

SEQ ID NO: 193483 - RNA, 1701 nt, Artificial Sequence
  derived and/or modified sequence opt5 from hemagglutinin__InfluenzaA__AGU92975
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaacacucucuaccgccagcuccuggucuuacaucguggagacgagcuccucugacaacgggaccugcuauccgggcgauuuuauugacuacgaagaacugcgggagcagcuuagcuccgucagcucuuucgaacgcuuugagaucuuccccaagacauccagcuggccuaaucacgauucuaacaagggagugaccgccgcuuguccccaugccggcgcgaaaggcuuuuauaagaaucugaucuggcucguuaaaaaggaaaacuccuacccuaaacugagcaagucuuauauuaaugacaaggggaaagaggugcuuguccuguggggaauccaccaccccuccacaaccgccgaucaacagagccucuaccagaacgcugacacguacguguucgugggcacauccagauauucuaagaaauuuaagccugagauugccacccggccgaaaguccgcgauagagaagggcggaugaauuacuauuggacacugguugagcccggagacaagaucaccuucgaagcuaccggcaaccugguggugccucgcuacgccuuugcgauggagagagaugccgggagcggaauuaucauuuccgacacacccguccaugacugcaacacgaccugucagacaccuaaaggcgcuaucaauaccagccuccccuuccaaaacauccacccgauuacaaucggcaagugcccuaaguaugugaaaucuaccaagcugcggcuugccacggggcugcgcaauguucccuccauucagagcagaggacucuuuggcgcuaucgccggguucauugaaggaggcuggacagggaugguggauggaugguacggcuaucaucaccagaacgagcagggcucuggguacgccgcugaccugaaaagcacccaaaaugcgaucgauaagaucaccaacaaagucaauuccgugauugagaagaugaacacacaguuuaccgccguuggaaaggaguucaaucaccuugagaaacggaucgaaaaccugaauaagaaaguggacgauggcuuccucgacauuuggacauacaacgcugagcugcugguccuccuggaaaaugagcgcacgcuugauuaucaugacucuaacgugaagaaucuguacgagaaagucagaaaccagcucaagaacaaugccaaggaaaucgggaacggauguuuugaguucuaucacaaaugcgauaauaccuguauggaaagcgugaagaacggcacauacgacuauccuaaauacuccgaggaagccaagcugaaucgggaggagauugaugggguuaaacuugaaagcacccgcaucuaucagauccuggcuauuuacucuacagccgcguccagccucgugcuggucgugucucugggcgcuaucuccuuuuggaugugcagcaacggaucccuccaaugcagaauuuguaucuga

SEQ ID NO: 193484 - RNA, 1701 nt, Artificial Sequence; identical to SEQ ID NO: 193474
  derived and/or modified sequence opt5 from hemagglutinin__InfluenzaA__AGU92986

SEQ ID NO: 193485 - RNA, 1701 nt, Artificial Sequence
  derived and/or modified sequence opt5 from hemagglutinin__InfluenzaA__AGU92997
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagauguuuaaaccugagauugcuauccggccgaagguccgcgauagagaggggcggaugaauuacuauuggacacugguugaacccggagacaaaauuaccuucgaggccacgggcaaccugguggugccucgcuacgcguuugccauggaaagaaacgcuggguccggaaucauuaucagcgauacacccguccaugacugcaauaccacaugucagaccccuaagggcgccaucaacaccucucuccccuuccaaaauauucacccgaucacaauuggcaaaugcccuaaguauguuaagagcacgaaacugcggcuugcuaccgggcugcgcaacgugcccuccauccagucuagaggacucuuuggcgccauugccggguucaucgagggaggcuggacagggaugguggacggaugguacggcuaucaucaccagaaugaacagggcagcggguacgcugcggaucugaaguccacccaaaacgccaucgacgagauuacaaauaaagucaacagcgugaucgagaagaugaauacccaguuuacggcuguuggaaaagaguucaaccaccuugagaagcggauugaaaaucugaacaagaaaguggaugacggcuuccucgauaucuggacauacaaugccgagcugcugguccuccuggaaaacgagcgcacccuugacuaucaugauucuaaugugaagaaccuguacgagaaagucagaucccagcucaagaacaaugccaaagaaauugggaacggauguuuugaguucuaucacaagugcgacaauaccuguauggaaagcgugaagaacggcacauacgauuauccuaaauacucugaggaagcuaagcugaaucgggaggagaucgacgggguuaaacuugaauccacccgcaucuaucagauucuggccaucuacagcacaguggcguccucucucguccuggugguuagccugggcgcuauuuccuuuuggaugugcucuaacggaagccuccaaugcagaaucuguauuuga

SEQ ID NO: 193486 - RNA, 1701 nt, Artificial Sequence; identical to SEQ ID NO: 193476
  derived and/or modified sequence opt5 from hemagglutinin__InfluenzaA__AGU93008

SEQ ID NO: 193487 - RNA, 1698 nt, Artificial Sequence; identical to SEQ ID NO: 189578
  derived and/or modified sequence opt5 from hemagglutinin__InfluenzaA__AGU93019

SEQ ID NO: 193488 - RNA, 1701 nt, Artificial Sequence; identical to SEQ ID NO: 190074
  derived and/or modified sequence opt5 from hemagglutinin__InfluenzaA__AGU93031

SEQ ID NO: 193489 - RNA, 1701 nt, Artificial Sequence
  derived and/or modified sequence opt5 from hemagglutinin__InfluenzaA__AGU93042
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaacacucucuaccgccaacagcugguccuacaucguggagacgucuagcuccgacaaugggaccugcuauccgggggauuuuauugacuacgaagaacugcgggagcagcuuucuagcgucuccagcuucgaacgcuuugagaucuuccccaagacaucuuccuggccuaaccacgauagcaauaagggagugaccgccgcuuguccccaugccggcgcgaaaggcuuuuauaagaaccugaucuggcucguuaaaaagggcaauucuuacccuaaacuguccaagagcuauauuaacgacaagggaaaagaagugcuuguccuguggggcauccaccaccccucuacaaccgccgaucaacagucccucuaccagaaugcugacacguacguguucguggggacaagcagauauuccaagaaauuuaagccugagauugccauccggccgaaaguccgcgaucaggagggaagaaugaacuacuauuggacccugguugaacccggcgacaagauuacauucgaggcuaccgggaaccugguggugccucgguacgccuuugcgauggaacgcgaugccggaucuggcaucauuaucagcgacacccccguccaugacugcaauacaacgugucaaaccccuaaaggcgcuaucaacacaucccuccccuuccagaauauucacccgaucaccauugggaagugcccuaaguaugugaaaagcacaaagcugagacuugccaccggacugcggaacguucccucuauccagucccgcggccucuuuggggcuauugccggauucaucgagggcggguggacgggaaugguggauggcugguacggcuaucaucaccagaaugaacaagggagcggauacgccgcugaccugaaaucuacacagaacgcgaucgauaagauuaccaauaaagucaacagcgugaucgagaagaugaauauucaguuuaccgccguuggcaaggaguucaaccaccuugagaaaagaaucgagaaucugaacaagaaaguggacgauggguuccucgacauuuggacauacaaugcugaacugcugguccuccuggagaacgaacggacccuugauuaucaugacuccaaugugaagaaccuguacgagaaaguccgcaaccagcucaagaauaacgccaaggagaucggaaauggcuguuuugaguucuaucacaaaugcgauaacacauguauggaaucugugaagaaugggacguacgacuauccuaaauacagcgaagaggccaagcugaacagagaagagaucgauggcguuaaacuugaguccacccggauuuaucaaauccuggcuauuuacagcacagccgcgucuucccucgugcuggucgugagccugggagcuaucucuuuuuggaugugcuccaauggcagccuccagugccgcauuuguaucuga

SEQ ID NO: 193490 - RNA, 1701 nt, Artificial Sequence
  derived and/or modified sequence opt5 from hemagglutinin__InfluenzaA__AGU93053
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaacacucucuaccgccagcuccuggucuuacaucguggagacgagcuccucugacaacgggaccugcuauccgggcgauuuuauugacuacgaagaacugcgggagcagcuuagcuccgucagcucuuucgaacgcuuugagaucuuccccaagacauccagcuggccuaaucacgauucuaacaagggagugaccgccgcuuguccccaugccggcgcgaaaggcuuuuauaagaaucugaucuggcucguuaaaaaggggaacuccuacccuaaacugagcaagucuuauauuaaugacaagggaaaagaagugcuuguccuguggggcauccaccaccccuccacaaccgccgaucaacagagccucuaccagaacgcugacacguacguguucguggggacauccagauauucuaagaaauuuaagccugagauugccacccggccgaaaguccgcgaucaggagggaagaaugaauuacuauuggacacugguugaacccggcgacaagaucaccuucgaggcuaccgggaaccugguggugccucgguacgccuuugcgauggaacgcgaugccggaagcggcauuaucauuuccgacacacccguccaugacugcaacacgaccugucaaacaccuaaaggcgcuaucaauaccagccuccccuuccagaacauccacccgauuacaaucgggaagugcccuaaguaugugaaaucuaccaagcugagacuugccacgggacugcggaauguucccuccauucagagccgcggccucuuuggggcuaucgccggauucauugagggcggguggacaggaaugguggauggcugguacggcuaucaucaccagaacgaacaagggucuggauacgccgcugaccugaaaagcacccagaaugcgaucgauaagaucaccaacaaagucaauuccgugauugagaagaugaacacacaguuuaccgccguuggcaaggaguucaaucaccuugagaaaagaaucgagaaccugaauaagaaaguggacgauggguuccucgacauuuggacauacaacgcugaacugcugguccuccuggagaaugaacggacgcuugauuaucaugacucuaacgugaagaaucuguacgagaaaguccgcaaccagcucaagaacaaugccaaggagaucggaaacggcuguuuugaguucuaucacaaaugcgauaauaccuguauggaaagcgugaagaacgggacauacgacuauccuaaauacuccgaagaggccaagcugaauagagaagagauugauggcguuaaacuugagagcacccggaucuaucaaauccuggcuauuuacucuacagccgcguccagccucgugcuggucgugucucugggagcuaucuccuuuuggaugugcagcaacggcucccuccagugccgcauuuguaucuga

SEQ ID NO: 193491 - RNA, 1701 nt, Artificial Sequence
  derived and/or modified sequence opt5 from hemagglutinin__InfluenzaA__AGV99014
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauaacuccuuuuucucucgccugaauuggcucacccauagcaacuuuaaguauccugcccugaacgucacaaugcccaauaacgagcaguucgacaaacuuuacaucuggggcgugcaccauccugggaccgauaaagaccagauuuuucuguaugcgcagucuuccggaagaaucacgguuagcacaaagcggucccaacaggccgugauuccgaauaucggcucucgccccagaauccggaacauuccuagccgcaucuccauuuacuggaccaucgucaaacccggggauauucuccugaucaauagcacaggaaaccugaucgcuccuagaggcuacuucaagauucggucugggaaauccagcaucaugcgcucugacgcccccauuggaaaguguaagagcgaaugcaucaccccgaauggcuccauuccuaacgacaaacccuuucagaaugugaacagaaucaccuauggcgcuuguccucgguacgugaagcagucuacacucaaacuggccacggggaugcgcaauguccccgagaagcaaaccagaggaaucuucggcgcgauugccggguuuaucgaaaacggaugggagggcaugauggaugggugguauggauuccggcaccagaauagcgagggcagaggccaggcugccgaccuuaaauccacacaagcugccauugaucagaucaacgggaagcugaaucgccucauuggaaaaaccaacgaaaaguuccaccagaucgagaaggaauuuagcgagguugaaggccggauucaggaccuggagaaauacguggaggauacaaagaucgaccuuuggucuuauaacgccgaacugcucguggcucuggagaaucaacauaccaucgaucugacggacuccgaaaugaacaaacucuucgagaagacaaagaagcagcugagagaaaaugcggaggauauggggaacggaugcuuuaagauuuaccacaaaugugacaaugccugcaucggcagcauucgcaacgggaccuaugaucaugacgucuaccgggacgaggcucuuaauaacagauuccagaucaagggcguggaacugaaaucuggauacaaggauuggauucucuggaucuccuuugccaucagcugcuuccugcuuuguguugcccugcucggcuuuauuaugugggcuugccagaaagggaauauccgcuguaacauuugcaucuga

SEQ ID NO: 193492 - RNA, 1701 nt, Artificial Sequence; identical to SEQ ID NO: 193018
  derived and/or modified sequence opt5 from hemagglutinin__InfluenzaA__AGV99037

SEQ ID NO: 193493 - RNA, 1701 nt, Artificial Sequence
  derived and/or modified sequence opt5 from hemagglutinin__InfluenzaA__AGV99049
augaagaccaucauugcccugagcuacauccucugccugguguucgcucagaaacuucccggcaacgacaauuccacagccacgcugugucucgggcaccaugcggucccuaacggaaccguugugaagacaauuaccaaugauagaaucgaggugacaaacgcuaccgaacugguccaaaauucuagcauuggcgagaucugcgacuccccgcaccagauccuugauggggaaaacuguacacugauugacgcccuccugggagauccccagugcgacggcuuucagaauaaaaagugggaucuguucguggagcggucuaaagccuauagcaacuguuacccuuaugacguucccgauuacgcuucccuccgcucucugguggccagcuccgggacccuugaauuuaauaacgagagcuucaauuggacgggagucacccaaaacggcacaucuuccgcuugcaucagacggagcaauaacuccuuuuucucucgccugaauuggcucacccaucugaacuuuaaguauccugcccuuaacgugacaaugcccaauaacgagcaguucgacaagcuguacauuuggggcguucaccauccugggaccgauaaagaccagaucuuucucuaugcgcagagcucuggaagaauuacgguguccacaaagcggagccaacaggccgucaucccgaauauuggcucccgccccagaauccggaacaucccuucucgcauuagcaucuacuggaccauugugaaacccggggauauccugcugauuaauuccacaggaaaccucaucgcuccuagaggcuacuucaagauccggagcgggaaaucuuccauuaugcgcagcgacgcccccaucggaaaguguaagucugaaugcauuaccccgaauggcagcaucccuaacgacaaacccuuucagaaugugaacagaauuaccuauggcgcuuguccucgguacgucaagcaguccacacugaaacuugccacggggaugcgcaauguucccgagaagcaaaccagaggaaucuucggcgcgaucgccggguuuauugaaaacggaugggagggcaugguggaugggugguauggauuccggcaccaaaauucugagggcagaggccaggcugccgaccugaaaagcacacaggcugccaucgaucagauuaacgggaagcucaaucgccugaucggaaaaaccaacggcaaguuccaccagauugaaaaggaguuuuccgaaguggaggggcggauccaggaccuugaaaaauacgucgaggauacaaagauugaccuguggagcuauaacgccgagcuccugguggcucuggaaaaucaacauaccaucgaucucacggacucugagaugaacaaacuguucgaaaagaccaaaaagcagcuuagagagaaugcggaagauaugggaaacggcugcuuuaagaucuaccacaaaugugacaaugccugcauuggguccauccgcaacggcacauaugaucaugacguuuaccgggacgaggcucugaauaacagauuccagauuaagggaguggagcucaaaagcggcuacaaggauuggauccuguggauuucuuuugccaucuccugcuuccuucugugugucgugcuccugggguuuaucaugugggccugccagaaaggaaauauucgcuguaacaucugcauuuga

SEQ ID NO: 193494 - RNA, 1701 nt, Artificial Sequence
  derived and/or modified sequence opt5 from hemagglutinin__InfluenzaA__AGV99073
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaggcagcaauucuuccuuuuucagccggcuuaacuggcugacccaucucaauuuuaaguauccugcccugaacgucacaaugcccaacaaugagcaguucgacaaacuuuacauuuggggagugcaccauccugggaccgauaaagaccagaucuuucuguaugcgcagucuuccggccgcauuacgguuagcacaaagagaucccaacaggccgugaucccgaacaucgggucucggccccgcauuagaaauaucccuagccggauuuccaucuacuggaccauugucaaacccggagauauccuccugaucaacagcacaggcaaucugauugcuccucgcggguacuucaagaucagaucuggaaaauccagcauuaugcggucugacgcccccaucggcaaguguaagagcgaaugcauuaccccgaacggcuccaucccuaaugacaaacccuuucagaacgugaaucgcaucaccuauggggcuuguccuagauacgugaagcagucuacacucaaacuggccacgggaaugcggaacguccccgagaagcaaacccgcggcauuuucggggcgaucgccggauuuauugaaaauggcugggaggggaugguugauggaugguauggcuucagacaccagaacagcgagggccgggggcaggcugccgaccuuaaauccacacaagcugccaucgaucagauuaauggaaagcugaacagacucaucggcaaaaccaaugaaaaguuccaccagauugagaaggaauuuagcgagguggaagggcgcauccaggaccuggagaaauacguggaggauacaaagaucgaccuuuggucuuauaacgccgaacugcucgucgcucuggagaaccaacauaccauugaucugacggacuccgaaaugaauaaacucuucgagaagacaaagaagcagcugcgggaaaacgcggaggauaugggaaauggcugcuuuaagaucuaccacaaaugugacaacgccugcauugggagcaucagaaauggcaccuaugaucaugacguguaccgcgacgaggcucuuaacaaucgguuccagauuaagggaguugaacugaaacccggcuacaaggauuggauccucuggaucucuuuugccauuuccugcuuccugcuuuguguggcccugcucggguuuaucaugugggcuugccagaaaggaaacauuagauguaauaucugcauuuga

SEQ ID NO: 193495 - RNA, 1701 nt, Artificial Sequence; identical to SEQ ID NO: 192882
  derived and/or modified sequence opt5 from hemagglutinin__InfluenzaA__AGV99085

SEQ ID NO: 193496 - RNA, 1701 nt, Artificial Sequence
  derived and/or modified sequence opt5 from hemagglutinin__InfluenzaA__AGV99097
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagucuacacugaaacuugccacggggaugcgcaacguccccgagaagcaaaccagaggaaucuucggcgcgauugccggguuuaucgaaaauggaugggagggcaugguugaugggugguauggauuccggcaccagaacagcgagggcagaggccaggcugccgaccugaaauccacacaagcugccauugaucagaucaaugggaagcucaaccgccugauuggaaaaaccaaugaaaaguuccaccagaucgagaaggaauuuagcgagguggaaggccggauucaggaccuugagaaauacguggaggauacaaagaucgaccuguggucuuauaacgccgaaauccucgucgcucuggagaaccaacauaccauugaucugacggacuccgaaaugaauaaacucuucgagaagaccaaaaagcagcugagagaaaacgcggaggauauggggaauggaugcuuuaagaucuaccacaaaugugacaacgccugcauuggcagcauccgcaaugggacauaugaucaugacguguaccgggacgaggcucuuaacaauagauuccagauuaagggcguugaacugaaaucuggauacaaggauuggauccucuggaucuccuuugccauuagcugcuuccugcuuuguguggcccugcucggcuuuaucaugugggcuugccagaaagggaacauucgcuguaauaucugcauuuga

SEQ ID NO: 193497 - RNA, 1701 nt, Artificial Sequence
  derived and/or modified sequence opt5 from hemagglutinin__InfluenzaA__AGV99121
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacgauuuucagaauaaaaagugggaccuguucgucgagcggucuaaagccuauagcaacuguuacccuuaugaugugcccgacuacgcuucccuccgcucucugguugccagcuccggcacccuugaauuuaauaacgagagcuucaauugggcuggggugacgcaaaacggaaccucuuccgccugcauuagaggcagcaauucuuccuuuuucagccggcugaacuggcucacacaucugaauuuuaaguauccugcgcuuaacgucaccaugcccaacaaugagcaguucgauaagcuguacaucuggggcgugcaccauccugggacagacaaagaucagauuuuucucuaugcccagucuuccggacgcaucaccguuagcacgaagagaucccaacaggcugugauuccgaacaucggcucucggccccgcaucagaaauauuccuagccggaucuccauuuacuggacaaucgucaaacccggggacauucugcugaucaacagcaccggaaaucucaucgccccucgcggcuacuucaagauuagaucugggaaauccagcaucaugcggucugacgcucccauuggaaaguguaagagcgaaugcaucacaccgaacggcuccauuccuaaugauaaacccuuucagaacgugaaucgcaucaccuauggcgccuguccuagauacgugaagcagucuacccugaaacuugcgacagggaugcggaacguccccgagaagcaaacgcgcggaaucuucggcgccauugcuggguuuaucgaaaauggaugggagggcaugguugacgggugguauggauucagacaccagaacagcgagggccggggccaggccgcugaucugaaauccacccaagccgccauugaccagaucaaugggaagcucaacagacugauuggaaaaacaaaugaaaaguuccaccagaucgagaaggaauuuagcgagguggaaggccgcauucaggaucuugagaaauacguggaggacaccaagaucgaucuguggucuuauaacgcugaacuccuggucgcgcuggagaaccaacauacaaucgaccucaccgauuccgaaaugaauaaacuguucgagaagacgaaaaagcagcuucgggaaaacgccgaggacauggggaauggaugcuuuaagauuuaccacaaaugugauaacgcuugcaucggcagcauuagaaaugggacauaugaccaugacguguaccgcgaugaggcccugaacaaucgguuccagaucaagggcguugaacucaaaucuggauacaaggacuggauucuguggaucuccuuugccaucagcugcuuccuucuguguguggcucuccugggcuuuauuaugugggccugccagaaagggaacaucagauguaauauuugcaucuga

SEQ ID NO: 193498 - RNA, 1701 nt, Artificial Sequence; identical to SEQ ID NO: 193497
  derived and/or modified sequence opt5 from hemagglutinin__InfluenzaA__AGV99133

SEQ ID NO: 193499 - RNA, 1701 nt, Artificial Sequence; identical to SEQ ID NO: 193491
  derived and/or modified sequence opt5 from hemagglutinin__InfluenzaA__AGV99145

SEQ ID NO: 193500 - RNA, 1701 nt, Artificial Sequence
  derived and/or modified sequence opt5 from hemagglutinin__InfluenzaA__AGV99157
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucauugagcggucuaaagccuauagcaacuguuacccuuaugacguccccgauuacgcuucccuccgcucucugguggccagcuccgggacccuugaauuuaauaacgagagcuucaauuggacgggaguuacccaaaacggcacaucuuccgcuugcaucagacggagcaauaacuccuuuuucucucgccugaauuggcucacccauagcaacuuuaaguauccugcccugaacgugacaaugcccaauaacgagcaguucgacaaacuuuacauuuggggcguccaccauccugggaccgauaaggaccagaucuuucuguaugcgcagucuuccggaagaauuacggugagcacaaagcggucccaacaggccguuaucccgaauaucggcucucgcccccggauuagaaacaucccuagccgcauuuccaucuacuggaccauugugaaacccggggauauccuccugaucaauagcacaggaaaccugauugcuccuagaggcuacuucaagauccggucugggaaauccagcauuaugcgcucugacacccccaucggaaaguguaagagcgaaugcauuaccccgaauggcuccaucccuaacgacaaacccuuucagaaugucaacagaaucacauauggcgccuguccucgguacgugaagcagucuacgcucaaacuggcuaccgggaugcgcaaugugcccgagaagcaaacaagaggaauuuucggcgccaucgcgggguuuauugaaaacggaugggagggcaugauggaugggugguauggauuccggcaccagaauagcgagggcagaggccaggccgcugaccuuaaauccacccaagccgcuaucgaucagauuaacgggaagcugaaucgccucaucggaaaaacaaacgaaaaguuccaccagauugagaaggaauuuagcgaggucgaaggccggauccaggaccuggagaaauacguugaggauaccaagaucgaccuuuggucuuauaacgccgaacugcucguggcccuggagaaucaacauacgauugaucugacagacuccgaaaugaacaaacucuucgagaagaccaaaaagcagcugagagaaaaugcugaggauauggggaacggaugcuuuaagaucuaccacaaaugugacaaugcgugcauuggcagcauccgcaacgggaccuaugaucaugacguguaccgggacgaggcccuuaauaacagauuccagauuaagggcgucgaacugaaaucuggauacaaggauuggauccucuggaucuccuuugcuauuagcugcuuccugcuuuguguggcccugcucggcuuuaucaugugggccugccagaaagggaauauucgcuguaacaucugcauuuga

SEQ ID NO: 193501 - RNA, 1701 nt, Artificial Sequence; identical to SEQ ID NO: 193018
  derived and/or modified sequence opt5 from hemagglutinin__InfluenzaA__AGV99169

SEQ ID NO: 193502 - RNA, 1701 nt, Artificial Sequence; identical to SEQ ID NO: 193491
  derived and/or modified sequence opt5 from hemagglutinin__InfluenzaA__AGV99181

SEQ ID NO: 193503 - RNA, 1701 nt, Artificial Sequence
  derived and/or modified sequence opt5 from hemagglutinin__InfluenzaA__AGV99193
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauaacuccuuuuucucucgccugaauuggcucacccauagcaacuuuaaguauccugcccugaacgucacaaugcccaauaacgagcaguucgacaaacuuuacaucuggggcgugcaccauccugggaccgauaaggaccagauuuuucuguaugcgcagucuuccggaagaaucacgguuagcacaaagcggucccaacaggccgugauuccgaauaucggcucucgccccagaauccggaacauuccuagccgcaucuccauuuacuggaccaucgucaaacccggggauauucuccugaucaauagcacaggaaaccugaucgcuccuagaggcuacuucaagauucggucugggaaauccagcaucaugcgcucugacacccccauuggaaaguguaagagcgaaugcaucaccccgaauggcuccauuccuaacgacaaacccuuucagaaugugaacagaaucacauauggcgccuguccucgguacgugaagcagucuacgcucaaacuggcuaccgggaugcgcaauguccccgagaagcaaacaagaggaaucuucggcgccauugcgggguuuaucgaaaacggaugggagggcaugauggaugggugguauggauuccggcaccagaauagcgagggcagaggccaggccgcugaccuuaaauccacccaagccgcuauugaucagaucaacgggaagcugaaucgccucauuggaaaaacaaacgaaaaguuccaccagaucgagaaggaauuuagcgagguugaaggccggauucaggaccuggagaaauacguggaggauaccaagaucgaccuuuggucuuauaacgccgaacugcucguggcccuggagaaucaacauacgaucgaucugacagacuccgaaaugaacaaacucuucgagaagaccaaaaagcagcugagagaaaaugcugaggauauggggaacggaugcuuuaagauuuaccacaaaugugacaaugcgugcaucggcagcauucgcaacgggaccuaugaucaugacgucuaccgggacgaggcccuuaauaacagauuccagaucaagggcguggaacugaaaucuggauacaaggauuggauucucuggaucuccuuugcuaucagcugcuuccugcuuuguguugcccugcucggcuuuauuaugugggccugccagaaagggaauauccgcuguaacauuugcaucuga

SEQ ID NO: 193504 - RNA, 1701 nt, Artificial Sequence; identical to SEQ ID NO: 192892
  derived and/or modified sequence opt5 from hemagglutinin__InfluenzaA__AGV99956

SEQ ID NO: 193505 - RNA, 1701 nt, Artificial Sequence
  derived and/or modified sequence opt5 from hemagglutinin__InfluenzaA__AGV99986
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugauugccagcuccgggacccuugaauuuaauaacgagagcuucaauuggacgggaguuacccaaaacggcacaucuuccgcuugcaucagacggagcaauaacuccuuuuucucucgccugaauuggcucacccauagcaacuuuaaguauccugcccugaacgugacaaugcccaauaacgagcaguucgacaaacuuuacauuuggggcguccaccauccugggaccgauaaagaccagaucuuucuguaugcgcagucuuccggaagaauuacggugagcacaaagcggucccaacaggccguuaucccgaauaucggcucucgcccccggauuagaaacaucccuagccgcauuuccaucuacuggaccauugugaaacccggggauauccuccugaucaauagcacaggaaaccugauugcuccuagaggcuacuucaagauccggucugggaaauccagcauuaugcgcucugacgcccccaucggaaaguguaagagcgaaugcauuaccccgaauggcuccaucccuaacgacaaacccuuucagaaugucaacagaaucaccuauggcgcuuguccucgguacgugaagcagucuacacucaaacuggccacggggaugcgcaaugugcccgagaagcaaaccagaggaauuuucggcgcgaucgccggguuuauugaaaacggaugggagggcaugauggaugggugguauggauuccggcaccagaauagcgagggcagaggccaggcugccgaccuuaaauccacacaagcugccaucgaucagauuaacgggaagcugaaucgccucaucggaaaaaccaacgaaaaguuccaccagauugagaaggaauuuagcgaggucgaaggccggauccaggaccuggagaaauacguugaggauacaaagaucgaccuuuggucuuauaacgccgaacugcucguggcucuggagaaucaacauaccauugaucugacggacuccgaaaugaacaaacucuucgagaagacaaagaagcagcugagagaaaaugcggaggauauggggaacggaugcuuuaagaucuaccacaaaugugacaaugccugcauuggcagcauccgcaacgggaccuaugaucaugacguguaccgggacgaggcucuuaauaacagauuccagauuaagggcgucgaacugaaaucuggauacaaggauuggauccucuggaucuccuuugccauuagcugcuuccugcuuuguguggcccugcucggcuuuaucaugugggcuugccagaaagggaauauucgcuguaacaucugcauuuga

SEQ ID NO: 193506 - RNA, 1701 nt, Artificial Sequence
  derived and/or modified sequence opt5 from hemagglutinin__InfluenzaA__AGW00065
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacaccucccuccgcucucugguugcuagcuccgggacgcuugaauuuaauaacgagagcuucaauuggaccggagugacacaaaacggcaccucuuccgccugcauuagacggagcaauucuuccuuuuucagccgccugaacuggcucacacaucugaauuuuaaguauccugcucuuaacgucaccaugcccaacaaugagcaguucgacaagcuguacaucuggggcgugcaccauccugggacggauaaagaccagauuuuucucuaugcccagucuuccggaagaaucacaguuagcaccaagcggucccaacaggcggugauuccgaacaucggcucucgccccagaauccggaauauuccuagccgcaucuccauuuacuggacaaucgucaaacccggggauauucugcugaucaacagcaccggaaaucucaucgccccuagaggcuacuucaagauucggucugggaaauccagcaucaugcgcucugacgcucccauuggaaaguguaagagcgaaugcaucaccccgaacggcuccauuccuaaugacaaacccuuucagaacgugaauagaaucacauauggcgccuguccucgguacgugaagcagucuacgcugaaacuugcuaccgggaugcgcaacguccccgagaagcaaacaagaggaaucuucggcgccauugcgggguuuaucgaaaauggaugggagggcaugguugaugggugguauggauuccggcaccagaacagcgagggcagaggccaggccgcugaccugaaauccacccaagccgcuauugaucagaucaaugggaagcucaaccgccugauuggaaaaacaaaugaaaaguuccaccagaucgagaaggaauuuagcgagguggaaggccggauucaggaccuugagaaauacguggaggauaccaagaucgaccuguggucuuauaacgccgaacuccuggucgcccuggagaaccaacauacgaucgaucucacagacuccgaaaugaauaaacuguucgagaagaccaaaaagcagcuuagagaaaacgcugaggauauggggaauggaugcuuuaagauuuaccacaaaugugacaacgcgugcaucggcagcauucgcaaugggaccuaugaucaugacguguaccgggacgaggcccugaacaauagauuccagaucaagggcguugaacucaaaucuggauacaaggauuggauucuguggaucuccuuugcuaucagcugcuuccuucuguguguggcccuccugggcuuuauuaugugggccugccagaaagggaacauccgcuguaauauuugcaucuga

SEQ ID NO: 193507 - RNA, 1701 nt, Artificial Sequence; identical to SEQ ID NO: 193018
  derived and/or modified sequence opt5 from hemagglutinin__InfluenzaA__AGW00077

SEQ ID NO: 193508 - RNA, 1701 nt, Artificial Sequence; identical to SEQ ID NO: 192882
  derived and/or modified sequence opt5 from hemagglutinin__InfluenzaA__AGW00089

SEQ ID NO: 193509 - RNA, 1701 nt, Artificial Sequence; identical to SEQ ID NO: 193018
  derived and/or modified sequence opt5 from hemagglutinin__InfluenzaA__AGW00101

SEQ ID NO: 193510 - RNA, 1701 nt, Artificial Sequence
  derived and/or modified sequence opt5 from hemagglutinin__InfluenzaA__AGW00113
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagaccuuucucuaugcccagucuuccggccgcauuacgguuagcacaaagagaucccaacaggcugugaucccgaacauugggucucggccccgcaucagaaauaucccuagccggauuuccaucuacuggaccauugucaaacccggagauauccugcugauuaacagcacaggcaaucucaucgccccucgcggguacuucaagaucagaucuggaaaauccagcauuaugcggucugacgcucccaucggcaaguguaagagcgaaugcauuaccccgaacggcuccaucccuaaugacaaacccuuucagaacgugaaucgcauuaccuauggggccuguccuagauacgugaagcagucuacacugaaacuugcgacgggaaugcggaacguccccgagaagcaaacccgcggcaucuucggggccaucgcuggauuuauugaaaauggcugggaggggaugguugauggaugguauggcuucagacaccagaacagcgagggccgggggcaggccgcugaccugaaauccacacaagccgccaucgaucagauuaauggaaagcucaacagacugaucggcaaaaccaaugaaaaguuccaccagauugagaaggaauuuagcgagguggaagggcgcauccaggaccuugagaaauacguggaggauacaaagauugaccuguggucuuauaacgcugaacuccuggucgcgcuggagaaccaacauaccaucgaucucacggacuccgaaaugaauaaacuguucgagaagaccaaaaagcagcuucgggaaaacgccgaggauaugggaaauggcugcuuuaagaucuaccacaaaugugacaacgcuugcauugggagcaucagaaauggcacauaugaucaugacguguaccgcgacgaggcccugaacaaucgguuccagauuaagggaguugaacucaaaucuggcuacaaggauuggauccuguggauuuccuuugccaucagcugcuuccuucuguguguggcucuccugggguuuaucaugugggccugccagaaaggaaacauuagauguaauaucugcauuuga

SEQ ID NO: 193511 - RNA, 1701 nt, Artificial Sequence; identical to SEQ ID NO: 193018
  derived and/or modified sequence opt5 from hemagglutinin__InfluenzaA__AGW00125

SEQ ID NO: 193512 - RNA, 1701 nt, Artificial Sequence; identical to SEQ ID NO: 193018
  derived and/or modified sequence opt5 from hemagglutinin__InfluenzaA__AGW00137

SEQ ID NO: 193513 - RNA, 1701 nt, Artificial Sequence; identical to SEQ ID NO: 193018
  derived and/or modified sequence opt5 from hemagglutinin__InfluenzaA__AGW00149

SEQ ID NO: 193514 - RNA, 1701 nt, Artificial Sequence; identical to SEQ ID NO: 193018
  derived and/or modified sequence opt5 from hemagglutinin__InfluenzaA__AGW00161

SEQ ID NO: 193515 - RNA, 1701 nt, Artificial Sequence; identical to SEQ ID NO: 193018
  derived and/or modified sequence opt5 from hemagglutinin__InfluenzaA__AGW00173

SEQ ID NO: 193516 - RNA, 1701 nt, Artificial Sequence
  derived and/or modified sequence opt5 from hemagglutinin__InfluenzaA__AGW00185
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucauugagcggucuaaagccuauagcaacuguuacccuuaugacguccccgauuacgcuucccuccgcucucugguggccagcuccgggacccuugaauuuaauaacgagagcuucaauuggacgggaguuacccaaaacggcacaucuuccgcuugcaucagacggagcaauaacuccuuuuucucucgccugaauuggcucacccauagcaacuuuaaguauccugcccugaacgugacaaugcccaauaacgagcaguucgacaaacuuuacauuuggggcguccaccauccugggaccgauaaagaccagaucuuucuguaugcgcagucuuccggaagaauuacggugagcacaaagcggucccaacaggccguuaucccgaauaucggcucucgcccccggauuagaaacaucccuagccgcauuuccaucuacuggaccauugugaaacccggggauauccuccugaucaauagcacaggaaaccugauugcuccuagaggcuacuucaagauccggucugggaaauccagcauuaugcgcucugacgcccccaucggaaaguguaagagcgaaugcauuaccccgaauggcuccaucccuaacgacaaacccuuucagaaugucaacagaaucaccuauggcgcuuguccucgguacgugaagcagucuacacucaaacuggccacggggaugcgcaaugugcccgagaagcaaaccagaggaauuuucggcgcgaucgccggguuuauugaaaacggaugggagggcaugauggaugggugguauggauuccggcaccagaauagcgagggcagaggccaggcugccgaccuuaaauccacacaagcugccaucgaucagauuaacgggaagcugaaucgccucaucggaaaaaccaacgaaaaguuccaccagauugagaaggaauuuagcgaggucgaaggccggauccaggaccuggagaaauacguugaggauacaaagaucgaccuuuggucuuauaacgccgaacugcucguggcucuggagaaucaacauaccauugaucugacggacuccgaaaugaacaaacucuucgagaagacaaagaagcagcugagagaaaaugcggaggauauggggaacggaugcuuuaagaucuaccacaaaugugacaaugccugcauuggcagcauccgcaacgggaccuaugaucaugacguguaccgggacgaggcucuuaauaacagauuccagauuaagggcgucgaacugaaaucuggauacaaggauuggauccucuggaucuccuuugccauuagcugcuuccugcuuuguguggcccugcucggcuuuaucaugugggcuugccagaaagggaauauucgcuguaacaucugcauuuga

SEQ ID NO: 193517 - RNA, 1701 nt, Artificial Sequence; identical to SEQ ID NO: 193018
  derived and/or modified sequence opt5 from hemagglutinin__InfluenzaA__AGW00709

SEQ ID NO: 193518 - RNA, 1701 nt, Artificial Sequence; identical to SEQ ID NO: 193018
  derived and/or modified sequence opt5 from hemagglutinin__InfluenzaA__AGW00721

SEQ ID NO: 193519 - RNA, 1701 nt, Artificial Sequence; identical to SEQ ID NO: 193018
  derived and/or modified sequence opt5 from hemagglutinin__InfluenzaA__AGW00733

SEQ ID NO: 193520 - RNA, 1701 nt, Artificial Sequence; identical to SEQ ID NO: 193018
  derived and/or modified sequence opt5 from hemagglutinin__InfluenzaA__AGW00745

SEQ ID NO: 193521 - RNA, 1701 nt, Artificial Sequence
  derived and/or modified sequence opt5 from hemagglutinin__InfluenzaA__AGW00757
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaaccugaaucgcaucaccuauggggccuguccuagauacgugaagcagucuacccuuaaacuggcgacaggaaugcggaacgugcccgagaagcaaacgcgcggcaucuucggggccauugcuggauuuaucgaaaauggcugggaggggauggucgauggaugguauggcuucagacaccagaacagcgagggccgggggcaggccgcugaccucaaauccacccaagccgccauugaucagaucaauggaaagcugaacagacuuauuggcaaaacaaaugaaaaguuccaccagaucgagaaggaauuuagcgagguugaagggcgcauucaggaccuggagaaauacguggaggauaccaagaucgaccucuggucuuauaacgcugaacugcugguggcgcucgagaaccaacauacaaucgaucugaccgacuccgaaaugaauaaacuuuucgagaagacgaaaaagcagcugcgggaaaacgccgaggauaugggaaauggcugcuuuaagauuuaccacaaaugugacaacgcuugcaucgggagcauuagaaauggcacauaugaucaugacgucuaccgcgacgaggcccucaacaaucgguuccagaucaagggaguggaacugaaaucuggcuacaaggauuggauucuuuggaucuccuuugccaucagcugcuuccugcucuguguugcucugcugggguuuauuaugugggccugccagaaaggaaacaucagauguaauauuugcaucuga

SEQ ID NO: 193522 - RNA, 1701 nt, Artificial Sequence; identical to SEQ ID NO: 193021
  derived and/or modified sequence opt5 from hemagglutinin__InfluenzaA__AGW00769

SEQ ID NO: 193523 - RNA, 1701 nt, Artificial Sequence; identical to SEQ ID NO: 192907
  derived and/or modified sequence opt5 from hemagglutinin__InfluenzaA__AGW00781

SEQ ID NO: 193524 - RNA, 1701 nt, Artificial Sequence; identical to SEQ ID NO: 193506
  derived and/or modified sequence opt5 from hemagglutinin__InfluenzaA__AGW00793

SEQ ID NO: 193525 - RNA, 1701 nt, Artificial Sequence; identical to SEQ ID NO: 193018
  derived and/or modified sequence opt5 from hemagglutinin__InfluenzaA__AGW00805

SEQ ID NO: 193526 - RNA, 1701 nt, Artificial Sequence; identical to SEQ ID NO: 192859
  derived and/or modified sequence opt5 from hemagglutinin__InfluenzaA__AGW00817

SEQ ID NO: 193527 - RNA, 1701 nt, Artificial Sequence; identical to SEQ ID NO: 193505
  derived and/or modified sequence opt5 from hemagglutinin__InfluenzaA__AGW00829

SEQ ID NO: 193528 - RNA, 1701 nt, Artificial Sequence
  derived and/or modified sequence opt5 from hemagglutinin__InfluenzaA__AGW00841
augaagaccaucauugcccugagcuacauccucugccugguguucgcucagaaacuucccggcaacgacaauuccacagccacgcugugucucgggcaccaugcggucccuaacggaaccauuguuaagacaaucaccaauggcagaauugaggugacaaacgcuaccgaacuggugcaaaauucuagcaucggggagaucugcgauuccccgcaccagauucuugacggagaaaacuguacacugaucgaugcccuccugggcgacccccagugcgauggguuucagaauaaaaagugggaccuguucgucgagcggucuaaagccuauagcaacuguuacccuuaugaugugcccgacuacgcuucccuccgcucucugguugccagcuccggaacccuugaauuuaauaacgagagcuucaauugggcuggcgugacgcaaaacggcaccucuuccgccugcauuagagggagcaauucuuccuuuuucagccggcugaacuggcucacacaucugaauuuuaaguauccugcgcuuaacgucaccaugcccaacaaugagcaguucgauaagcuguacaucuggggagugcaccauccuggcacagacaaagaucagauuuuucucuaugcccagucuuccgggcgcaucaccguuagcacgaagagaucccaacaggcugugauuccgaacaucggaucucggccccgcaucagaaauauuccuagccggaucuccauuuacuggacaaucgucaaacccggcgacauucugcugaucaacagcaccgggaaucucaucgccccucgcggauacuucaagauuagaucuggcaaauccagcaucaugcggucugaugcucccauuggcaaguguaagagcgaaugcaucacaccgaacggguccauuccuaaugacaaacccuuucagaacgugaaucgcaucaccuauggagccuguccuagauacgugaagcagucuacccugaaacuugcgacaggcaugcggaacguccccgagaagcaaacgcgcgggaucuucggagccauugcuggcuuuaucgaaaaugggugggagggaaugguugacggcugguauggcuucagacaccagaacagcgaggggcggggacaggccgcugaucugaaauccacccaagccgccauugaccagaucaauggcaagcucaacagacugauugggaaaacaaaugaaaaguuccaccagaucgagaaggaauuuagcgagguggaaggacgcauucaggaucuugagaaauacguggaggacaccaagaucgaucuguggucuuauaacgcugaacuccuggucgcgcuggagaaccaacauacaaucgaccucaccgauuccgaaaugaauaaacuguucgagaagacgaaaaagcagcuucgggaaaacgccgaggacaugggcaaugggugcuuuaagauuuaccacaaaugugauaacgcuugcaucggcagcauuagaaauggaacauaugaccaugauguguaccgcgacgaggcccugaacaaucgguuccagaucaagggcguugaacucaaaucuggguacaaggacuggauucuguggaucuccuuugccaucagcugcuuccuucuguguguggcucuccugggauuuauuaugugggccugccagaaaggcaacaucagauguaauauuugcaucuga

SEQ ID NO: 193529 - RNA, 1701 nt, Artificial Sequence
  derived and/or modified sequence opt5 from hemagglutinin__InfluenzaA__AGW00853
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagccgucuggaagaaucacgguuuccacaaagcggagccaacaggccgugauucccaacaucggcucccgcccuagaauccggaauauucccucucgcaucagcauuuacuggaccaucgucaaaccuggggauauucugcugaucaacuccacaggaaaucucaucgcucccagaggcuacuucaagauucggagcgggaaaucuuccaucaugcgcagcgacgccccgauuggaaaguguaagucugaaugcaucaccccuaacggcagcauucccaaugacaaaccuuuucagaacgugaauagaaucaccuauggcgcuuguccccgguacgugaagcaguccacacugaaacuugccacggggaugcgcaacguccccgagaagcaaaccagaggaaucuucggcgcgauugccggguuuaucgaaaauggaugggagggcaugguugaugggugguauggauuccggcaccagaacucugagggcagaggccaggcugccgaccugaaaagcacacaagcugccauugaucagaucaaugggaagcucaaccgccugauuggaaaaaccaaugaaaaguuccaccagaucgagaaggaauuuuccgagguggaaggccggauucaggaccuugagaaauacguggaggauacaaagaucgaccuguggagcuauaacgccgaacuccuggucgcucuggagaaccaacauaccaucgaucucacggacucugaaaugaauaaacuguucgagaagaccaaaaagcagcuuagagaaaacgcggaggauauggggaauggaugcuuuaagauuuaccacaaaugugacaacgccugcaucggcuccauucgcaaugggacauaugaucauaacguguaccgggacgaggcucugaauaacagauuccagaucaagggcguugaacucaaaagcggauacaaggacuggauucuguggaucucuuuugccaucuccugcuuccuucuguguguggcccuccugggcuuuauuaugugggcuugccagaaagggaauauccgcuguaacauuugcaucuga

SEQ ID NO: 193530 - RNA, 1701 nt, Artificial Sequence; identical to SEQ ID NO: 192882
  derived and/or modified sequence opt5 from hemagglutinin__InfluenzaA__AGW00865

SEQ ID NO: 193531 - RNA, 1701 nt, Artificial Sequence
  derived and/or modified sequence opt5 from hemagglutinin__InfluenzaA__AGW00877
augaagaccaucauugcccugagcuacauccucugccugguguucgcucaggagcuucccggcaacgacgauuccacagccacgcugugucucgggcaccaugcggucccuaauggaaccauuguuaaaacaaucaccaacgaccaaauugaagugacaaaugcuaccgagcuggugcagucuagcuccacaggcgaaaucugcaacucuccgcaccagauccuugauggggagaauuguacccugauugacgcccuccugggagauccccagugcgacggcuuucaaaacaagaaaugggaucuguucgucgaaagaagcaaggcccauuccaauuguuauccuuacgacgugcccgauuaugcuucucuccggagccugguugccuccagcgggacgcuugaguuuaacaaugagucuuucaacuggaccggagugacacagaauggcaccuccagcgcuugcauccgcagaucuaacaauuccuuuuucagccggcugaacuggcucacacaccugaauuuuaaauacccugcccuuaacgucaccaugcccaacaaugaacaguucgacaagcuguauauuuggggcgugcaucacccugggacggauaaggaccagaucuuucucuacgcgcaagccucuggacgcauuacaguuuccaccaaaagaagccagcaggcugugaucccgaacauuggcuuccggccccgcgucagaaauaucccuucccgggugucuaucuauuggacaauugugaagcccggggauauccugcugauuaacagcaccggaaaucucaucgccccucgcggcuacuuuaaaauuagauccggaaagagcucuaucaugcgguccgacgcucccaucgggaaauguaacagcgccugcauuaccccgaauggcucuaucccuaacgacaagcccuuccagaaugucaaccgcauuacauacggcgcguguccuagauauguuaagcaaaauacgcugaaacuugccaccgggaugcggaacgugcccgagaagcagacacgcggaaucuuuggcgcuauugccggguucaucgaaaauggaugggagggcaugguggaugggugguacggauucagacaccagaacagcgagggccggggccaagcugccgaccugaaauccacccaggccgcuaucgaucagauuaaugggaagcucaacagacugaucggaaaaacaaacgaaaaguuucaucagauugagaaagaguucucugaagucgaaggccgcauccaagaccuugagaaguauguggaggauaccaagauugaccuguggagcuacaaugcggaacuccugguugcccuggagaaccagcacacgaucgaucucacagacuccgaaaugaauaaacuguuugagaagaccaaaaagcagcuucgggaaaacgcugaggauauggggaauggaugcuucaaaauuuaucauaagugugacaacgccugcaucggcagcaucagaaaugggaccuacgaucacgacguguaucgcgacgaggcccugaacaaucgguuucagauuaagggcgucgaacucaaaucuggauacaaggauuggauccuguggauuuccuucgcuaucagcugcuuucuucuguguguggcccuccugggcuucauuaugugggcgugccaaaaagggaacaucagauguaauaucugcauuuga

SEQ ID NO: 193532 - RNA, 1701 nt, Artificial Sequence
  derived and/or modified sequence opt5 from hemagglutinin__InfluenzaA__AGW00889
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagucuacacugaaacuugccacggggaugcgcaacguccccgagaagcaaaccagaggaaucuucggcgcgauugccggguuuaucgaaaauggaugggagggcaugguugaugggugguauggauuccggcaccagaacagcgagggcagaggccaggcugccgaccugaaauccacacaagcugccauugaucagaucaaugggaagcucaaccgccugauuggaaaaaccaaugaaaaguuccaccagaucgagaaggaauuuagcgagguggaaggccggauucaggaccuugagaaauacguggaggauacaaagaucgaccuguggucuuauaacgccgaacuccuggucgcucuggagaaccaacauaccaucgaucucacggacuccgaaaugaauaaacuguucgagaagaccaaaaagcagcuuagagaaaacgcggaggauauggggaauggaugcuuuaagauuuaccacaaaugugacaacgccugcaucggcagcauucgcaaugggacauaugaucauaacguguaccgggacgaggcucugaauaacagauuccagaucaagggcguugaacucaaaucuggauacaaggacugggugcuguggauuuccuuugccaucagcugcuuccuucugugugucgcccuccugggcuuuaucaugugggcuugccagaaagggaauauucgcuguaacaucugcauuuga

SEQ ID NO: 193533 - RNA, 1701 nt, Artificial Sequence; identical to SEQ ID NO: 192882
  derived and/or modified sequence opt5 from hemagglutinin__InfluenzaA__AGW00901

SEQ ID NO: 193534 - RNA, 1701 nt, Artificial Sequence; identical to SEQ ID NO: 192882
  derived and/or modified sequence opt5 from hemagglutinin__InfluenzaA__AGW00913

SEQ ID NO: 193535 - RNA, 1701 nt, Artificial Sequence; identical to SEQ ID NO: 193018
  derived and/or modified sequence opt5 from hemagglutinin__InfluenzaA__AGW00931

SEQ ID NO: 193536 - RNA, 1701 nt, Artificial Sequence; identical to SEQ ID NO: 193018
  derived and/or modified sequence opt5 from hemagglutinin__InfluenzaA__AGW01244

SEQ ID NO: 193537 - RNA, 1701 nt, Artificial Sequence; identical to SEQ ID NO: 192892
  derived and/or modified sequence opt5 from hemagglutinin__InfluenzaA__AGW01256

SEQ ID NO: 193538 - RNA, 1701 nt, Artificial Sequence
  derived and/or modified sequence opt5 from hemagglutinin__InfluenzaA__AGW01295
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagucuacacugaaacuugccacggggaugcgcaacguccccgagaagcaaaccagaggaaucuucggcgcgauugccggguuuaucgaaaauggaugggagggcaugguugaugggugguauggauuccggcaccagaacagcgagggcagaggccaggcugccgaccugaaauccacacaagcugccauugaucagaucaaugggaagcucaaccgccugauuggaaaaaccaaugaaaaguuccaccagaucgagaaggaauuuagcgagguggaaggccggauucaggaccuugagaaauacguggaggauacaaagaucgaccuguggucuuauaacgccgaaauccucgucgcucuggagaaccaacauaccauugaucugacggacuccgaaaugaauaaacucuucgagaagaccaaaaagcagcugagagaaaacgcggaggauauggggaauggaugcuuuaagaucuaccacaaaugugacaacgccugcauuggcagcauccgcaaugggacauaugaucauaacguguaccgggacgaggcucuuaauaacagauuccagauuaagggcguugaacugaaaucuggauacaaggacuggauccucuggaucuccuuugccauuagcugcuuccugcuuuguguggcccugcucggcuuuaucaugugggcuugccagaaagggaauauucgcuguaacaucugcauuuga

SEQ ID NO: 193539 - RNA, 1701 nt, Artificial Sequence; identical to SEQ ID NO: 192882
  derived and/or modified sequence opt5 from hemagglutinin__InfluenzaA__AGW01307

SEQ ID NO: 193540 - RNA, 1701 nt, Artificial Sequence
  derived and/or modified sequence opt5 from hemagglutinin__InfluenzaA__AGW01319
augaagaccaucauugcccugagcuacauccucugccugguguucgcucaggagcuucccggcaacgacgauuccacagccacgcugugucucgggcaccaugcggucccuaauggaaccauuguuaaaacaaucaccaacgaccaaauugaagugacaaaugcuaccgagcuggugcagucuagcuccacaggcgaaaucugcaacucuccgcaccagauccuugauggggagaauuguacccugauugacgcccuccugggagauccccagugcgacggcuuucaaaacaagaaaugggaucuguucgucgaaagaagcaaggcccauuccaauuguuauccuuacgacgugcccgauuaugcuucucuccggagccugguugccuccagcgggacgcuugaguuuaacaaugagucuuucaacuggaccggagugacacaggacggcaccuccagcgcuugcauccgcagaucuaauaacuccuuuuucagccggcugaauuggcucacacaccugaacuuuaaauacccugcccuuaaugucaccaugcccaacaacgaacaguucgauaagcuguauauuuggggcgugcaucacccugggacggacaaggaucagaucuuucucuacgcgcaagccucuggacgcauuacaguuuccaccaaaagaagccagcaggcugugaucccgaauauuggcucccggccccgcgucagaaacaucccuucucgggugagcaucuauuggacaauugugaagcccggggacauccugcugauuaauuccaccggaaaccucaucgccccucgcggcuacuucaaaauuagaagcgggaagucuuccaucaugcggagcgacgcucccaucggaaaauguaauucugccugcauuaccccgaacggcagcaucccuaaugauaagcccuuucagaacgucaaucgcauuacauacggcgcguguccuagauauguuaagcaaaacacgcugaaacuugccaccgggaugcggaaugugcccgagaagcagacacgcggaaucuucggcgcuauugccggguuuaucgaaaacggaugggagggcaugguggacgggugguacggauucagacaccaaaauuccgagggccggggccaggcugccgaucugaaaucuacccaggccgcuaucgaccagauuaacgggaagcucaauaaacugaucggaaagacaaacgaaaaauuccaucagauugagaaggaauuuagcgaggucgaaggcagaauccaagaucuugagaaguauguggaggacaccaaaauugaucugugguccuacaacgcggaacuccugguugcccuggagaaucagcacacgaucgaccucacagauagcgaaaugaacaagcuguucgagaaaaccaagaaacagcuucgcgaaaaugcugaggacauggggaacggaugcuuuaagauuuaucauaagugugauaaugccugcaucggcucuauccggaacgggaccuacgaccacgacguguauagagaugaggcccugaauaaccgcuuccagauuaaaggcgucgaacucaaguccggauacaaagacuggauccuguggauuagcuuugcuaucucuugcuuccuucuguguguggcccuccugggcuuuauuaugugggcgugccaaaaggggaauauccgguguaacaucugcauuuga

SEQ ID NO: 193541 - RNA, 1701 nt, Artificial Sequence
  derived and/or modified sequence opt5 from hemagglutinin__InfluenzaA__AGW01331
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugguugauggaugguauggcuucagacaccagaacagcgagggccgggggcaggccgcugaccugaaauccacccaagccgccauugaucagaucaauggaaagcucaacagacugauuggcaaaacaaaugaaaaguuccaccagaucgagaaggaauuuagcgagguggaagggcgcauucaggaccuugagaaauacguggaggauaccaagaucgaccuguggucuuauaacgcugaacuccuggucgcgcuggagaaccaacauacaaucgaucucaccgacuccgaaaugaauaaacuguucgagaagacgaaaaagcagcuucgggaaaacgccgaggauaugggaaauggcugcuuuaagauuuaccacaaaugugacaacgcuugcaucgggagcauuagaaauggcacauaugagcaugauguguaccgcgacgaagcccugaacaaucgguuccagaucaagggaguugagcucaaaucuggcuacaaggacuggauucuguggaucuccuuugccaucagcugcuuccuucuguguguggcucuccugggguuuauuaugugggccugccagaaaggaaacaucagauguaauauuugcaucuga

SEQ ID NO: 193542 - RNA, 1701 nt, Artificial Sequence; identical to SEQ ID NO: 193018
  derived and/or modified sequence opt5 from hemagglutinin__InfluenzaA__AGW01343

SEQ ID NO: 193543 - RNA, 1701 nt, Artificial Sequence; identical to SEQ ID NO: 193021
  derived and/or modified sequence opt5 from hemagglutinin__InfluenzaA__AGW01355

SEQ ID NO: 193544 - RNA, 1701 nt, Artificial Sequence; identical to SEQ ID NO: 192892
  derived and/or modified sequence opt5 from hemagglutinin__InfluenzaA__AGW01367

SEQ ID NO: 193545 - RNA, 1701 nt, Artificial Sequence; identical to SEQ ID NO: 193018
  derived and/or modified sequence opt5 from hemagglutinin__InfluenzaA__AGW01391

SEQ ID NO: 193546 - RNA, 1701 nt, Artificial Sequence
  derived and/or modified sequence opt5 from hemagglutinin__InfluenzaA__AGW01403
augaagaccaucauugcccugagcuacauccucugccugauuuucgcucagaaacuucccggcaacgacaauuccacagccacgcugugucucgggcaccaugcggugccuaacggaaccaucgucaagacaauuaccaaugaucaaaucgagguuacaaacgcuaccgaacuggugcagucuagcuccacaggcgagaucugcaauucuccgcaccagauucuugacggggaaaacuguacccugaucgaugcccuccugggagacccccagugcgauggcuuucaaaauaaaaagugggaccuguucguggagagaagcaaagcccauuccaacuguuauccuuacgauguccccgacuaugcuucucuccggagccugguggccuccagcgggacgcuugaauuuaauaacgagucuuucaauuggaccggaguuacacagaacggcaccuccagcgcuugcauucgcagaucuaauaacuccuuuuucagccggcugaauuggcucacacaccugaacuuuaaguacccugcccuuaacgugaccaugcccaauaacgagcaguucgauaagcuguauaucuggggcguccaucacccugggacggacaaagaucagauuuuucucuacgcgcaagccgcuggacgcaucacagugucuaccaagagaucccagcaggccguuauuccgaauaucggcagccggccccgcgugagaaacaucccuucccgggucucuauuuauuggacaaucgugaaacccggggacauucugcugaucaauagcaccggaaaccucauugcuccucgcggcuacuucaagaucagauccgggaaaagcucuaucaugcgguccgaugcccccauuggaaaguguaauagcgcgugcaucaccccgaacggcucuauuccuaaugacaagcccuuucagaacgugaaucgcaucacauacggcgccuguccuagauaugucaaacaaaacacgcugaaacuugcuaccgggaugcggaauguucccgaaaaacagacacgcggaauuuucggcgccaucgcuggguuuaucgagaacggaugggaaggcaugguggacgggugguacggauucagacaccagaauagcgagggccggggccaagccgccgaucugaaguccacccaggcugcgauugaccagaucaacgggaaacucaacagacugauuggaaagacaaaugagaaauuccaucagaucgaaaaggaguuuucugaaguggagggccgcauucaagaucuugaaaaguaugucgaggacaccaaaaucgaucuguggagcuacaacgccgagcuccugguggcucuggaaaaucagcacacgauugaccucacagauuccgagaugaacaagcuguucgaaaagaccaagaaacagcuucgggagaaugccgaagacauggggaacggaugcuuuaagaucuaucauaagugugauaaugccugcaucggcagcauuagaaacgggaccuacgaccacuauguuuaccgcgaugaggcucugaauaaccgguuccagaucaaaggcguggagcucaagucuggauacaaagacuggauucuguggaucuccuuugccacaagcugcuuccuucugugugucgcgcuccugggcuuuauuaugugggcuugccaaaaggggaauaucagauguaacaucugcauuuga

SEQ ID NO: 193547 - RNA, 1701 nt, Artificial Sequence; identical to SEQ ID NO: 192882
  derived and/or modified sequence opt5 from hemagglutinin__InfluenzaA__AGW01415

SEQ ID NO: 193548 - RNA, 1701 nt, Artificial Sequence; identical to SEQ ID NO: 192882
  derived and/or modified sequence opt5 from hemagglutinin__InfluenzaA__AGW01427

SEQ ID NO: 193549 - RNA, 1701 nt, Artificial Sequence; identical to SEQ ID NO: 192882
  derived and/or modified sequence opt5 from hemagglutinin__InfluenzaA__AGW01439

SEQ ID NO: 193550 - RNA, 1701 nt, Artificial Sequence
  derived and/or modified sequence opt5 from hemagglutinin__InfluenzaA__AGW01451
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugauggauggaugguauggcuucagacaccagaacagcgagggccgggggcaggccgcugaccugaaauccacccaagccgccauugaucagaucaauggaaagcucaacagacugauuggcaaaacaaaugaaaaguuccaccagaucgagaaggaauuuagcgagguugaagggcgcauucaggaccuugagaaauacgugguggauaccaagaucgaccuguggucuuauaacgcugagcuccuggucgcgcuggaaaaccaacauacaaucgaucucaccgacuccgagaugaauaaacuguucgaaaagacgaaaaagcagcuucgggagaacgccgaagauaugggaaauggcugcuuuaagauuuaccacaaaugugacaacgcuugcaucgggagcauuagaaauggcacauaugaucaugacguguaccgcgacgaggcccugaacaaucgguuccagaucaagggaguugagcucaaaucuggcuacaaggauuggauucuguggaucuccuuugccaucagcugcuuccuucuguguguggcucuccugggguuuauuaugugggccugccagaaaggaaacaucagauguaauauuugcaucuga

SEQ ID NO: 193551 - RNA, 1701 nt, Artificial Sequence; identical to SEQ ID NO: 193018
  derived and/or modified sequence opt5 from hemagglutinin__InfluenzaA__AGW01463

SEQ ID NO: 193552 - RNA, 1701 nt, Artificial Sequence; identical to SEQ ID NO: 193018
  derived and/or modified sequence opt5 from hemagglutinin__InfluenzaA__AGW01475

SEQ ID NO: 193553 - RNA, 1701 nt, Artificial Sequence
  derived and/or modified sequence opt5 from hemagglutinin__InfluenzaA__AGW01487
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauaacuccuuuuucucucgccugaauuggcucacccauagcaacuuuaaguauccugcccugaacgucacaaugcccaauaacgagcaguucgacaaacuuuacaucuggggcgugcaccauccugggaccggaaaagaucagauuuuucuguaugcgcagucuuccggcagaaucacgguuagcacaaagcggucccaacaggccgugauuccgaauaucgggucucgccccagaauccggaacauuccuagccgcaucuccauuuacuggaccaucgucaaacccggagacauucuccugaucaauagcacaggcaaccugaucgcuccuagaggguacuucaagauucggucuggaaaauccagcaucaugcgcucugaugcccccauuggcaaguguaagagcgaaugcaucaccccgaauggcuccauuccuaacgacaaacccuuucagaaugugaacagaaucaccuauggggcuuguccucgguacgugaagcagucuacacucaaacuggccacgggaaugcgcaauguccccgagaagcaaaccagaggcaucuucggggcgauugccggauuuaucgaaaacggcugggaggggaugauggacggaugguauggcuuccggcaccagaauagcgagggcagagggcaggcugccgaucuuaaauccacacaagcugccauugaccagaucaacggaaagcugaaucgccucauuggcaaaaccaacgaaaaguuccaccagaucgagaaggaauuuagcgagguugaagggcggauucaggaucuggagaaauacguggaggacacaaagaucgaucuuuggucuuauaacgccgaacugcucguggcucuggagaaucaacauaccaucgaccugacggauuccgaaaugaacaaacucuucgagaagacaaagaagcagcugagagaaaaugcggaggacaugggaaacggcugcuuuaagauuuaccacaaaugugauaaugccugcaucgggagcauucgcaacggcaccuaugaccaugaugucuaccgggacgaggcucuuaauaacagauuccagaucaagggaguggaacugaaaucuggcuacaaggacuggauucucuggaucuccuuugccaucagcugcuuccugcuuuguguugcccugcucggguuuauuaugugggcuugccagaaaggaaauauccgcuguaacauuugcaucuga

SEQ ID NO: 193554 - RNA, 1701 nt, Artificial Sequence; identical to SEQ ID NO: 192882
  derived and/or modified sequence opt5 from hemagglutinin__InfluenzaA__AGW01499

SEQ ID NO: 193555 - RNA, 1701 nt, Artificial Sequence
  derived and/or modified sequence opt5 from hemagglutinin__InfluenzaA__AGW01511
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugguugauggaugguauggcuucagacaccagaacagcgagggccgggggcaggccgcugaccugaaauccacccaagccgccauugaucagaucaauggaaagcucaacagacugauuggcaaaacaaaugaaaaguuccaccagaucgagaaggaauuuagcgagguggaagggcgcauucaggaccuugagaaauacguggaggauaccaagaucgaccuguggucuuauaacgcugaacuccuggucgcgcuggagaaccaacauacaaucgaucucaccgacuccgaaaugaauaaacuguucgagaagacgaaaaagcagcuucgggaaaacgccgaggauaugggaaauggcugcuuuaagauuuaccacaaaugugacaacgcuugcaucgggagcauuagaaauggcacauaugaucaugacguguaccgcgacgaggcccugaacaaucgguuccagaucaagggaguugaacucaaaucuggcuacaaggauuggauucuguggaucuccuuugccaucagcugcuuccuucugugugcugcccuccugggguuuauuaugugggcgugccagaaaggaaacaucagauguaauauuugcaucuga

SEQ ID NO: 193556 - RNA, 1701 nt, Artificial Sequence
  derived and/or modified sequence opt5 from hemagglutinin__InfluenzaA__AGW01535
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaaggagagcuucaacugggcuggagugacgcaaaauggcaccucuuccgccugcauuagaggcagcaacucuuccuuuuucagccggcugaauuggcucacacaucugaacuuuaaguauccugcgcuuaaugucaccaugcccaacaacgagcaguucgacaaacuguacaucuggggagugcaccauccugggacagauaaggaccagauuuuucucuaugcccagucuuccggccgcaucaccguuagcacgaaaagaucccaacaggcugugauuccgaauaucgggucucggccccgcaucagaaacauuccuagccggaucuccauuuacuggacaaucgucaagcccggagauauucugcugaucaauagcaccggcaaccucaucgccccucgcggguacuucaaaauuagaucuggaaaguccagcaucaugcggucugacgcucccauuggcaaguguaaaagcgaaugcaucacaccgaauggcuccauuccuaacgacaagcccuuucagaaugugaaccgcaucaccuauggggccuguccuagauacgugaaacagucuacccugaaacuugcgacaggaaugcggaauguccccgagaagcaaacgcgcggcaucuucggggccauugcuggauuuaucgaaaacggcugggaggggaugguugauggaugguauggcuucagacaccagaauagcgagggccgggggcaggccgcugaccugaaguccacccaagccgccauugaucagaucaacggaaaacucaauagacugauuggcaagacaaacgaaaaguuccaccagaucgagaaagaauuuagcgagguggaagggcgcauucaggaccuugagaaguacguggaggauaccaaaaucgaccuguggucuuauaaugcugaacuccuggucgcgcuggagaaccaacauacaaucgaucucaccgacuccgaaaugaacaagcuguucgagaaaacgaagaagcagcuucgggaaaaugccgaggauaugggaaacggcugcuuuaaaauuuaccacaagugugacaaugcuugcaucgggagcauuagaaacggcacauaugaucaugacguguaccgcgacgaggcccugaauaaccgguuccagaucaaaggaguugaacucaagucuggcuacaaagauuggauucuguggaucuccuuugccaucagcugcuuccuucuguguguggcucuccugggguuuauuaugugggccugccagaagggaaauaucagauguaacauuugcaucuga

SEQ ID NO: 193557 - RNA, 1701 nt, Artificial Sequence; identical to SEQ ID NO: 192882
  derived and/or modified sequence opt5 from hemagglutinin__InfluenzaA__AGW01547

SEQ ID NO: 193558 - RNA, 1701 nt, Artificial Sequence; identical to SEQ ID NO: 193018
  derived and/or modified sequence opt5 from hemagglutinin__InfluenzaA__AGW01559

SEQ ID NO: 193559 - RNA, 1701 nt, Artificial Sequence; identical to SEQ ID NO: 193018
  derived and/or modified sequence opt5 from hemagglutinin__InfluenzaA__AGW01571

SEQ ID NO: 193560 - RNA, 1701 nt, Artificial Sequence; identical to SEQ ID NO: 193018
  derived and/or modified sequence opt5 from hemagglutinin__InfluenzaA__AGW01583

SEQ ID NO: 193561 - RNA, 1701 nt, Artificial Sequence; identical to SEQ ID NO: 193018
  derived and/or modified sequence opt5 from hemagglutinin__InfluenzaA__AGW01595

SEQ ID NO: 193562 - RNA, 1701 nt, Artificial Sequence
  derived and/or modified sequence opt5 from hemagglutinin__InfluenzaA__AGW01607
augaagaccaucauugcccugagcuacauccucugccuggugcuugcucagaaacugcccggcaacgacaauuccacagccacgcucugucuggggcaccaugcggucccuaacggaaccauuguuaagacaaucaccaaugauagaauugaggugacaaacgcuaccgaacuugugcaaaauucuagcaucggcgagaucugcgacuccccgcaccagauucuggauggggaaaacuguacacucaucgacgcccugcugggagauccccagugcgacggcuuccagaauaaaaagugggaucucuuugucgagcggucuaaagccuauagcaacuguuacccuuaugacgugcccgauuacgcuucccugcgcucucuuguugccagcuccgggacccuggaauuuaauaacgagagcuucaauugggcuggagugacgcaaaacggcaccucuuccgccugcauuagaggcagcaauucuuccuucuuuagccggcucaacuggcugacacaucuuaauuucaaguauccugcgcugaacgucaccaugcccaacaaugagcaguuugacaagcucuacaucuggggagugcaccauccugggacagauaaagaccagauuuuccuguaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcucaucaacagcaccggcaaucugaucgccccucgcggguacuuuaagauuagaucuggaaaauccagcaucaugcggucugacgcucccauuggcaaguguaagagcgaaugcaucacaccgaacggcuccauuccuaaugacaaacccuuccagaacgugaaucgcaucaccuauggggccuguccuagauacgugaagcagucuacccuuaaacuggcgacaggaaugcggaacguccccgagaagcaaacgcgcggcaucuuuggggccauugcuggauucaucgaaaauggcugggaggggaugguugauggaugguauggcuuuagacaccagaacagcgagggccgggggcaggccgcugaccucaaauccacccaagccgccauugaucagaucaauggaaagcugaacagacuuauuggcaaaacaaaugaaaaguuccaccagaucgagaaggaguucagcgaaguggaagggcgcauucaggaccuggagaaauacguggaggauaccaagaucgaccucuggucuuauaacgcugaacugcuggucgcgcucgagaaccaacauacaaucgaucugaccgacuccgaaaugaauaaacuuuuugagaagacgaaaaagcagcugcgggaaaacgccgaggauaugggaaauggcugcuucaagauuuaccacaaaugugacaacgcuugcaucgggagcauuagaaauggcacauaugaucaugacguguaccgcgacgaggcccucaacaaucgguuucagaucaagggaguugaacugaaaucuggcuacaaggauuggauucuuuggaucuccuucgccaucagcugcuuucugcucuguguggcucugcugggguucauuaugugggccugccagaaaggaaacaucagauguaauauuugcaucuga

SEQ ID NO: 193563 - RNA, 1701 nt, Artificial Sequence; identical to SEQ ID NO: 193021
  derived and/or modified sequence opt5 from hemagglutinin__InfluenzaA__AGW01619

SEQ ID NO: 193564 - RNA, 1701 nt, Artificial Sequence; identical to SEQ ID NO: 193018
  derived and/or modified sequence opt5 from hemagglutinin__InfluenzaA__AGW01631

SEQ ID NO: 193565 - RNA, 1701 nt, Artificial Sequence
  derived and/or modified sequence opt5 from hemagglutinin__InfluenzaA__AGW01643
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagaggcagcaauucuuccuuuuucagccggcugaacuggcucacccaucugaauuuuaaguauccugcccuuaacgucacaaugcccaacaaugagcaguucgacaagcuguacaucuggggagugcaccauccugggaccgauaaagaccagauuuuucucuaugcgcagucuuccggccgcaucacgguuagcacaaagagaucccaacaggccgugauuccgaacaucgggucucggccccgcaucagaaauauuccuagccggaucuccauuuacuggaccaucgucaaacccggagauauucugcugaucaacagcacaggcaaucucaucgcuccucgcggguacuucaagauuagaucuggaaaauccagcaucaugcggucugacgcccccauuggcaaguguaagagcgaaugcaucaccccgaacggcuccauuccuaaugacaaacccuuucagaacgugaaucgcaucaccuauggggcuuguccuagauacgugaagcagucuacacugaaacuugccacgggaaugcggaacguccccgagaagcaaacccgcggcaucuucggggcgauugccggauuuaucgaaaauggcugggaggggaugauggauggaugguauggcuucagacaccagaacagcgagggccgggggcaggcugccgaccugaaauccacacaagcugccauugaucagaucaauggaaagcucaacagacugauuggcaaaaccaaugaaaaguuccaccagaucgagaaggaauuuagcgagguugaagggcgcauucaggaccuugagaaauacguggaggauacaaagaucgaccuguggucuuauaacgccgaacuccugguggcucuggagaaccaacauaccaucgaucucacggacuccgaaaugaauaaacuguucgagaagaccaaaaagcagcuucgggaaaacgcggaggauaugggaaauggcugcuuuaagauuuaccacaaaugugacaacgccugcaucgggagcauuagaaauggcacauaugaucaugacgucuaccgcgacgaggcucugaacaaucgguuccagaucaagggaguggaacucaaaucuggcuacaaggauuggauucuguggaucuccuuugccaucagcugcuuccuucuguguguugcccuccugggguuuauuaugugggcuugccagaaaggaaacaucagauguaauauuugcaucuga

SEQ ID NO: 193566 - RNA, 1701 nt, Artificial Sequence; identical to SEQ ID NO: 193018
  derived and/or modified sequence opt5 from hemagglutinin__InfluenzaA__AGW01655

SEQ ID NO: 193567 - RNA, 1701 nt, Artificial Sequence
  derived and/or modified sequence opt5 from hemagglutinin__InfluenzaA__AGW01667
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugguugauggaugguauggcuucagacaccagaacagcgagggccgggggcaggccgcugaccugaaauccacccaagccgccauugaucagaucaauggaaagcucaacagacugauuggcaaaacaaaugaaaaguuccaccagaucgagaaggaauuuagcgagguggaagggcgcauucaggaccuugagaaauacguggaggauaccaagaucgaccuguggucuuauaacgcugaacuccuggucgcgcuggagaaccaacauacaaucgaucucaccgacuccgaaaugaauaaacuguucgagaagacgaaaaagcagcuucgggaaaacgccgaggauaugggaaauggcugcuuuaagauuuaccacaaaugugacaacgcuugcaucgggagcauuagaaaugagacauaugaucaugacguguaccgcgacgaagcccugaacaaucgguuccagaucaagggcguugagcucaaaucuggauacaaggauuggauucuguggaucuccuuugccaucagcugcuuccuucuguguguggcucuccugggcuuuauuaugugggccugccagaaagggaacaucagauguaauauuugcaucuga

SEQ ID NO: 193568 - RNA, 1701 nt, Artificial Sequence; identical to SEQ ID NO: 193018
  derived and/or modified sequence opt5 from hemagglutinin__InfluenzaA__AGW01679

SEQ ID NO: 193569 - RNA, 1701 nt, Artificial Sequence
  derived and/or modified sequence opt5 from hemagglutinin__InfluenzaA__AGW01691
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagucuacacugaaacuugccacggggaugcgcaacguccccgagaagcaaaccagaggaaucuucggcgcgauugccggguuuaucgaaaauggaugggagggcaugguugaugggugguauggauuccggcaccagaacagcgagggcagaggccaggcugccgaccugaaauccacacaagcugccauugaucagaucaaugggaagcucaaccgccugauuggaaaaaccaaugaaaaguuccaccagaucgagaaggaauuuagcgagguggaaggccggauucaggaccuugagaaauacguggaggauacaaagaucgaccuguggucuuauaacgccgaacuccuggucgcucuggagaaccaacauaccaucgaucucacggacuccgaaaugaauaaacuguucgagaagaccaaaaagcagcuuagagaaaacgcggaggauauggggaauggaugcuuuaagauuuaccacaaaugugacaacgccugcaucggcagcauucgcaaugggacauaugaucaugacguguaccgggacgaggcucugaacaauagauuccagaucaagggcguugaacucaaaucuggauacaaggauuggauucuguggaucuccuuugccaucagcugcuuccuucuguguguggcccuccugggcuuugucaugugggcuugccagaaagggaacauucgcuguaauaucugcauuuga

SEQ ID NO: 193570 - RNA, 1701 nt, Artificial Sequence; identical to SEQ ID NO: 192882
  derived and/or modified sequence opt5 from hemagglutinin__InfluenzaA__AGW01701

SEQ ID NO: 193571 - RNA, 1701 nt, Artificial Sequence; identical to SEQ ID NO: 192882
  derived and/or modified sequence opt5 from hemagglutinin__InfluenzaA__AGW01713

SEQ ID NO: 193572 - RNA, 1701 nt, Artificial Sequence
  derived and/or modified sequence opt5 from hemagglutinin__InfluenzaA__AGW01725
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagucuacacugaaacuugccacggggaugcgcaacguccccgagaagcaaaccagaggaaucuucggcgcgauugccggguuuaucgaaaauggaugggagggcaugguugaugggugguauggauuccggcaccagaacagcgagggcagaggccaggcugccgaccugaaauccacacaagcugccauugaucagaucaaugggaagcucaaccgccugauuggaaaaaccaaugaaaaguuccaccagaucgagaaggaauuuagcgagguggaaggccggauucaggaccuugagaaauacguggaggauacaaagaucgaccuguggucuuauaacgccgaacuccuggucgcucuggagaaccaacauaccaucgaucucacggacuccgaaaugaauaaacuguucgagaagaccaaaaagcagcuuagagaaaacgcggaggauauggggaauggaugcuuuaagauuuaccacaaaugugacaacgccugcaucggcagcauucgcaaugggacauaugaucauaacguguaccgggacgaggcucugaauaacagauuccagaucaagggcguugaacucaaaucuggauacaaggacuggauucuguggaucuccuuugccaucagcugcuuccuuauuuguguggcccugcucggcuuuaucaugugggcuugccagaaagggaauauucgcuguaacaucugcauuuga

SEQ ID NO: 193573 - RNA, 1701 nt, Artificial Sequence; identical to SEQ ID NO: 192882
  derived and/or modified sequence opt5 from hemagglutinin__InfluenzaA__AGW01737

SEQ ID NO: 193574 - RNA, 1701 nt, Artificial Sequence; identical to SEQ ID NO: 193018
  derived and/or modified sequence opt5 from hemagglutinin__InfluenzaA__AGW01749

SEQ ID NO: 193575 - RNA, 1701 nt, Artificial Sequence; identical to SEQ ID NO: 193018
  derived and/or modified sequence opt5 from hemagglutinin__InfluenzaA__AGW01761

SEQ ID NO: 193576 - RNA, 1701 nt, Artificial Sequence; identical to SEQ ID NO: 192882
  derived and/or modified sequence opt5 from hemagglutinin__InfluenzaA__AGW01773

SEQ ID NO: 193577 - RNA, 1701 nt, Artificial Sequence; identical to SEQ ID NO: 193018
  derived and/or modified sequence opt5 from hemagglutinin__InfluenzaA__AGW01785

SEQ ID NO: 193578 - RNA, 1701 nt, Artificial Sequence; identical to SEQ ID NO: 192882
  derived and/or modified sequence opt5 from hemagglutinin__InfluenzaA__AGW01797

SEQ ID NO: 193579 - RNA, 1701 nt, Artificial Sequence; identical to SEQ ID NO: 193018
  derived and/or modified sequence opt5 from hemagglutinin__InfluenzaA__AGW01809

SEQ ID NO: 193580 - RNA, 1701 nt, Artificial Sequence; identical to SEQ ID NO: 193018
  derived and/or modified sequence opt5 from hemagglutinin__InfluenzaA__AGW01821

SEQ ID NO: 193581 - RNA, 1701 nt, Artificial Sequence; identical to SEQ ID NO: 193017
  derived and/or modified sequence opt5 from hemagglutinin__InfluenzaA__AGW01833

SEQ ID NO: 193582 - RNA, 1701 nt, Artificial Sequence
  derived and/or modified sequence opt5 from hemagglutinin__InfluenzaA__AGW01845
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuacgaaugagagcuucaacuggaccggagugacacaaaauggcaccucuuccgcuugcauuagacggagcaacucuuccuuuuucagccgccugaauuggcucacacaucugaacuuuaaguauccugcccuuaaugucaccaugcccaacaacgagcaguucgacaagcuguacaucuggggcgugcaccauccugggacggauaaagaccagauuuuucucuaugcgcagucuuccggaagaaucacaguuagcaccaagcggucccaacaggccgugauuccgaauaucggcucucgccccagaauccggaacauuccuagccgcaucuccauuuacuggacaaucgucaaacccggggauauucugcugaucaauagcaccggaaaccucaucgcuccuagaggcuacuucaagauucggucugggaaauccagcaucaugcgcucugacgcccccauuggaaaguguaagagcgaaugcaucaccccgaauggcuccauuccuaacgacaaacccuuucagaaugugaacagaaucacauauggcgcuuguccucgguacgugaagcagucuacgcugaaacuugccaccgggaugcgcaauguccccgagaagcaaacaagaggaaucuucggcgcgauugccggguuuaucgaaaacggaugggagggcaugguugaugggugguauggauuccggcaccagaauagcgagggcagaggccaggcugccgaccugaaauccacccaagcugccauugaucagaucaacgggaagcucaaucgccugauuggaaaaacaaacgaaaaguuccaccagaucgagaaggaauuuagcgagguggaaggccggauucaggaccuugagaaauacguggaggauaccaagaucgaccuguggucuuauaaugccgaacuccuggucgcucuggagaaccaacauacgaucgaucucacagacuccgaaaugaacaaacuguucgagaagaccaaaaagcagcuuagagaaaaugcggaggauauggggaacggaugcuuuaagauuuaccacaaaugugacaaugccugcaucggcagcauucgcaacgggaccuaugaucauaauguguaccgggacgaggcucugaacaauagauuccagaucaagggcguugaacucaaaucuggauacaaggacuggauucuguggaucuccuuugccaucagcugcuuccuucuguguguggcccuccugggcuuuauuaugugggcuugccagaaagggaacauccgcuguaauauuugcaucuga

SEQ ID NO: 193583 - RNA, 1701 nt, Artificial Sequence; identical to SEQ ID NO: 193018
  derived and/or modified sequence opt5 from hemagglutinin__InfluenzaA__AGW01857

SEQ ID NO: 193584 - RNA, 1701 nt, Artificial Sequence; identical to SEQ ID NO: 193018
  derived and/or modified sequence opt5 from hemagglutinin__InfluenzaA__AGW01869

SEQ ID NO: 193585 - RNA, 1701 nt, Artificial Sequence; identical to SEQ ID NO: 193569
  derived and/or modified sequence opt5 from hemagglutinin__InfluenzaA__AGW01881

SEQ ID NO: 193586 - RNA, 1701 nt, Artificial Sequence; identical to SEQ ID NO: 192892
  derived and/or modified sequence opt5 from hemagglutinin__InfluenzaA__AGW01893

SEQ ID NO: 193587 - RNA, 1701 nt, Artificial Sequence; identical to SEQ ID NO: 192907
  derived and/or modified sequence opt5 from hemagglutinin__InfluenzaA__AGW01905

SEQ ID NO: 193588 - RNA, 1701 nt, Artificial Sequence; identical to SEQ ID NO: 193018
  derived and/or modified sequence opt5 from hemagglutinin__InfluenzaA__AGW01917

SEQ ID NO: 193589 - RNA, 1701 nt, Artificial Sequence; identical to SEQ ID NO: 192882
  derived and/or modified sequence opt5 from hemagglutinin__InfluenzaA__AGW01929

SEQ ID NO: 193590 - RNA, 1701 nt, Artificial Sequence; identical to SEQ ID NO: 193018
  derived and/or modified sequence opt5 from hemagglutinin__InfluenzaA__AGW01941

SEQ ID NO: 193591 - RNA, 1701 nt, Artificial Sequence; identical to SEQ ID NO: 192882
  derived and/or modified sequence opt5 from hemagglutinin__InfluenzaA__AGW01953

SEQ ID NO: 193592 - RNA, 1701 nt, Artificial Sequence
  derived and/or modified sequence opt5 from hemagglutinin__InfluenzaA__AGW01965
augaagaccaucauugcccugagcuacauccucugccugguguucgcucaggagcuucccggcaacgacgauuccauggccacacugugucucgggcaccaugcggucccuaauggaacgauuguuaaaaccaucacaaacgaccaaauugaagugaccaaugcuacagagcuggugcagucuagcuccaccggcgaaaucugcaacucuccgcaccagauccuugauggggagaauuguacacugauugacgcccuccugggagauccccagugcgacggcuuucaaaacaagaaaugggaucuguucgucgaaagaagcaaggcccauuccaauuguuauccuuacgacgugcccgauuaugcuucucuccggagccugguugccuccagcgggacccuugaguuuaacaaugagucuuucaacuggacgggagugacccagaauggcacauccagcgcuugcauccgcagaucuaacaauuccuuuuucagccggcugaacuggcucacccaccugaauuuuaaauacccugcccuuaacgucacaaugcccaacaaugaacaguucgacaagcuguauauuuggggcgugcaucacccugggaccgauaaggaccagaucuuucucuacgcgcaagccucuggacgcauuacgguuuccacaaaaagaagccagcaggcugugaucccgaacauuggcucccggccccgcgucagaaauaucccuucucgggugagcaucuauuggaccauugugaagcccggggauauccugcugauuaacuccacaggaaaucucaucgccccucgcggcuacuucaaaauuagaagcgggaagucuuccaucaugcggagcgacgcucccaucggaaaauguaacucugccugcauuaccccgaauggcagcaucccuaacgacaagcccuuucagaaugucaaccgcauuaccuacggcgcguguccuagauauguuaagcaaaauacacugaaacuugccacggggaugcggaacgugcccgagaagcagacccgcggaaucuucggcgcuauugccggguuuaucgaaaauggaugggagggcaugguggaugggugguacggauucagacaccagaacuccgagggccggggccaagcugccgaccugaaaucuacacaggccgcuaucgaucagauuaaugggaagcucaacagacugaucggaaaaaccaacgaaaaguuccaucagauugagaaagaauuuagcgaggucgaaggccgcauccaagaccuugagaaguauguggaggauacaaagauugaccugugguccuacaaugcggaacuccugguugcccuggagaaccagcacaccaucgaucucacggacagcgaaaugaauaaacuguucgagaagaccaaaaagcagcuucgggaaaacgcugaggauauggggaauggaugcuuuaaaauuuaucauaagugugacaacgauugcaucggcucuaucagaaaugggacauacgaccacaacguguaucgcgacgaggcccugaauaaccgguuccagauuaagggcaucgaacucaaauccggauacaaggauuggauucuguggaucagcuuugccauuucuugcuuccuucugugugucgcucuccugggcuuuaucaugugggccugccaaaaagggaauaucagauguaacauuugcaucuga

SEQ ID NO: 193593 - RNA, 1701 nt, Artificial Sequence; identical to SEQ ID NO: 193018
  derived and/or modified sequence opt5 from hemagglutinin__InfluenzaA__AGW01977

SEQ ID NO: 193594 - RNA, 1701 nt, Artificial Sequence; identical to SEQ ID NO: 193018
  derived and/or modified sequence opt5 from hemagglutinin__InfluenzaA__AGW01989

SEQ ID NO: 193595 - RNA, 1701 nt, Artificial Sequence; identical to SEQ ID NO: 193018
  derived and/or modified sequence opt5 from hemagglutinin__InfluenzaA__AGW02001

SEQ ID NO: 193596 - RNA, 1701 nt, Artificial Sequence; identical to SEQ ID NO: 193018
  derived and/or modified sequence opt5 from hemagglutinin__InfluenzaA__AGW02013

SEQ ID NO: 193597 - RNA, 1701 nt, Artificial Sequence; identical to SEQ ID NO: 192882
  derived and/or modified sequence opt5 from hemagglutinin__InfluenzaA__AGW02025

SEQ ID NO: 193598 - RNA, 1701 nt, Artificial Sequence; identical to SEQ ID NO: 193018
  derived and/or modified sequence opt5 from hemagglutinin__InfluenzaA__AGW02037

SEQ ID NO: 193599 - RNA, 1701 nt, Artificial Sequence; identical to SEQ ID NO: 193018
  derived and/or modified sequence opt5 from hemagglutinin__InfluenzaA__AGW02061

SEQ ID NO: 193600 - RNA, 1701 nt, Artificial Sequence; identical to SEQ ID NO: 193018
  derived and/or modified sequence opt5 from hemagglutinin__InfluenzaA__AGW02073

SEQ ID NO: 193601 - RNA, 1701 nt, Artificial Sequence; identical to SEQ ID NO: 193018
  derived and/or modified sequence opt5 from hemagglutinin__InfluenzaA__AGW02085

SEQ ID NO: 193602 - RNA, 1701 nt, Artificial Sequence; identical to SEQ ID NO: 192907
  derived and/or modified sequence opt5 from hemagglutinin__InfluenzaA__AGW02097

SEQ ID NO: 193603 - RNA, 1701 nt, Artificial Sequence; identical to SEQ ID NO: 192882
  derived and/or modified sequence opt5 from hemagglutinin__InfluenzaA__AGW02109

SEQ ID NO: 193604 - RNA, 1701 nt, Artificial Sequence; identical to SEQ ID NO: 193018
  derived and/or modified sequence opt5 from hemagglutinin__InfluenzaA__AGW02133

SEQ ID NO: 193605 - RNA, 1701 nt, Artificial Sequence; identical to SEQ ID NO: 193018
  derived and/or modified sequence opt5 from hemagglutinin__InfluenzaA__AGW02157

SEQ ID NO: 193606 - RNA, 1701 nt, Artificial Sequence; identical to SEQ ID NO: 192882
  derived and/or modified sequence opt5 from hemagglutinin__InfluenzaA__AGW02169

SEQ ID NO: 193607 - RNA, 1701 nt, Artificial Sequence; identical to SEQ ID NO: 193018
  derived and/or modified sequence opt5 from hemagglutinin__InfluenzaA__AGW02181

SEQ ID NO: 193608 - RNA, 1701 nt, Artificial Sequence; identical to SEQ ID NO: 192892
  derived and/or modified sequence opt5 from hemagglutinin__InfluenzaA__AGW02193

SEQ ID NO: 193609 - RNA, 1701 nt, Artificial Sequence; identical to SEQ ID NO: 192859
  derived and/or modified sequence opt5 from hemagglutinin__InfluenzaA__AGW04171

SEQ ID NO: 193610 - RNA, 1707 nt, Artificial Sequence
  derived and/or modified sequence opt5 from hemagglutinin__InfluenzaA__AGW27061
auggagaagaucgugcuucucuucgccauugucaaccugguuaaaagcgaccacaucugcauuggcuaccaugcuaauaacuccaccgaacagguggauacaaucauggagaagaaugugacggucacccacgcccaagacauucuugaaaagacacauaacgggaagcugugugaucucaauggagugaaaccccugauccuuaaggacugcucuguugcgggcuggcugcucgggaacccuaugugugaugaguuuaucgacgugccggaauggagcuauauugucgagaaggcuaaucccgccaacgaucugugcuacccuggaaauuucaacgacuaugaggaacugaaacaccuccuguccagaaucaaucauuuugagaagauucggaucauucccaaagauucuuggccugaccacgaagccagccuuggcguguccgcugccuguucuuaccaggggaacagcuccuucuuucgcaauguuguguggcugcucaagaaaaacgaugcuuaucccaucauuaaaaagagcuacaauaacaccaacaaagaggaccugcuuguccuguggggaauccaccauccuaaugaugaggccgaacagaucagacucuaucagaacccgacaaccuacgugucuacaggcaccuccacgcugaaucaacggcuggugccccgcauugcgaccagaagcaaggucaacggccagucugggcggaucgacuucuuuuggacaauucucaaaccuaaugacgccaucaacuucgaguccaauggaaacuuuauugcucccgaauacgccuauaagaucguuaaaaagggcgauagcaccaucaugcgcucugagguggaauacgggaauugcuccacaagaugucagaccccuaugggagcuauuaacagcuccaugcccuuccacaauauccauccgcugacgauuggcgagugcccuaaauaugugaagucuaacaagcugguccuggccacagggcuccggaauagcccccagaucgagcgcagacggcgcaaaagaggacuguuuggcgcgauugccggcuucaucgaagggggauggcaaggcaugguggacgggugguacggauaucaccacuccaacgagcagggcagcggguacgcugccgauaaggaaucuacccagaaagcuaucgacggaguuacaaauaaggugaacuccauuaucgauaaaaugaacacccaguuugaggccgucggccgggaguucaauaaccuugaacgcagaauugagaaucugaacaagaagauggaagacggcuuccucgauguguggaccuauaaugccgagcugcugguucucauggaaaacgagcggacacuggacuuucaugauagcaaugugaaaaaccuuuacgacaaggucagacugcaacuccgcgauaaugcuaaagaacuggggaacggauguuucgaguuuuaccacaagugcgacaaugaguguauggaaucugugcggaacggcacguaugacuacccucaguauagcgaggaagcgagacuuaaacgcgaggagaucuccggggucaagcuggaaucuauuggaaccuaccagauccucagcauuuauuccacaguggccagcucucugguucuguccaucaugguggcuggccucagccuguggaugugcucuaaugggucccuucaaugccggauguguaucuga

SEQ ID NO: 193611 - RNA, 1698 nt, Artificial Sequence
  derived and/or modified sequence opt5 from hemagglutinin__InfluenzaA__AGY14471
augaaggugaaacugcucauccugcuuugcaccuucacagccacguacgcugacaccauuuguaucggcuaucacgccaacaauagcacagauaccgucgacacaauucuggagaagaacguuaccgugacacauuccgugaaucuccuggaagauucucacaacgggaaacuuugccugcucaagggaaucgcgccccugcagcugggcaauuguagcgucgcuggguggauucucggaaacccugagugcggccugcuuaucccgaaagaauccuggucuuacaucguggagacccccaauccugaaaacgggacguguuaucccggauacuuugacgauuaugaggagcugagagaacaacucagcuccguuucuagcuucgagcgguuugaaauuuucccuaaggaguccagcuggcccaaucauaccgugacaggcgucucugccuccugcagccacaacggcaagucuuccuuuuaccgcaaucugcuuuggcugaccgggaaaaacggacucuauccuaaucugagcaagucuuacgccaacaauaaagagaaggaagugcugauccucuggggcguucaucacccguccaacauugggaaccagagaacacuguaccacaccgagaauacguaugugagcgucguguccucucauuacagccggcgcuucacacccgaaaucaccaaaagaccuaaggugcgggaccaggagggacgcauuaacuauuacuggacacuucuggaacccggcgauaccaucauuuuugaggcuaaugggaaccucaucgccccuugguaugcuuucgcccuguccaagggauuuggcagcggcaucauuaccucuaaugcgcccauggacgagugugaugccaaaugccagacaccgcaaggggcuaucaacuccaaucuuccuuuccagaacguccaccccguuacgauuggagaauguccuaaguacgugagaagcaccaaacugcggauggugacaggccuccgcaauauccccucuauucagagcagagggcuguuuggagccaucgcuggcuucaucgaagggggauggaccggcauggucgacggcugguauggguaccaucaccagaacgaacaaggauccggcuacgccgcggaucaggagucuacacagaaugccauuaacgggaucaccaauaaggugaacagcguuauugagaaaaugaauacgcaguuuacaguggucggaaaggaguucaacaaacuggagcggcgcauggaaaaccucaauaagaagguggacgauggcuuccuggacaucuggaccuauaacgcugagcuucugguucuccuggaaaaugagagaacccuugacuuucacgauuccaacgugaugaaucuguacgaaaaagucaaggggcaacucaaaaacaaugccaaggagauuggcaacggaugcuucgaguuuuaucauaaauguaauaacgaaugcauggagagcgugaagaauggcacauacgacuaucccaaguacucugaagaguccaaacugaaccgggagaagaucgauggggucaaacuggaaagcaugggaguguaucagauccucgcuauuuacucuaccguugccuccagccuggugcuucuggucucccucggcgccaucucuuucuggaugugcagcaaugggucccugcagugucgcauuugcaucuga

SEQ ID NO: 193612 - RNA, 1698 nt, Artificial Sequence; identical to SEQ ID NO: 193611
  derived and/or modified sequence opt5 from hemagglutinin__InfluenzaA__AGY14477

SEQ ID NO: 193613 - RNA, 1701 nt, Artificial Sequence
  derived and/or modified sequence opt5 from hemagglutinin__InfluenzaA__AHC57459
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccgcuggacgcauuacaguuucuaccaagagaucccagcaggccgugaucccgaauauuggcagccggccccgcaucagaaacaucccuucccgggucucuauuuauuggacaaucgugaaacccggggacauucugcugaucaauagcaccggaaaccucauugcuccucgcggcuacuucaagaucagauccgggaaaagcucuaucaugcgguccgaugcccccauuggaaaguguaauagcgcgugcaucaccccgaacggcucuauuccuaaugacaagcccuuucagaacgugaaucgcaucacauacggcgccuguccuagauaugucaaacaaaacacgcugaaacuugcuaccgggaugcggaauguucccgaaaaacagacacgcggaauuuucggcgccaucgcuggguuuaucgagaacggaugggaaggcaugguggacgggugguacggauucagacaccagaauagcgagggccggggccaagccgccgaucugaaguccacccaggcugcgauugaccagaucaacgggaaacucaacagacugauuggaaagacaaaugagaaauuccaucagaucgaaaaggaguuuucugaaguggagggccgcauucaagaucuugaaaaguaugucgaggacaccaaaaucgaucuguggagcuacaacgccgagcuccugguggcucuggaaaaucagcacacgauugaccucacagauuccgagaugaacaagcuguucgaaaagaccaagaaacagcuucgggagaaugccgaagacauggggaacggaugcuuuaagaucuaucauaagugugauaaugccugcaucggcagcauuagaaacgggaccuacgaccacgauguuuaucgcgacgaggcucugaauaaccgguuccagaucaaaggcguggagcucaagucuggauacaaagacuggauucuguggaucuccuuugccauuagcugcuuccuucugugugucgcgcuccugggcuuuaucaugugggcuugccaaaaggggaauaucagauguaacauuugcaucuga

SEQ ID NO: 193614 - RNA, 1701 nt, Artificial Sequence; identical to SEQ ID NO: 190006
  derived and/or modified sequence opt5 from hemagglutinin__InfluenzaA__AHC57465

SEQ ID NO: 193615 - RNA, 1701 nt, Artificial Sequence; identical to SEQ ID NO: 189879
  derived and/or modified sequence opt5 from hemagglutinin__InfluenzaA__AHC57487

SEQ ID NO: 193616 - RNA, 1701 nt, Artificial Sequence; identical to SEQ ID NO: 190806
  derived and/or modified sequence opt5 from hemagglutinin__InfluenzaA__AHC57499

SEQ ID NO: 193617 - RNA, 1701 nt, Artificial Sequence; identical to SEQ ID NO: 190806
  derived and/or modified sequence opt5 from hemagglutinin__InfluenzaA__AHC57511

SEQ ID NO: 193618 - RNA, 1701 nt, Artificial Sequence; identical to SEQ ID NO: 190806
  derived and/or modified sequence opt5 from hemagglutinin__InfluenzaA__AHC57523

SEQ ID NO: 193619 - RNA, 1701 nt, Artificial Sequence; identical to SEQ ID NO: 190006
  derived and/or modified sequence opt5 from hemagglutinin__InfluenzaA__AHC57675

SEQ ID NO: 193620 - RNA, 1701 nt, Artificial Sequence; identical to SEQ ID NO: 190006
  derived and/or modified sequence opt5 from hemagglutinin__InfluenzaA__AHC57827

SEQ ID NO: 193621 - RNA, 1701 nt, Artificial Sequence; identical to SEQ ID NO: 189879
  derived and/or modified sequence opt5 from hemagglutinin__InfluenzaA__AHC57956

SEQ ID NO: 193622 - RNA, 1701 nt, Artificial Sequence
  derived and/or modified sequence opt5 from hemagglutinin__InfluenzaA__AHC57981
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugaucaaaucgaggugacaaacgcuaccgaacucgugcaaaauucuagcacaggcgagaucugcgacuccccgcaccagauucuggauggggaaaacuguacccuuaucgacgcccugcucggagauccccagugcgacggcuuucagaauaaaaagugggaucuguucgucgagagaucuaaagccuauagcaacuguuacccuuaugacgugcccgauuacgcuucccugcggucucucauugccagcuccgggacgcuggaauuuaauaacgagagcuucaauuggaccggaguuacacagaacggcaccucuuccgcuugcauccgcagaagcaauaacuccuuuuucucucggcuuaauuggcugacacaucucaacuuuaaguauccugcccugaacgugaccaugcccaauaacgagcaguucgacaaacuuuacauuuggggcguccaccauccugggacggauaaggaccagaucuuucuguaugcgcaagccagcggacgcauuacagugucuaccaagagaucccagcaggcuguuaucccgaauaucggcagccggccccgcgugagaaacauuccuucccggaucucuauuuacuggacaaucgucaaacccggggauauucuccugaucaauagcaccggaaaccugaucgccccucgcggcuacuucaagauuagauccgggaaaagcucuaucaugcgguccgacgcucccauuggaaaguguaauagcgaaugcaucaccccgaacggcucuauuccuaaugacaagcccuuucagaacgugaaucgcaucacauauggcgccuguccuagauacgugaaacaaaacacgcucaagcuggcgaccgggaugcggaauguccccgagaaacagacacgcggaaucuucggcgccauugcuggguuuaucgaaaacggaugggagggcaugguugaugggugguauggauucagacaccagaauagcgagggccggggccaagccgcugaccuuaaguccacccaggccgccauugaucagaucaacgggaaccugaauagacucauuggaaaaacaaacgaaaaguuccaccagaucgagaaagaauuuucugagguggaaggccgcauucaagaccuggagaaguacguggaggauaccaagaucgaccuuuggagcuauaaugcugaacugcucgucgcgcuggagaaccagcauacgaucgaucugacagacuccgaaaugaauaaacucuucgagaagaccaaaaagcagcugcgggaaaacgccgaggauauggggaauggaugcuuuaaaauuuaccacaagugugacaacgcuugcaucggcagcauuagaaaugggaccuaugaucaugacguguaccgcgacgaggcccuuaacaaucgguuccagaucaagggcguugaacugaaaucuggauacaaggauuggauucucuggaucuccuuugccaucagcugcuuccugcuuuguguggcucugcucggcuuuauuaugugggccugccaaaaagggaacaucagauguaauauuugcaucuga

SEQ ID NO: 193623 - RNA, 1701 nt, Artificial Sequence; identical to SEQ ID NO: 190806
  derived and/or modified sequence opt5 from hemagglutinin__InfluenzaA__AHC57993

SEQ ID NO: 193624 - RNA, 1701 nt, Artificial Sequence; identical to SEQ ID NO: 192098
  derived and/or modified sequence opt5 from hemagglutinin__InfluenzaA__AHC58005

SEQ ID NO: 193625 - RNA, 1701 nt, Artificial Sequence
  derived and/or modified sequence opt5 from hemagglutinin__InfluenzaA__AHC58017
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccgcuggacgcauuacaguuucuaccaagagaucccagcaggccgugaucccgaauauuggcagccggccccgcgucagaaacaucccuucccgggugucuaucuauuggacaauugugaaacccggggacauccugcugauuaauagcaccggaaaccucaucgcuccucgcggcuacuucaagauuagauccgggaaaagcucuaucaugcgguccgaugcccccaucggaaaguguaauagcgcgugcauuaccccgaacggcucuaucccuaaugacaagcccuuucagaacgucaaucgcauuacauacggcgccuguccuagauauguuaaacaaaacacgcugaaacuugcuaccgggaugcggaaugugcccgaaaaacagacacgcggaaucuucggcgccauugcuggguuuaucgagaacggaugggaaggcaugguggacgggugguacggauucagacaccagaauagcgagggccggggccaagccgccgaucugaaguccacccaggcugcgaucgaccagauuaacgggaaacucaacagacugaucggaaagacaaaugagaaauuccaucagauugaaaaggaguuuucugaagucgagggccgcauccaagaucuugaaaaguauguggaggacaccaaaauugaucuguggagcuacaacgccgagcuccugguugcucuggaaaaucagcacacgaucgaccucacagauuccgagaugaacaagcuguucgaaaagaccaagaaacagcuucgggagaaugccgaagacauggggaacggaugcuuuaagauuuaucauaagugugauaaugccugcaucgugagcaucagaaacggcaccuacgaccacgaugucuaucgcgacgaggcucugaauaaccgguuccagauuaaagggguggagcucaagucuggcuacaaagacuggauccuguggauuuccuuugccaucagcugcuuccuucuguguguugcgcuccugggauuuauuaugugggcuugccaaaagggcaauaucagauguaacaucugcauuuga

SEQ ID NO: 193626 - RNA, 1701 nt, Artificial Sequence
  derived and/or modified sequence opt5 from hemagglutinin__InfluenzaA__AHC58029
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcggcucuaauaacuccuuuuucagcagacugaauuggcucacacagcugaacuuuaaguacccugcccuuaacgucaccaugcccaauaacgagcaguucgauaagcuguauauuuggggagugcaccauccugggacggacaaagaucaaaucuuucucuacgcgcaggccucuggccggauuacaguuuccaccaagcgcagccagcaggcugugaucccgaauauuggguccagaccccggguccgcaacaucccuucuagagugagcaucuauuggacaauugugaaacccggagacauccugcugauuaauuccaccggcaaccucaucgccccucggggguacuucaagauucgcagcggaaaaucuuccaucaugagaagcgaugcucccaucggcaaguguaauucugccugcauuaccccgaacggcagcaucccuaaugacaagcccuuucaaaacgucaaucggauuacauacggggcguguccucgcuauguuaaacagaacacgcugaaacuugccaccggaaugagaaaugugcccgaaaaacagacacggggcaucuucggggcuauugccggauuuaucgagaacggcugggaagggaugguggacggaugguacggcuuccgccaccaaaauuccgagggcagagggcaggcugccgaucugaagucuacccaggccgcuaucgaccagauuaacggaaaacucaaccggcugaucggcaagacaaaugagaaauuccaccaaauugaaaaggaguuuagcgaagucgaggggagaauccaggaucuugaaaaguauguggaggacaccaaaauugaucugugguccuacaacgcggagcuccugguugcccuggaaaaucagcauacgaucgaccucacagauagcgagaugaacaagcuguucgaaaagaccaagaaacagcuucgcgagaaugcugaagacaugggaaacggcugcuuuaagauuuaucacaagugugauaaugccugcaucgggucuauccggaacggcaccuacgaccaugauguguauagagacgaggcccugaauaaccgcuuccaaauuaaaggagucgagcucaaguccggcuacaaagacuggauccuguggauuagcuuugcuaucucuugcuuccuucuguguguggcccuccugggguuuauuaugugggcgugccagaagggaaauauccgguguaacaucugcauuuga

SEQ ID NO: 193627 - RNA, 1701 nt, Artificial Sequence
  derived and/or modified sequence opt5 from hemagglutinin__InfluenzaA__AHC58050
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacuccagcuuuuucucucggcugaauuggcucacacaucugaacuuuaaguauccugcccuuaaugucaccaugcccaacaacgagcaguucgacaagcuguacauuuggggcgugcaccauccugggacggauaaagaccagaucuuucucuaugcgcaauccagcggacgcauuacaguuuccaccagacggucucagcaggccgugaucccgaauauuggcagccgccccagaauccggaacaucccuucccgcauuagcaucuacuggacaauugucaagcccggggauauccugcugauuaauucuaccggaaaccucaucgcuccuagaggcuacuucaaaauccgguccggaaagagcucuauuaugcgcagcgacgcccccaucgggaaauguaauuccgaaugcauuaccccgaacggcucuaucccuaaugacaagcccuuucagaacgugaauagaauuacauauggcgcuuguccucgguacgugaagcaaagcacgcugaaacuugccaccgggaugcgcaacguccccgagaagcagacaagaggaaucuucggcgcgaucgccggguuuauugaaaauggaugggagggcaugguugaugggugguauggauuccggcaccagaacuccgagggcagaggccaagcugccgaccugaaaagcacccaggcugccaucgaucagauuaaugggaagcucaaccgccugaucggaaaaacaaaugaaaaguuccaccagauugagaaagaauuuucugagguggaaggccggauccaagaccuugagaaguacguggaggauaccaagauugaccugugguccuauaacgccgaacuccuggucgcucuggagaaccagcauacgaucgaucucacagacagcgaaaugaauaaacuguucgagaagaccaaaaagcagcuuagagaaaacgcggaggauauggggaauggaugcuuuaaaaucuaccacaagugugacaacgccugcauuggcucuauccgcaaugggaccuauaaccaugauguguaccgggacgaggcucugaauaacagauuccagauuaagggcguugaacucaaauccggauacaaggacuggauccuguggauuagcuuugccaucuccugcuuccuucuguguguggcccuccugggcuuuaucaugugggcuugccaaaaagggaauauucgcuguaacaucugcauuuga

SEQ ID NO: 193628 - RNA, 1701 nt, Artificial Sequence; identical to SEQ ID NO: 190806
  derived and/or modified sequence opt5 from hemagglutinin__InfluenzaA__AHC58074

SEQ ID NO: 193629 - RNA, 1701 nt, Artificial Sequence; identical to SEQ ID NO: 190806
  derived and/or modified sequence opt5 from hemagglutinin__InfluenzaA__AHC58098

SEQ ID NO: 193630 - RNA, 1701 nt, Artificial Sequence; identical to SEQ ID NO: 190806
  derived and/or modified sequence opt5 from hemagglutinin__InfluenzaA__AHC58110

SEQ ID NO: 193631 - RNA, 1701 nt, Artificial Sequence; identical to SEQ ID NO: 190806
  derived and/or modified sequence opt5 from hemagglutinin__InfluenzaA__AHC58126

SEQ ID NO: 193632 - RNA, 1701 nt, Artificial Sequence; identical to SEQ ID NO: 190806
  derived and/or modified sequence opt5 from hemagglutinin__InfluenzaA__AHC58138

SEQ ID NO: 193633 - RNA, 1701 nt, Artificial Sequence; identical to SEQ ID NO: 190806
  derived and/or modified sequence opt5 from hemagglutinin__InfluenzaA__AHC58162

SEQ ID NO: 193634 - RNA, 1701 nt, Artificial Sequence; identical to SEQ ID NO: 192098
  derived and/or modified sequence opt5 from hemagglutinin__InfluenzaA__AHC58186

SEQ ID NO: 193635 - RNA, 1701 nt, Artificial Sequence
  derived and/or modified sequence opt5 from hemagglutinin__InfluenzaA__AHC58198
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagauccuugauggggaaaacuguacccugauugacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacgcuugaauuuaauaacgagagcuucaauuggaccggagugacacagaacggcaccucuuccgcuugcauccgcagaagcaauaacuccuuuuucucucggcugaauuggcucacacaucugaacuuuaaguauccugcccuuaacgucaccaugcccaauaacgagcaguucgacaagcuguacauuuggggcgugcaccauccugggacggauaaagaccagaucuuucucuaugcgcaagccagcggacgcauuacaguuucuaccaagagaucccagcaggcugugaucccgaauauuggcagccggccccgcgucagaaacaucccuucccggaucucuauuuacuggacaaucgugaaacccggggauauucugcugaucaauagcaccggaaaccucauugccccucgcggcuacuucaagaucagauccgggaaaagcucuaucaugcgguccgacgcucccauuggaaaguguaauagcgaaugcaucaccccgaacggcucuauuccuaaugacaagcccuuucagaacgugaaucgcaucacauauggcgccuguccuagauacgucaaacaaaacacgcugaaacuugcgaccgggaugcggaauguucccgagaagcagacacgcggaauuuucggcgccaucgcuggguuuaucgaaaacggaugggagggcaugguggaugggugguauggauucagacaccagaauagcgagggccggggccaagccgcugaccugaaguccacccaggccgccauugaucagaucaacgggaaacucaacagacugauuggaaagacaaaugaaaaauuccaccagaucgagaaggaauuuucugagguggaaggccgcauucaaaaccuugagaaguacgucgaggacaccaaaaucgaucuguggagcuauaaugcugaacuccugguggcgcuggagaaccagcauacgauugaccucacagauuccgaaaugaauaagcuguucgagaaaaccaagaaacagcuucgggaaaacgccgaggacauggggaauggaugcuuuaagaucuaccacaagugugauaacgcuugcaucggcagcauuagaaaugggaccuaugaccaugauguuuaccgcgacgaggcccugaacaaucgguuccagaucaaaggcguggaacucaagucuggauacaaagacuggauucuguggaucuccuuugccauuagcugcuuccuucugugugucgcucuccugggcuuuaucaugugggauugccaaaaggggaacaucagauguaauauuugcaucuga

SEQ ID NO: 193636 - RNA, 1701 nt, Artificial Sequence
  derived and/or modified sequence opt5 from hemagglutinin__InfluenzaA__AHC58210
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagauccuugauggggaaaacuguacccugauugacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacgcuugaauuuaauaacgagagcuucaauugggcuggagugacccagaacggcacaucuuccgccugcauccgcagaagcaauaacuccuuuuucucucggcugaauuggcucacccaucugaacuuuaaguauccugcgcuuaacgucacaaugcccaauaacgagcaguucgacaagcuguacauuuggggcgugcaccauccugggaccgauaaagaccagaucuuucucuaugcccaagcuagcggacgcauuacgguuucuacaaagagaucccagcaggccgugaucccgaauauuggcagccggccccgcgucagaaacaucccuucccggaucucuauuuacuggaccaucgugaaacccggggauauucugcugaucaauagcacaggaaaccucauugcuccucgcggcuacuucaagaucagauccgggaaaagcucuaucaugcgguccgacgcccccauuggaaaguguaauagcgaaugcaucaccccgaacggcucuauuccuaaugacaagcccuuucagaacgugaaucgcaucaccuauggcgcguguccuagauacgucaaacaaaacacacugaaacuugccacggggaugcggaauguucccgagaagcagacccgcggaauuuucggcgcuaucgccggguuuaucgaaaacggaugggagggcaugguggaugggugguauggauucagacaccagaauagcgagggccggggccaagcugccgaccugaaguccacacaggccgcuauugaucagaucaacgggaaacucaacagacugauuggaaagaccaaugaaaaauuccaccagaucgagaaggaauuuucugagguggaaggccgcauucaagaccuugagaaguacgucgaggauacaaaaaucgaccuguggagcuauaacgcggaacuccugguggcccuggagaaucagcauaccauugaucucacggacuccgaaaugaacaagcuguucgagaaaacaaagaaacagcuucgggaaaaugcugaggauauggggaacggaugcuuuaagaucuaccacaagugugacaaugccugcaucggcagcauuagaaacgggaccuaugaucaugacguuuaccgcgacgaggcccugaauaaccgguuccagaucaaaggcguggaacucaagucuggauacaaagauuggauucuguggaucuccuuugcuauuagcugcuuccuucugugugucgcccuccugggcuuuaucaugugggcgugccaaaaggggaauaucagauguaacauuugcaucuga

SEQ ID NO: 193637 - RNA, 1701 nt, Artificial Sequence; identical to SEQ ID NO: 190006
  derived and/or modified sequence opt5 from hemagglutinin__InfluenzaA__AHC58234

SEQ ID NO: 193638 - RNA, 1701 nt, Artificial Sequence; identical to SEQ ID NO: 190806
  derived and/or modified sequence opt5 from hemagglutinin__InfluenzaA__AHC58246

SEQ ID NO: 193639 - RNA, 1701 nt, Artificial Sequence; identical to SEQ ID NO: 190006
  derived and/or modified sequence opt5 from hemagglutinin__InfluenzaA__AHC58258

SEQ ID NO: 193640 - RNA, 1701 nt, Artificial Sequence; identical to SEQ ID NO: 189879
  derived and/or modified sequence opt5 from hemagglutinin__InfluenzaA__AHC58270

SEQ ID NO: 193641 - RNA, 1701 nt, Artificial Sequence
  derived and/or modified sequence opt5 from hemagglutinin__InfluenzaA__AHC58372
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacuccagcuuuuucucucggcugaauuggcucacacaucugaacuuuaaguauccugcccuuaaugucaccaugcccaacaacgagcaguucgacaagcuguacauuuggggcgugcaccauccugggacggauaaagaccagaucuuucucuaugcgcaauccagcggacgcauuacaguuuccaccaagagaucucagcaggccgugacaccgaauaucggcagccggccccgcauuagaaacaucccuucccggaucagcauuuacuggaccaucgucaaacccggggauauucugcugaucaauucuaccggaaaccucauugcuccucgcggcuacuucaagaucagauccgggaaaagcucuaucaugcggagcgacgcccccauuggaaaguguaauuccgaaugcaucacaccgaacggcucuauuccuaaugacaagcccuuucagaacgugaaucgcaucacguauggcgcuuguccuagauacgugaaacaaagcacccugaagcuggccacagggaugcggaacguccccgagaaacagacccgcggaauuuucggcgcgaucgccggguuuaucgaaaauggaugggagggcaugguugaugggugguauggauucagacaccagaacuccgagggccggggccaagcugccgaccuuaagagcacacaggcugccauugaucagaucaaugggaaacucaacagacugauuggaaagaccaaugaaaaauuccaccagaucgagaaggaauuuucugagguggaaggccgcauucaagaccuugagaaguacguggaggauacgaaaaucgaccugugguccuauaacgccgaacuccuggucgcucuggagaaccagcauacaauugaucucaccgacagcgaaaugaauaagcuguucgagaaaaccaagaaacagcuucgggaaaacgcggaggauauggggaauggaugcuuuaagaucuaccacaagugugacaacgccugcaucggcucuauuagaaaugggacauauaaccaugauguguaccgcgacgaggcucugaauaaccgguuccagaucaaaggcguugaacucaaguccggauacaaagacuggauucuguggaucagcuuugccauuuccugcuuccuucuguguguggcccuccugggcuuuaucaugugggcuugccaaaaggggaauaucagauguaacauuugcaucuga

SEQ ID NO: 193642 - RNA, 1701 nt, Artificial Sequence
  derived and/or modified sequence opt5 from hemagglutinin__InfluenzaA__AHC58396
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcggcucuaauaacuccuuuuucagcagacugaauuggcucacacaccugaacuuuaaguacccugcccuuaacgucaccaugcccaauaacgagcaguucgauaagcuguauauuuggggagugcaucacccugggacggacaaagaucagaucuuucucuacgcgcaagccucuggccggauuacaguuuccaccaagcgcagccagcaggcugugaucccgaauauuggguccagaccccggguccgcaacaucccuucuagagugagcaucuauuggacaauugugaaacccggagacauccugcugauuaauuccaccggcaaccucaucgccccucggggguacuucaagauucgcagcggaaaaucuuccaucaugagaagcgaugcucccaucggcaaguguaauucugccugcauuaccccgaacggcagcaucccuaaugacaagcccuuucagaacgucaaucggauuacauacggggcguguccucgcuauguuaaacaaaacacgcugaaacuugccaccggaaugagaaaugugcccgaaaaacagacacggggcaucuucggggcuauugccggauuuaucgagaacggcugggaagggaugguggacggaugguacggcuuccgccaccaaaauuccgagggcagagggcaggcugccgaucugaagucuacccaggccgcuaucgaccagauuaacggaaaacucaaccggcugaucggcaagacaaaugagaaauuccaucagauugaaaaggaguuuagcgaagucgaggggagaauccaagaucuugaaaaguauguggaggacaccaaaauugaucugugguccuacaacgcggagcuccugguugcccuggaaaaucagcacacgaucgaccucacagauagcgagaugaacaagcuguucgaaaagaccaagaaacagcuucgcgagaaugcugaagacaugggaaacggcugcuuuaagauuuaucauaagugugauaaugccugcaucgggucuauccggaacggcaccuacgaccacgauguguauagagacgaggcccugaauaaccgcuuccagauuaaaggagucgagcucaaguccggcuacaaagacuggauccuguggauuagcuuugcuaucucuugcuuccuucuguguguggcccuccugggguuuauuaugugggcgugccaaaagggaaauauccgguguaacaucugcauuuga

SEQ ID NO: 193643 - RNA, 1701 nt, Artificial Sequence; identical to SEQ ID NO: 190806
  derived and/or modified sequence opt5 from hemagglutinin__InfluenzaA__AHC58408

SEQ ID NO: 193644 - RNA, 1701 nt, Artificial Sequence; identical to SEQ ID NO: 192098
  derived and/or modified sequence opt5 from hemagglutinin__InfluenzaA__AHC58420

SEQ ID NO: 193645 - RNA, 1701 nt, Artificial Sequence; identical to SEQ ID NO: 192098
  derived and/or modified sequence opt5 from hemagglutinin__InfluenzaA__AHC58432

SEQ ID NO: 193646 - RNA, 1701 nt, Artificial Sequence; identical to SEQ ID NO: 190006
  derived and/or modified sequence opt5 from hemagglutinin__InfluenzaA__AHC58444

SEQ ID NO: 193647 - RNA, 1701 nt, Artificial Sequence; identical to SEQ ID NO: 193642
  derived and/or modified sequence opt5 from hemagglutinin__InfluenzaA__AHC58456

SEQ ID NO: 193648 - RNA, 1701 nt, Artificial Sequence
  derived and/or modified sequence opt5 from hemagglutinin__InfluenzaA__AHC58468
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaggaacugcgggagcagcuuuccagcgucucuuccuucgaacgcuuugagaucuuccccaagaccagcucuuggccuaaccacgacuccaauaagggagugacagccgcuuguccccaagccggcgcgaaaucuuuuuauaagaaccugaucuggcucguuaaaaagggcaauagcuacccuaaacuguccaagagcuauauuaacgauaaggggaaagaagugcuuguccuguggggaauccaucaccccuccaccucugccgaccagcagagccucuaccagaaugcugaugccuacguguucgugggcacauccaaguauagcaaaaaguuuaaaccugagauugcugucagaccgaagguucgggaccaagaggggcgcaugaacuacuauuggacccugguggaacccggagauaaaaucacguucgaggccacaggcaaccugcucgugccuagauacgcguuugccauggaacggaaugcugggucuggaauuaucauuuccgacacccccguccacgauugcaacacaaccugucagaccccuaagggcgccaucaauacaagccugcccuuccagaacauccauccgauuacgaucggcaagugcccuaaauaugugaagucuaccaaacuucgccuggcuacagggcucagaaauguucccagcauucagucccggggacuguuuggcgccaucgccggguucauugagggaggcuggaccgggaugguggacggaugguacggcuaucaccaucaaaacgcucagggcucuggguacgcggccgaccuuaagagcacacagaaugcuaucgauaaaaucaccaacaaggucaauuccgugauugaaaagaugaacacgcaguuuacagccguuggaaaagaguucaaucaccuggagcgcagaaucgaaaaccucaauaagaaaguggacgauggcuuccuggacauuuggaccuacaacgccgagcugcucguccugcuugaaaaugagcggacccuggauuaucacgacagcaacgugaagaaccucuacgaaaaaguccgcucucaacugaagaauaacgcuaaggagaucgggaauggauguuuugaguucuaucauaaaugcgauaacacauguauggaauccgugaagaauggcaccuacgacuauccuaaauacagcgaggaagccaaacuuaacagagaggaaauugaugggguuaagcuggagucuacacggaucuaucagauccucgcgauuuacuccacgguggcuagcucccugguccuggugguuucucucggcgccaucagcuuuuggaugugcuccaauggaucucugcagugccgcauuuguaucuga

SEQ ID NO: 193649 - RNA, 1701 nt, Artificial Sequence
  derived and/or modified sequence opt5 from hemagglutinin__InfluenzaA__AHC58479
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagaucauugauggggaaaacuguacccuuaucgacgcccugcucggagauccccagugcgacggcuuucagaauaaaaagugggaucuguucgucgagagaucuaaagccuauagcaacuguuacccuuaugacgugcccgauuacgcuucccugcggucucucguugccagcuccgggacgcuggaauuuaauaacgagagcuucaauuggaccggagugacacagaacggcaccucuuccgcuugcauucgcagaagcaauaacucuuucuucucccggcuuaauuggcugacacaucucaacuuuaaguauccugcccugaacgucaccaugcccaauaacgagcaguucgacaaacuuuacaucuggggcgugcaccauccugggacggauaaggaccagauuuuucuguaugcgcaagccagcggacgcaucacaguuucuaccaagagaucccagcaggcugugauuccgaauaucggcagccggccccgcgucagaaacaucccuucccggauuucuaucuacuggacaauugugaaacccggggauauccuccugauuaauagcaccggaaaccugaucgccccucgcggcuacuucaagaucagauccgggaaaagcucuauuaugcgguccgacgcucccaucggaaaguguaauagcgaaugcauuaccccgaacggcucuaucccuaaugacaagcccuuucagaacgugaaucgcauuacauauggcgccuguccuagauacgucaaacaaaacacgcucaagcuggcgaccgggaugcggaauguucccgagaaacagacacgcggaaucuucggcgccaucgcuggguuuauugaaaacggaugggagggcaugguggaugggugguauggauucagacaccagaauagcgagggccggggccaagccgcugaccuuaaguccacccaggccgccaucaaccagauuaacgggaaacugaauagacucaucggaaagacaaacgaaaaauuccaccagauugagaaggaauuuucugagguggaaggccgcauccaagaucuggagaaguacgucgaggacaccaaaauugaucuuuggagcuauaaugcugaacugcucguggcgcuggagaaccagcauacgaucgaccugacagauuccgaaaugaauaagcucuuugagaaaaccaagaaacagcugcgggaaaacgccgaggacauggggaauggaugcuuuaagaucuaccacaagugugauaacgcuugcauuggcagcaucagaaaugggaccuaugaccaugauguuuaccgcgacgaggcccuuaacaaucgguucaaaauuaagggcguggaacugaaaucuggauacaaggacuggauccucuggauuuccuuugccaucagcugcuuccugcuuugugucgcucugcucggcuuuaucaugugggccugccagaaagggaacauuagauguaauaucugcauuuga

SEQ ID NO: 193650 - RNA, 1701 nt, Artificial Sequence; identical to SEQ ID NO: 193642
  derived and/or modified sequence opt5 from hemagglutinin__InfluenzaA__AHC58491

SEQ ID NO: 193651 - RNA, 1701 nt, Artificial Sequence; identical to SEQ ID NO: 190006
  derived and/or modified sequence opt5 from hemagglutinin__InfluenzaA__AHC58515

SEQ ID NO: 193652 - RNA, 1701 nt, Artificial Sequence; identical to SEQ ID NO: 190806
  derived and/or modified sequence opt5 from hemagglutinin__InfluenzaA__AHC58527

SEQ ID NO: 193653 - RNA, 1701 nt, Artificial Sequence
  derived and/or modified sequence opt5 from hemagglutinin__InfluenzaA__AHC58563
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagaucauugauggggaaaacuguacccuuaucgacgcccugcucggagauccccagugcgacggcuuucagaauaaaaagugggaucuguucgucgagagaucuaaagccuauagcaacuguuacccuuaugacgugcccgauuacgcuucccugcggucucucguugccagcuccgggacgcuggaauuuaauaacgagagcuucaauuggaccggagugacacagaacggcaccucuuccgcuugcauucgcagaagcaauaacucuuucuucucccggcuuaauuggcugacacaucucaacuuuaaguauccugcccugaacgucaccaugcccaauaacgagcaguucgacaaacuuuacaucuggggcgugcaccauccugggacggauaaggaccagauuuuucuguaugcgcaagccagcggacgcaucacaguuucuaccaagagaucccagcaggcugugauuccgaauaucggcagccggccccgcgucagaaacaucccuucccggauuucuaucuacuggacaauugugaaacccggggauauccuccugauuaauagcaccggaaaccugaucgccccucgcggcuacuucaagaucagauccgggaaaagcucuauuaugcgguccgacgcucccaucggaaaguguaauagcgaaugcauuaccccgaacggcucuaucccuaaugacaagcccuuucagaacgugaaucgcauuacauauggcgccuguccuagauacgucaaacaaaacacgcucaagcuggcgaccgggaugcggaauguucccgagaaacagacacgcggaaucuucggcgccaucgcuggguuuauugaaaacggaugggagggcaugguggaugggugguauggauucagacaccagaauagcgagggccggggccaagccgcugaccuuaaguccacccaggccgccaucgaucagauuaacgggaaacugaacagacucaucggaaagacaaaugaaaaauuccaccagauugagaaggaauuuucugagguggaaggccgcauccaagaccuggagaaguacgucgaggauaccaaaauugaccuuuggagcuauaacgcugaacugcucguggcgcuggagaaucagcauacgaucgaucugacagacuccgaaaugaacaagcucuuugagaaaaccaagaaacagcugcgggaaaaugccgaggauauggggaacggaugcuuuaagaucuaccacaagugugacaaugcuugcauuggcagcaucagaaacgggaccuaugaucaugacguuuaccgcgacgaggcccuuaauaaccgguuccagauuaaaggcguggaacugaagucuggauacaaagauuggauccucuggauuuccuuugccaucagcugcuuccugcuuugugucgcucugcucggcuuuaucaugugggccugccaaaaggggaauauuagauguaacaucugcauuuga

SEQ ID NO: 193654 - RNA, 1701 nt, Artificial Sequence; identical to SEQ ID NO: 190806
  derived and/or modified sequence opt5 from hemagglutinin__InfluenzaA__AHC58575

SEQ ID NO: 193655 - RNA, 1701 nt, Artificial Sequence; identical to SEQ ID NO: 189879
  derived and/or modified sequence opt5 from hemagglutinin__InfluenzaA__AHC58587

SEQ ID NO: 193656 - RNA, 1701 nt, Artificial Sequence; identical to SEQ ID NO: 190006
  derived and/or modified sequence opt5 from hemagglutinin__InfluenzaA__AHC58599

SEQ ID NO: 193657 - RNA, 1701 nt, Artificial Sequence; identical to SEQ ID NO: 190806
  derived and/or modified sequence opt5 from hemagglutinin__InfluenzaA__AHC58611

SEQ ID NO: 193658 - RNA, 1701 nt, Artificial Sequence; identical to SEQ ID NO: 190806
  derived and/or modified sequence opt5 from hemagglutinin__InfluenzaA__AHC58623

SEQ ID NO: 193659 - RNA, 1701 nt, Artificial Sequence; identical to SEQ ID NO: 190806
  derived and/or modified sequence opt5 from hemagglutinin__InfluenzaA__AHC58647

SEQ ID NO: 193660 - RNA, 1701 nt, Artificial Sequence; identical to SEQ ID NO: 190006
  derived and/or modified sequence opt5 from hemagglutinin__InfluenzaA__AHC58659

SEQ ID NO: 193661 - RNA, 1701 nt, Artificial Sequence; identical to SEQ ID NO: 189879
  derived and/or modified sequence opt5 from hemagglutinin__InfluenzaA__AHC58671

SEQ ID NO: 193662 - RNA, 1701 nt, Artificial Sequence; identical to SEQ ID NO: 192098
  derived and/or modified sequence opt5 from hemagglutinin__InfluenzaA__AHC58683

SEQ ID NO: 193663 - RNA, 1701 nt, Artificial Sequence; identical to SEQ ID NO: 189879
  derived and/or modified sequence opt5 from hemagglutinin__InfluenzaA__AHC58695

SEQ ID NO: 193664 - RNA, 1701 nt, Artificial Sequence; identical to SEQ ID NO: 192098
  derived and/or modified sequence opt5 from hemagglutinin__InfluenzaA__AHC58707

SEQ ID NO: 193665 - RNA, 1701 nt, Artificial Sequence; identical to SEQ ID NO: 192098
  derived and/or modified sequence opt5 from hemagglutinin__InfluenzaA__AHC58719

SEQ ID NO: 193666 - RNA, 1701 nt, Artificial Sequence; identical to SEQ ID NO: 193642
  derived and/or modified sequence opt5 from hemagglutinin__InfluenzaA__AHC58731

SEQ ID NO: 193667 - RNA, 1701 nt, Artificial Sequence
  derived and/or modified sequence opt5 from hemagglutinin__InfluenzaA__AHC58743
augaagaccaucauugccuggagcuacauccugugccucguguucgcucagaaacugcccggcaacgacaauuccacagccacgcuuugucuggggcaccaugcggucccuaacggaaccauuguuaagacaaucaccaaugaucaaauugaggugacaaacgcuaccgaacucgugcaaaauucuagcacaggcgagaucugcgacuccccgcaccagauccuggauggggaaaacuguacccuuauugacgcccugcucggagauccccagugcgacggcuuucagaauaaaaagugggaucuguucgucgagagaucuaaagccuauagcaacuguuacccuuaugacgugcccgauuacgcuucccugcggucucucguugccagcuccgggacgcuggaauuuaauaacgagagcuucaauuggaccggagugacacagaacggcaccucuuccgcuugcauccgcagaagcaauaacucuuucuucucccggcuuaauuggcugacacaucucaacuuuaaguauccugcccugaacgucaccaugcccaauaacgagcaguucgacaaacuuuacauuuggggcgugcaccauccugggacggauaaggaccagaucuuucuguaugcgcaagccagcggacgcauuacaguuucuaccaagagaucccagcaggcugugaucccgaauauuggcagccggccccgcgucagaaacaucccuucccggaucucuauuuacuggacaaucgugaaacccggggauauucuccugaucaauagcaccggaaaccugauugccccucgcggcuacuucaagaucagauccgggaaaagcucuaucaugcgguccgacgcucccauuggaaaguguaauagcgaaugcaucaccccgaacggcucuauuccuaaugacaagcccuuucagaacgugaaucgcaucacauauggcgccuguccuagauacgucaaacaaaacacgcucaagcuggcgaccgggaugcggaauguucccgagaaacagacacgcggaauuuucggcgccaucgcuggguuuaucgaaaacggaugggagggcaugguggaugggugguauggauucagacaccagaauagcgagggccggggccaagccgcugaccuuaaguccacccaggccgccauugaucagaucaacgggaaacugaacagacucauuggaaagacaaaugaaaaauuccaccagaucgagaaggaauuuucugagguggaaggccgcauucaagaccuggagaaguacgucgaggauaccaaaaucgaccuuuggagcuauaacgcugaacugcucguggcgcuggagaaucagcauacgauugaucugacagacuccgaaaugaacaagcucuuugagaaaaccaagaaacagcugcgggaaaaugccgaggauauggggaacggaugcuuuaagaucuaccacaagugugacaaugcuugcaucggcagcauuagaaacgggaccuaugaucaugacguuuaccgcgacgaggcccuuaauaaccgguuccagaucaaaggcguggaacugaagucuggauacaaagauuggauucucuggaucuccuuugccauuagcugcuuccugcuuugugucgcucugcucggcuuuaucaugugggccugccaaaaggggaauaucagauguaacauuugcaucuga

SEQ ID NO: 193668 - RNA, 1701 nt, Artificial Sequence; identical to SEQ ID NO: 193642
  derived and/or modified sequence opt5 from hemagglutinin__InfluenzaA__AHC58755

SEQ ID NO: 193669 - RNA, 1701 nt, Artificial Sequence; identical to SEQ ID NO: 189879
  derived and/or modified sequence opt5 from hemagglutinin__InfluenzaA__AHC58779

SEQ ID NO: 193670 - RNA, 1701 nt, Artificial Sequence; identical to SEQ ID NO: 193641
  derived and/or modified sequence opt5 from hemagglutinin__InfluenzaA__AHC58791

SEQ ID NO: 193671 - RNA, 1701 nt, Artificial Sequence
  derived and/or modified sequence opt5 from hemagglutinin__InfluenzaA__AHC58803
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagaucauugauggggaaaacuguacccuuaucgacgcccugcucggagauccccagugcgacggcuuucagaauaaaaagugggaucuguucgucgagagaucuaaagccuauagcaacuguuacccuuaugacgugcccgauuacgcuucccugcggucucucguugccagcuccgggacgcuggaauuuaauaacgagagcuucaauuggaccggagugacacagaacggcaccucuuccgcuugcauucgcagaagcaauaacuccuuuuucucucggcuuaauuggcugacacaucucaacuuuaaguauccugcccugaacgucaccaugcccaauaacgagcaguucgacaaacuuuacaucuggggcgugcaccauccugggacggauaaggaccagauuuuucuguaugcgcaagccagcggacgcaucacaguuucuaccaagagaucccagcaggcugugauuccgaauaucggcagccggccccgcgucagaaacaucccuucccggauuucuaucuacuggacaauugugaaacccggggauauccuccugauuaauagcaccggaaaccugaucgccccucgcggcuacuucaagaucagauccgggaaaagcucuauuaugaaguccgacgcucccaucggaaaguguaauagcgaaugcauuaccccgaacggcucuaucccuaaugacaaacccuuucagaacgugaaucggauuacauauggcgccuguccucgcuacgucaagcaaaacacgcucaaacuggcgaccgggaugagaaauguucccgagaagcagacacggggaaucuucggcgccaucgcuggguuuauugaaaacggaugggagggcaugguggaugggugguauggauuccgccaccagaauagcgagggcagaggccaagccgcugaccuuaaauccacccaggccgccaucgaucagauuaacgggaagcugaaccggcucaucggaaaaacaaaugaaaaguuccaccagauugagaaggaauuuucugagguggaaggcagaauccaagaccuggagaaauacgucgaggauaccaagauugaccuuuggagcuauaacgcugaacugcucguggcgcuggagaaucagcauacgaucgaucugacagacuccgaaaugaacaaacucuucgagaagaccaaaaagcagcugcgcgaaaaugccgaggauauggggaacggaugcuuuaagaucuaccacaaaugugacaaugcuugcauuggcagcauccggaacgggaccuaugaucaugacguuuacagagacgaggcccuuaauaaccgcuucaagauuaaaggcguggaacugaagucuggauacaaagauuggauccucuggauuuccuuugccaucagcugcuuccugcuuugugucgcucugcucggcuuuaucaugugggccugccagaaggggaauauucgguguaacaucugcauuuga

SEQ ID NO: 193672 - RNA, 1701 nt, Artificial Sequence
  derived and/or modified sequence opt5 from hemagglutinin__InfluenzaA__AHC58815
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacgggggaaacuguacccugauugaugcccuccugggcgacccccagugcgauggguuucaaaauaaaaagugggaccuguucgucgaaagaagcaaagccuauuccaacuguuacccuuaugaugugcccgacuacgcuucucuccggagccugguugccuccagcggaacgcuugaguuuaauaacgaaucuuucaauuggaccggcgugacacagaacggcaccuccagcgcuugcauccgcagaucuaauaacuccuuuuucagccggcugaauuggcucacacaucugaacuuuaaguauccugcccuuaacgucaccaugcccaauaacgagcaguucgauaagcuguacauuuggggagugcaccauccugggacggacaaagaucagaucuuucucuaugcgcaagccucuggccgcauuacaguuuccaccaagagaagccagcaggcugugaucccgaauauugggucccggccccgcgucagaaacaucccuucucggaucagcauuuacuggacaaucgugaaacccggagacauucugcugaucaauuccaccggcaaccucauugccccucgcggguacuucaagaucagaagcggaaaaucuuccaucaugcggagcgaugcucccauuggcaaguguaauucugagugcaucaccccgaacggcagcauuccuaaugacaagcccuuucagaacgugaaucgcaucacauauggggccuguccuagauacgucaaacaaaacacgcugaaacuugcgaccggaaugcggaauguucccgaaaaacagacacgcggcauuuucggggccaucgcuggauuuaucgagaacggcugggaagggaugguggacggaugguauggcuucagacaccaaaauuccgagggccgggggcaggccgcugaucugaagucuacccaggccgccauugaccagaucaacggaaaacucaacagacugauuggcaagacaaaugagaaauuccaccagaucgaaaaggaguuuagcgaaguggaggggcgcauucaagaucuugaaaaguacgucgaggacaccaaaaucgaucugugguccuauaacgcugagcuccugguggcgcuggaaaaucagcauacgauugaccucacagauagcgagaugaacaagcuguucgaaaagaccaagaaacagcuucgggagaaugccgaagacaugggaaacggcugcuuuaagaucuaccacaagugugauaaugcuugcaucgggucuauuagaaacggcaccuaugaccauaauguuuaccgcgaugaggcccugaacaaucgguuccagaucaaaggaguggagcucaaguccggcuacaaagacuggauucuguggaucagcuuugccauuucuugcuuccuucugugugucgcucuccugggguuuaucaugugggccugccaaaagggaaacaucagauguaauauuugcaucuga

SEQ ID NO: 193673 - RNA, 1701 nt, Artificial Sequence; identical to SEQ ID NO: 189879
  derived and/or modified sequence opt5 from hemagglutinin__InfluenzaA__AHC58827

SEQ ID NO: 193674 - RNA, 1701 nt, Artificial Sequence; identical to SEQ ID NO: 190806
  derived and/or modified sequence opt5 from hemagglutinin__InfluenzaA__AHC58839

SEQ ID NO: 193675 - RNA, 1701 nt, Artificial Sequence
  derived and/or modified sequence opt5 from hemagglutinin__InfluenzaA__AHC58863
augaagaccaucauugcccugagcuacauccucugccugguguucgcucagaaacuucccggcaacgacaauuccacagccacgcugugucucgggcaccaugcggucucuaacggaaccauuguuaagacaaucaccaaugaucaaauugaggugacaaacgcuaccgaacuggugcagagcuccucuacaggcgagaucugcaauagcccucaccagauccuugacggggaaaacuguacccugauugaugcccuccugggagacccgcagugcgauggcuuucaaaauaaaaagugggaccuguucgucgagagauccaaagcccauucuaacuguuaucccuacgaugugccugacuaugcuagccuccggucccugguugccagcucugggacgcuugaauuuaauaacgaguccuucaauuggaccggagugacacagaacggcaccagcucugcuugcauccgcggcuccaauaacagcuuuuucucuagacugaauuggcucacacaccugaacuuuaaguaccccgcccuuaacgucaccaugccuaauaacgagcaguucgauaagcuguauauuuggggagugcaucaccccgggacggacaaagaucagaucuuucucuacgcgcaagccuccggccggauuacaguuagcaccaagcgcucccagcaggcugugaucccuaauauugggucuagaccgcggguccgcaacauccccagcagaguguccaucuauuggacaauugugaaaccuggagacauccugcugauuaauagcaccggcaaccucaucgcuccccggggguacuucaagauucgcucuggaaaauccagcaucaugagaucugaugccccuaucggcaaguguaauagcgccugcauuacccccaacggcuccaucccgaaugacaagccuuuucagaacgucaaucggauuacauacggggcguguccccgcuauguuaaacaaaacacgcugaaacuugccaccggaaugagaaaugugccugaaaaacagacacggggcaucuucggggcuauugccggauuuaucgagaacggcugggaagggaugauggacggaugguacggcuuccgccaccagaauagcgagggcagagggcaagcugccgaucugaagucuacccaggccgcuaucgaccagauuaacggaaaacucaaccggcugaucggcaagacaaaugagaaauuccaucagauugaaaaggaguuuuccgaaguggaggggagaauccaagaucuugaaaaguaugucgaggacaccaaaauugaucuguggagcuacaacgcggagcuccugguggcccuggaaaaucagcacacgaucgaccucacagauucugagaugaacaagcuguucgaaaagaccaagaaacagcuucgcgagaaugcugaagacaugggaaacggcugcuuuaagauuuaucauaagugugauaaugccugcaucggguccauccggaacggcaccuacgaccacgauguuuauagagacgaggcccugaauaaccgcuuccagauuaaaggaguggagcucaagagcggcuacaaagacuggauccuguggauuucuuuugcuaucuccugcuuccuucugugugucgcccuccugggguuuauuaugugggcgugccaaaagggaaauauccgguguaacaucugcauuuga

SEQ ID NO: 193676 - RNA, 1701 nt, Artificial Sequence; identical to SEQ ID NO: 189879
  derived and/or modified sequence opt5 from hemagglutinin__InfluenzaA__AHC58875

SEQ ID NO: 193677 - RNA, 1701 nt, Artificial Sequence; identical to SEQ ID NO: 190806
  derived and/or modified sequence opt5 from hemagglutinin__InfluenzaA__AHC58887

SEQ ID NO: 193678 - RNA, 1701 nt, Artificial Sequence; identical to SEQ ID NO: 193642
  derived and/or modified sequence opt5 from hemagglutinin__InfluenzaA__AHC58899

SEQ ID NO: 193679 - RNA, 1701 nt, Artificial Sequence; identical to SEQ ID NO: 190806
  derived and/or modified sequence opt5 from hemagglutinin__InfluenzaA__AHC58981

SEQ ID NO: 193680 - RNA, 1701 nt, Artificial Sequence; identical to SEQ ID NO: 190806
  derived and/or modified sequence opt5 from hemagglutinin__InfluenzaA__AHC58993

SEQ ID NO: 193681 - RNA, 1701 nt, Artificial Sequence; identical to SEQ ID NO: 190806
  derived and/or modified sequence opt5 from hemagglutinin__InfluenzaA__AHC59005

SEQ ID NO: 193682 - RNA, 1701 nt, Artificial Sequence
  derived and/or modified sequence opt5 from hemagglutinin__InfluenzaA__AHC59017
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcggcucuaauaacuccuuuuucagcagacugaauuggcucacacaccugaacuuuaaguacccugcccuuaacgucaccaugcccaauaacgagcaguucgauaagcuguauauuuggggagugcaucacccugggacggacaaagaucagaucuuucucuacgcgcaagccucuggccggauuacaguuuccaccaagcgcagccagcaggcugugaucccgaauauuggguccagaccccggguccgcaacaucccuucuagagugagcaucuauuggacaauugugaaacccggagacauccugcugauuaauuccaccggcaaccucaucgccccucggggguacuucaagauucgcagcggaaaaucuuccaucaugagaagcgaugcucccaucggcaaguguaauucugccugcauuaccccgaacggcagcaucccuaaugacaagcccuuucagaacgucaaucggauuacauacggggcguguccucgcuauguuaaacaaaacacgcugaaacuugccaccggaaugagaaaugugcccgaaaaacagacacggggcaucuucggggcuauugccggauuuaucgagaacggcugggaagggaugguggacggaugguacggcuuccgccaccaaaauuccgagggcagagggcaggcugccgaucugaagucuacccaggccgcuaucgaccagauuaacggaaaacucaaccggcugaucggcaagacaaaugagaaauuccaucagauugaaaaggaguuuagcgaagucgaggggagaauccaagaucuugaaaaguauguggaggacaccaaaauugaucugugguccuacaacgcggagcuccugguugcccuggaaaaucagcacacgaucgaccucacagauagcgagaugucuaagcuguucgaaaagaccaagaaacagcuucgcgagaacgcugaagacaugggaaauggcugcuuuaagauuuaucauaagugugauaacgccugcaucggguccauccggaauggcaccuacgaccacgauguguauagagacgaggcccugaacaaucgcuuccagauuaaaggagucgagcucaagagcggcuacaaagacuggauccuguggauuucuuuugcuaucuccugcuuccuucuguguguggcccuccugggguuuauuaugugggcgugccaaaagggaaacauccgguguaauaucugcauuuga

SEQ ID NO: 193683 - RNA, 1701 nt, Artificial Sequence; identical to SEQ ID NO: 193642
  derived and/or modified sequence opt5 from hemagglutinin__InfluenzaA__AHC59029

SEQ ID NO: 193684 - RNA, 1701 nt, Artificial Sequence; identical to SEQ ID NO: 190006
  derived and/or modified sequence opt5 from hemagglutinin__InfluenzaA__AHC59041

SEQ ID NO: 193685 - RNA, 1701 nt, Artificial Sequence
  derived and/or modified sequence opt5 from hemagglutinin__InfluenzaA__AHC59053
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccgcuggacgcauuacaguuucuaccaagagaucccagcaggccgugaucccgaauauuggcagccggccccgcgucagaaacaucccuucccgggugucuaucuauuggacaauugugaaacccggggacauccugcugauuaauagcaccggaaaccucaucgcuccucgcggcuacuucaagauucaguccgggaaaagcucuaucaugagauccgaugcccccaucggaaaguguaauagcgcgugcauuaccccgaacggcucuaucccuaaugacaagcccuuucaaaacgucaaucggauuacauacggcgccuguccucgcuauguuaaacagaacacgcugaaacuugcuaccgggaugagaaaugugcccgaaaaacagacacggggaaucuucggcgccauugcuggguuuaucgagaacggaugggaaggcaugguggacgggugguacggauuccgccaccaaaauagcgagggcagaggccaggccgccgaucugaaguccacccaggcugcgaucgaccagauuaacgggaaacucaaccggcugaucggaaagacaaaugagaaauuccaucaaauugaaaaggaguuuucugaagucgagggcagaauccaggaucuugaaaaguauguggaggacaccaaaauugaucuguggagcuacaacgccgagcuccugguugcucuggaaaaucagcacacgaucgaccucacagauuccgagaugaacaagcuguucgaaaagaccaagaaacagcuucgcgagaaugccgaagacauggggaacggaugcuuuaagauuuaucauaagugugauaaugccugcaucggcagcauccggaacgggaccuacgaccacgauguguauagagacgaggcucugaauaaccgcuuccaaauuaaaggcgucgagcucaagucuggauacaaagacuggauccuguggauuuccuuugccaucagcugcuuccuucuguguguggcgcuccugggcuuuauuauguggacaugccagaaggggaauauccgguguaacaucugcauuuga

SEQ ID NO: 193686 - RNA, 1701 nt, Artificial Sequence
  derived and/or modified sequence opt5 from hemagglutinin__InfluenzaA__AHC59077
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagauccuugauggggaaaacuguacccugauugacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacgcuugaauuuaauaacgagagcuucaauuggaccggagugacacagaacggcaccucuuccgcuugcauccgcagaagcaauaacuccuuuuucucucggcugaauuggcucacacaucugaacuuuaaguauccugcccuuaacgucaccaugcccaauaacgagcaguucgacaagcuguacauuuggggcgugcaccauccugggacggauaaagaccagaucuuucucuaugcgcaagccagcggacgcauuacaguuucuaccaagagaucccagcaggcugugaucccgaauauuggcagccggccccgcgucagaaacaucccuucccggaucucuauuuacuggacaaucgugaaacccggggauauucugcugaucaauagcaccggaaaccucauugccccucgcggcuacuucaagaucagauccgggaaaagcucuaucaugcgguccgacgcucccauuggaaaguguaauagcgaaugcaucaccccgaacggcucuauuccuaaugacaagcccuuucagaacgugaaucgcaucacauauggcgccuguccuagauacgucaaacaaaacacgcugaaacuugcgaccgggaugcggaauguucccgagaagcagacacgcggaauuuucggcgccaucgcuggguuuaucgaaaacggaugggagggcaugguggaugggugguauggauucagacaccagaauagcgagggccggggccaagccgcugaccugaaguccacccaggccgccauugaucagaucaacgggaaacucaacagacugauuggaaagacaaaugaaaaauuccaccagaucgagaaggaauuuucugagguggaaggccgcauucaagaccuugagaaguacgucgaggauaccaaaaucgaccuguggagcuauaacgcugaacuccugguggcgcuggagaaucagcauacgauugaucucacagacuccgaaaugaacaagcuguucgagaaaaccaagaaacagcuucgggaaaaugccgaggauauggggaacggaugcuuuaagaucuaccacaagugugacaaugcuugcaucggcagcauuagaaacgggaccuaugaucaugacguuuaccgcgacgaggcccugaauaaccgguuccagaucaaaggcguggaacucaagucuggauacaaagauuggauucuguggaucuccuuugccauuagcugcuuccuucugugugucgugcuccugggcuuuaucaugugggcuugccaaaaggggaauaucagauguaacauuugcaucuga

SEQ ID NO: 193687 - RNA, 1701 nt, Artificial Sequence; identical to SEQ ID NO: 192098
  derived and/or modified sequence opt5 from hemagglutinin__InfluenzaA__AHC59089

SEQ ID NO: 193688 - RNA, 1701 nt, Artificial Sequence; identical to SEQ ID NO: 190806
  derived and/or modified sequence opt5 from hemagglutinin__InfluenzaA__AHC59101

SEQ ID NO: 193689 - RNA, 1701 nt, Artificial Sequence; identical to SEQ ID NO: 190006
  derived and/or modified sequence opt5 from hemagglutinin__InfluenzaA__AHC59113

SEQ ID NO: 193690 - RNA, 1701 nt, Artificial Sequence; identical to SEQ ID NO: 190806
  derived and/or modified sequence opt5 from hemagglutinin__InfluenzaA__AHC59125

SEQ ID NO: 193691 - RNA, 1701 nt, Artificial Sequence
  derived and/or modified sequence opt5 from hemagglutinin__InfluenzaA__AHC59137
augaagaccaucauugcccugagcuacauccucugccugguguucgcucagaaaauucccggcaacgacaauuccacagccacgcuuugucuggggcaccaugcggucucuaacggaaccaucguuaagacaauuaccaaugaucaaaucgaggugacaaacgcuaccgaacucgugcagagcuccucuacaggcgagaucugcaauagcccucaccagauucuggacggggaaaacuguacccuuaucgaugcccugcucggagacccgcagugcgauggcuuucaaaauaaaaagugggaccuguucgucgagagauccaaagcccauucuaacuguuaucccuacgaugugccugacuaugcuagccugcggucccucguugccagcucugggacgcuggaauuuaauaacgaguccuucaauuggaccggagugacacagaacggcaccagcucugcuugcauucgcggcuccaauaacagcuuuuucucuagacuuaauuggcugacacaccucaacuuuaaguaccccgcccugaacgucaccaugccuaauaacgagcaguucgauaagcuguauaucuggggagugcaucaccccgggacggacaaagaucagauuuuucuguacgcgcaagccuccggccggaucacaguuagcaccaagcgcucccagcaggcugugauuccuaauaucgggucuagaccgcggguccgcaacauccccagcagaguguccauuuauuggacaaucgugaaaccuggagacauucuccugaucaauagcaccggcaaccugauugcccccagaggguacuucaagauccgcucuggaaaauccagcaucaugagaucugaugcuccuauuggcaaguguaauagcgccugcaucacccccaacggcuccauuccgaaugacaagccuuuucagaacgucaaucggaucacauacggggcguguccccgcuauguuaaacaaaacacgcucaagcuggccaccggaaugagaaaugugccugaaaaacagacacggggcauuuucggggcuaucgccggauuuaucgagaacggcugggaagggaugauggacggaugguacggcuuccgccaccaaaauucugagggcagagggcaggcugccgaucuuaagagcacccaggccgcuauugaccagaucaacggaaaacugaaccggcucauuggcaagacaaaugagaaauuccaucagaucgaaaaggaguuuuccgaaguggaggggcggauucaagaucuggaaaaguaugucgaggacaccaaaaucgaucuuuggagcuacaacgcggagcugcucguggcccuggaaaaucagcacacgauugaccugacagauucugagaugaacaaacucuucgaaaagaccaagaaacagcugcgcgagaaugcugaagacaugggaaacggcugcuuuaagaucuaucauaagugugauaaugccugcaucggguccauucggaacggcaccuacgaccacgauguuuauagagacgaggcccuuaauaaccgcuuccagaucaaaggaguggagcuuaagagcggcuacaaagacuggauucucuggaucucuuuugcuauuuccugcuuccugcuuugugucgcccugcucggguuuaucaugugggcgugccaaaagggaaauauccgguguaacauuugcaucuga

SEQ ID NO: 193692 - RNA, 1701 nt, Artificial Sequence; identical to SEQ ID NO: 190006
  derived and/or modified sequence opt5 from hemagglutinin__InfluenzaA__AHC59149

SEQ ID NO: 193693 - RNA, 1701 nt, Artificial Sequence
  derived and/or modified sequence opt5 from hemagglutinin__InfluenzaA__AHC59185
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacuccagcuuuuucucucggcugaauuggcucacacaucugaacuuuaaguauccugcccuuaaugucaccaugcccaacaacgagcaguucgacaagcuguacauuuggggcgugcaccauccugggacggauaaagaccagaucuuucucuaugcgcaauccagcggacgcauuacaguuuccaccaagagaucucagcaggccgugaucccgaauauuggcagccggccccgcaucagaaacaucccuucccggauuagcaucuacuggacaauugucaaacccggggauauccugcugauuaauucuaccggaaaccucaucgcuccucgcggcuacuucaagaucagauccgggaaaagcucuauuaugcggagcgacgcccccaucggaaaguguaauuccgaaugcauuaccccgaacggcucuaucccuaaugacaagcccuuucagaacgugaaucgcauuacauauggcgcuuguccuagauacgugaaacaaagcacgcugaagcuggccaccgggaugcggaacguccccgagaaacagacacgcggaaucuucggcgcgaucgccggguuuauugaaaauggaugggagggcaugguugaugggugguauggauucagacaccagaacuccgagggccggggccaagcugccgaccuuaagagcacccaggcugccaucgaucagauuaaugggaaacucaacagacugaucggaaagacaaaugaaaaauuccaccagauugagaaggaauuuucugagguggaaggccgcauccaagaccuugagaaguacguggaggauaccaaaauugaccugugguccuauaacgccgaacuccuggucgcucuggagaaccagcauacgaucgaucucacagacagcgaaaugaauaagcuguucgagaaaaccaagaaacagcuucgggaaaacgcggaggauauggggaauggaugcuuuaagaucuaccacaagugugacaacgccugcauuggcucuaucagaaaugggaccuaugaucauaacguguaccgcgacgaggcucugaauaaccgguuccagauuaaaggcguugaacucaaguccggauacaaagacuggauccuguggauuagcuuugccaucuccugcuuccuucuguguguggcccuccugggcuuuaucaugugggcuugccaaaaggggaauauuagauguaacaucugcauuuga

SEQ ID NO: 193694 - RNA, 1701 nt, Artificial Sequence; identical to SEQ ID NO: 189879
  derived and/or modified sequence opt5 from hemagglutinin__InfluenzaA__AHC59197

SEQ ID NO: 193695 - RNA, 1701 nt, Artificial Sequence
  derived and/or modified sequence opt5 from hemagglutinin__InfluenzaA__AHC59209
augaagaccaucauugcccugagcuacauccucugccugguguucgcucaggagauucccggcaacgacaauuccacagccacgcuuugucuggggcaccaugcggucccuaacggaaccaucguuaaaacaauuaccaaugaucaaaucgaagugacaaacgcuaccgagcucgugcagucuagcuccacaggcgaaaucugcaauucuccgcaccagauucuggacggggagaacuguacccuuaucgaugcccugcucggagacccccagugcgaugacuuucaaaauaagaaaugggaucuguucgucgaaagaagcaaggcccauuccaacuguuauccuuacgacgugcccgauuaugcuucucugcggagccucguugccuccagcggcacgcuggaguuuaauaacgagucuuucaauuggaccggggugacacagaacggaaccuccagcgcuugcauucgcagaucuaauaacuccuuuuucagccggcuuaauuggcugacacaccucaacuuuaaauacccugcccugaacgucaccaugcccaauaacgaacaguucgacaaacuuuauaucuggggcgugcaucacccuggcacggauaaggaccagauuuuucuguacgcgcaagccucugggcgcaucacaguuuccaccaaaagaagccagcaggcugugauuccgaauaucggaucccggccccgcgucagaaacaucccuucucgggugagcauuuauuggacaaucgugaagcccggcgauauucuccugaucaauuccaccgggaaccugauugccccucgcggauacuucaaaaucagaagcggcaagucuuccaucaugcggagcgacgcucccauuggggaguguaauucugccugcaucaccccgaacggaagcauuccuaaugacaaacccuuucagaacgucaaucgcaucacauacggcgcguguccuagauauguuaagcaaaacacgcucaagcuggccaccggcaugcggaaugugcccgaaaaacagacacgcgggauuuucggagcuaucgccggcuuuaucgagaacgggugggagggaaugguggauggcugguacggguucagacaccaaaauuccgaaggacggggccaggcugccgaccuuaagucuacccaggccgcuauugaucagaucaacggcaaacugaacagacucauugggaagacaaaugagaaauuccaucagaucgaaaaggaguuuagcgaagucgagggacgcauucaagaccuggagaaauauguggaagauaccaagaucgaccuuugguccuacaacgcggagcugcucguugcccuggaaaaucagcacacgauugaucugacagacagcgagaugaacaaacucuucgaaaagaccaagaagcagcugcgggagaaugcugaggauaugggcaacgggugcuuuaagaucuaucauaaaugugacaaugccugcaucggaucuauuagaaacggcaccuacgaucacgccguguaucgcgacgaagcucuuaauaaccgguuccagaucaagggggucgagcugaaguccggcuacaaagacuggauucucuggaucagcuuugccauuucuugcuuccugcuuuguguggcgcugcucggauuuaucaugugggcuugccaaaagggcaauaucagauguaacauuugcaucuga

SEQ ID NO: 193696 - RNA, 1701 nt, Artificial Sequence; identical to SEQ ID NO: 190006
  derived and/or modified sequence opt5 from hemagglutinin__InfluenzaA__AHC59221

SEQ ID NO: 193697 - RNA, 1701 nt, Artificial Sequence; identical to SEQ ID NO: 193675
  derived and/or modified sequence opt5 from hemagglutinin__InfluenzaA__AHC59245

SEQ ID NO: 193698 - RNA, 1701 nt, Artificial Sequence; identical to SEQ ID NO: 193642
  derived and/or modified sequence opt5 from hemagglutinin__InfluenzaA__AHC59257

SEQ ID NO: 193699 - RNA, 1701 nt, Artificial Sequence; identical to SEQ ID NO: 190806
  derived and/or modified sequence opt5 from hemagglutinin__InfluenzaA__AHC59269

SEQ ID NO: 193700 - RNA, 1701 nt, Artificial Sequence; identical to SEQ ID NO: 193642
  derived and/or modified sequence opt5 from hemagglutinin__InfluenzaA__AHC59281

SEQ ID NO: 193701 - RNA, 1701 nt, Artificial Sequence; identical to SEQ ID NO: 190006
  derived and/or modified sequence opt5 from hemagglutinin__InfluenzaA__AHC59293

SEQ ID NO: 193702 - RNA, 1701 nt, Artificial Sequence
  derived and/or modified sequence opt5 from hemagglutinin__InfluenzaA__AHC59305
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcucuagcccgcaccagauccuugacggggaaaauuguacccugauugaugcccuccugggagacccccagugcgauggcuuucaaaacaaaaagugggaccuguucgucgagagauccaaagcccauucuaauuguuauccuuacgaugugcccgacuaugcuagccuccggucccugguugccagcucugggacgcuugaauuuaacaaugaguccuucaacuggaccggagugacacagaauggcaccagcucugcuugcauccgcagauccaacaauagcuuuuucucucggcugaacuggcucacacaccugaauuuuaaguacccugcccuuaacgucaccaugcccaacaaugagcaguucgauaagcuguauauuuggggcgugcaucacccugggacggacaaagaucagaucuuucucuacgcgcaagccuccggacgcauuacaguuagcaccaagagaucccagcaggcugugaucccgaacauuggcucucggccccgcgucagaaauaucccuagccggguguccaucuauuggacaauugugaaacccggggacauccugcugauuaacagcaccggaaaucucaucgccccucgcggcuacuucaagauuagaucugggaaauccagcaucaugcggucugaugcucccaucggaaaguguaacagcgccugcauuaccccgaauggcuccaucccuaacgacaagcccuuucagaaugucaaccgcauuacauacggcgcguguccuagauauguuaaacaaaauacgcugaaacuugccaccgggaugcggaacgugcccgaaaaacagacacgcggaaucuucggcgcuauugccggguuuaucgagaauggaugggaaggcaugguggacgggugguacggauucagacaccagaacucugagggccggggccaagcugccgaucucaagagcacccaggccgcuaucgaccagauuaaugggaaacugaacagacugaucggaaagacaaacgagaaauuccaucagauugaaaaggaguuuuccgaagucgagggccgcauccaagaucuugaaaaguauguggaggacaccaaaauugaucuguggagcuacaaugcggagcuccugguugcccuggaaaaccagcacacgaucgaccucacagauucugagaugaauaagcuguucgaaaagaccaagaaacagcuucgggagaacgcugaagacauggggaauggaugcuuuaagauuuaucauaagugugauaacgccugcaucggcuccaucagaaaugggaccuacgaccacgauguguaucgcgacgaggcccugaacaaucgguuccagauuaaaggcgucgagcucaagagcggauacaaagacuggauccuguggauuucuuuugcuaucuccugcuuccuucuguguguggcccuccugggcuuuauuaugugggcgugccaaaaggggaacaucagauguaauaucugcauuuga

SEQ ID NO: 193703 - RNA, 1701 nt, Artificial Sequence
  derived and/or modified sequence opt5 from hemagglutinin__InfluenzaA__AHC59329
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauaacuccuuuuucucucgccugaauuggcucacccaucugaacuuuaaguauccugcccuuaacgucacaaugcccaauaacgagcaguucgacaagcuguacaucuggggcgugcaccauccugggaccgaaaaagaucagauuuuucucuaugcgcagagcucuggaagaaucacgguuuccacaaagcggagccaacaggccgugauuccgaauaucggcucccgccccagaauccggaacauuccuucucgcaucagcauuuacuggaccaucgucaaacccggggacauucugcugaucaauuccacaggaaaccucaucgcuccuagaggcuacuucaagauucggagcgggaaaucuuccaucaugcgcagcgaugcccccauuggaaaguguaagucugagugcaucaccccgaauggcagcauuccuaacgacaaacccuuucagaaugugaacagaaucaccuauggcgcuuguccucgguacgugaagcaguccacacugaaacuugccacggggaugcgcaauguccccgaaaagcaaaccagaggaaucuucggcgcgauugccggguuuaucgagaacggaugggagggcaugguugacgggugguauggauuccggcaccaaaauucugaaggcagaggccaggcugccgaucugaaaagcacacaggcugccauugaccagaucaacgggaagcucaaucgccugauuggaaaaaccaacgagaaguuccaccagaucgaaaaggaguuuuccgaaguggagggccggauucaggaucuugagaaauacguggaagacacaaagaucgaucuguggagcuauaacgccgagcuccuggucgcucuggaaaaucaacauaccaucgaccucacggauucugagaugaacaaacuguucgaaaagaccaaaaagcagcuuagagagaaugcggaggacauggggaacggaugcuuuaagauuuaccacaaaugugauaaugccugcaucggcuccauucgcaacgggacauaugaccaugauguguaccgggacgaagcucugaauaacagauuccagaucaagggcguugagcucaaaagcggauacaaggacuggauucuguggaucucuuuugccaucuccugcuuccuucuguguguggcccuccugggcuuuauuaugugggcuugccagaaagggaauauccgcuguaacauuugcaucuga

SEQ ID NO: 193704 - RNA, 1701 nt, Artificial Sequence; identical to SEQ ID NO: 192098
  derived and/or modified sequence opt5 from hemagglutinin__InfluenzaA__AHC59341

SEQ ID NO: 193705 - RNA, 1701 nt, Artificial Sequence; identical to SEQ ID NO: 193642
  derived and/or modified sequence opt5 from hemagglutinin__InfluenzaA__AHC59365

SEQ ID NO: 193706 - RNA, 1701 nt, Artificial Sequence
  derived and/or modified sequence opt5 from hemagglutinin__InfluenzaA__AHC59377
augaagaccaucauugcccugagcuacauccucugccugguguucgcucagaaacuucccggcaacgacaauuccacagccacgcugugucucgggcaccaugcggucccuaacggaaccguugugaagacaauuaccaaugaucaaaucgaggugacaaacgcuaccgaacugguccaaaauucuagcacaggcgagauuugcgacuccccgcaccagauccuugauggggaaaacuguacccugaucgacgcccuccugggagauccccagugcgacggcuuucagaauaaaaagugggaucuguucguggagagaucuaaagccuauagcaacuguuacccuuaugacguucccgauuacgcuucccuccggucucugguggccagcuccgggacgcuugaauuuaauaacgagagcuucaauuggaccggagucacacagaacggcaccucuuccgcuugcauucgcagaagcaauaacuccuuuuucucucggcugaauuggcucacacaucugaacuuuaaguauccugcccuuaacgugaccaugcccaauaacgagcaguucgacaagcuguacaucuggggcguucaccauccugggacggauaaagaccagauuuuucucuaugcgcaagccagcggacgcaucacagugucuaccaagagaucccagcaggcugucauuccgaauaucggcagccggccccgcgugagaaacauuccuucccggaucucuaucuacuggacaauugugaaacccggggauauccugcugauuaauagcaccggaaaccucaucgccccucgcggcuacuucaagauuagauccgggaaaagcucuaucaugcgguccgacgcucccaucggaaaguguaauagcgaaugcauuaccccgaacggcucuaucccuaaugacaagcccuuucagaacgucaaucgcauuacauauggcgccuguccuagauacguuaaacaaaacacgcugaaacuugcgaccgggaugcggaaugugcccgagaagcagacacgcggaaucuucggcgccauugcuggguuuaucgaaaacggaugggagggcaugguggaugggugguauggauucagacaccagaauagcgagggccggggccaagccgcugaccugaaguccacccaggccgccaucgaucagauuaacgggaaacucaacagacugaucggaaagacaaaugaaaaauuccaccagauugagaaggaauuuucugaggucgaaggccgcauccaaaaccuugagaaguacguggaggacaccaaaauugaucuguggagcuauaaugcugaacuccugguugcgcuggagaaccagcauacgaucgaccucacagauuccgaaaugaauaagcuguucgagaaaaccaagaaacagcuucgggaaaacgccgaggacauggggaauggaugcuuuaagauuuaccacaagugugauaacgcuugcaucggcagcaucagaaaugggaccuaugaccaugauguguaccgcgacgaggcccugaacaaucgguuccagauuaaaggcgucgaacucaagucuggauacaaagacuggauccuguggauuuccuuugccaucagcugcuuccuucuguguguggcucuccugggcuuuauuaugugggccugccaaaaggggaacaucagauguaauaucugcauuuga

SEQ ID NO: 193707 - RNA, 1701 nt, Artificial Sequence; identical to SEQ ID NO: 190006
  derived and/or modified sequence opt5 from hemagglutinin__InfluenzaA__AHC59413

SEQ ID NO: 193708 - RNA, 1701 nt, Artificial Sequence; identical to SEQ ID NO: 190806
  derived and/or modified sequence opt5 from hemagglutinin__InfluenzaA__AHC59425

SEQ ID NO: 193709 - RNA, 1701 nt, Artificial Sequence; identical to SEQ ID NO: 192098
  derived and/or modified sequence opt5 from hemagglutinin__InfluenzaA__AHC59437

SEQ ID NO: 193710 - RNA, 1701 nt, Artificial Sequence
  derived and/or modified sequence opt5 from hemagglutinin__InfluenzaA__AHC59449
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcggcucuaauaacuccuuuuucagcagacugaauuggcucacacaccugaacuuuaaguacccugcccuuaacgucaccaugcccaauaacgagcaguucgauaagcuguauauuuggggagugcaucacccugggacggacaaagaucagaucuuucucuacgcgcaagccucuggccggauuacaguuuccaccaagcgcagccagcaggcugugaucccgaauauuggguccagaccccggguccgcaacaucccuucuagagugagcaucuauuggacaauugugaaacccggagacauccugcugauuaauuccaccggcaaccucaucgccccucggggguacuucaagauucgcagcggaaaaucuuccaucaugagaagcgaugcucccaucggcaaguguaauucugccugcauuaccccgaacggcagcaucccuaaugacaagcccuuucagaacgucaaucggauuacauacggggcguguccucgcuauguuaaacaaaacacgcugaaacuugccaccggaaugagaaaugugcccgaaaagcagacacggggcaucuucggggcuauugccggauuuaucgagaacggcugggaagggaugguggacggaugguacggcuuccgccaccaaaauuccgagggcagagggcaggcugccgaucugaagucuacccaggccgcuaucgaccagauuaacggaaaacucaaccggcugaucggcagaacaaaugagaaguuccaucagauugaaaaagaguuuagcgaagucgaggggcgcauccaagaucuugaaaaguauguggaggacaccaagauugaucugugguccuacaacgcggagcuccugguugcccuggaaaaucagcacacgaucgaccucacagauagcgagaugaacaaacuguucgaaaagaccaaaaagcagcuucgggagaaugcugaagacaugggaaacggcugcuuuaaaauuuaucauaagugugauaaugccugcaucgggucuaucagaaacggcaccuacgaccacgauguguaucgcgacgaggcccugaauaaccgguuccagauuaagggagucgagcucaaauccggcuacaaggacuggauccuguggauuagcuuugcuaucucuugcuuccuucuguguguggcccuccugggguuuauuaugugggcgugccaaaaaggaaauaucagauguaacaucugcauuuga

SEQ ID NO: 193711 - RNA, 1701 nt, Artificial Sequence; identical to SEQ ID NO: 189879
  derived and/or modified sequence opt5 from hemagglutinin__InfluenzaA__AHC59461

SEQ ID NO: 193712 - RNA, 1701 nt, Artificial Sequence; identical to SEQ ID NO: 193703
  derived and/or modified sequence opt5 from hemagglutinin__InfluenzaA__AHC59473

SEQ ID NO: 193713 - RNA, 1701 nt, Artificial Sequence; identical to SEQ ID NO: 190006
  derived and/or modified sequence opt5 from hemagglutinin__InfluenzaA__AHC59485

SEQ ID NO: 193714 - RNA, 1701 nt, Artificial Sequence; identical to SEQ ID NO: 190006
  derived and/or modified sequence opt5 from hemagglutinin__InfluenzaA__AHC59497

SEQ ID NO: 193715 - RNA, 1701 nt, Artificial Sequence; identical to SEQ ID NO: 189879
  derived and/or modified sequence opt5 from hemagglutinin__InfluenzaA__AHC59509

SEQ ID NO: 193716 - RNA, 1701 nt, Artificial Sequence; identical to SEQ ID NO: 189879
  derived and/or modified sequence opt5 from hemagglutinin__InfluenzaA__AHC59521

SEQ ID NO: 193717 - RNA, 1701 nt, Artificial Sequence
  derived and/or modified sequence opt5 from hemagglutinin__InfluenzaA__AHC59533
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaagaaugagucuuucaacuggaccggagugacacagaauggcaccuccagcgcuugcauccgcagaucuaacaauuccuuuuucagccggcugaacuggcucacacaccugaauuuuaaguacccugcccuuaacgucaccaugcccaacaaugagcaguucgauaaacuguauauuuggggcgugcaucacccugggacggacaaggaucagaucuuucucuacgcgcaagccucuggacgcauuacaguuuccaccaaaagaagccagcaggcugugaucccgaacauuggcucccggccccgcgucagaaauaucccuucucgggugagcaucuauuggacaauugugaagcccggggacauccugcugauuaacuccaccggaaaucucaucgccccucgcggcuacuucaaaauuagaagcgggaagucuuccaucaugcggagcgaugcucccaucggaaaguguaacucugccugcauuaccccgaauggcagcaucccuaacgacaaacccuuucagaaugucaaccgcauuacauacggcgcguguccuagauauguuaagcaaaauacgcugaaacuugccaccgggaugcggaacgugcccgaaaagcagacacgcggaaucuucggcgcuauugccggguuuaucgagaauggaugggaaggcaugguggacgggugguacggauucagacaccagaacuccgagggccggggccaagcugccgaucugaaaucuacccaggccgcuaucgaccagauuaaugggaagcucaacagacugaucggaaaaacaaacgagaaguuccaucagauugaaaaggaguuuagcgaagucgagggccgcauccaagaucuugaaaaauauguggaggacaccaagauugaucugugguccuacaaugcggagcuccugguugcccuggaaaaccagcacacgaucgaccucacagauagcgagaugaauaaacuguucgaaaagaccaaaaagcagcuucgggagaacgcugaagacauggggaauggaugcuuuaagauuuaucauaaaugugauaacgccugcaucggcucuaucagaaaugggaccuacgaccacgauguguaucgcgacgaggcccugaacaaucgguuccagauuaagggcgucgagcucaaauccggauacaaggacuggauccuguggauuagcuuugcuaucucuugcuuccuucuguguguggcccuccugggcuuuauuaugugggcgugccaaaaagggaacaucagauguaauaucugcauuuga

SEQ ID NO: 193718 - RNA, 1701 nt, Artificial Sequence; identical to SEQ ID NO: 190006
  derived and/or modified sequence opt5 from hemagglutinin__InfluenzaA__AHC59545

SEQ ID NO: 193719 - RNA, 1701 nt, Artificial Sequence; identical to SEQ ID NO: 193642
  derived and/or modified sequence opt5 from hemagglutinin__InfluenzaA__AHC59557

SEQ ID NO: 193720 - RNA, 1701 nt, Artificial Sequence
  derived and/or modified sequence opt5 from hemagglutinin__InfluenzaA__AHC59569
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagauccuugauggggaaaacuguacccugauugacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacgcuugaauuuaauaacgagagcuucaauuggaccggagugacacagaacggcaccucuuccgcuugcauccgcagaagcaauaacuccuuuuucucucggcugaauuggcucacacaucugaacuuuaaguauccugcccuuaacgucaccaugcccaauaacgagcaguucgacaagcuguacauuuggggcgugcaccauccugggacggauaaagaccagaucuuucucuaugcgcaagccagcggacgcauuacaguuucuaccaagagaucccagcaggcugugaucccgaauauuggcagccggccccgcgucagaaacaucccuucccggaucucuauuuacuggacaaucgugaaacccggggauauucugcugaucaauagcaccggaaaccucauugccccucgcggcuacuucaagaucagauccgggaaaagcucuaucaugcgguccgacgcucccauuggaaaguguaauagcgaaugcaucaccccgaacggcucuauuccuaaugacaagcccuuucagaacgugaaucgcaucacauauggcgccuguccuagauacgucaaacaaaacacgcugaaacuugcgaccgggaugcggaauguucccgagaagcagacacgcggaauuuucggcgccaucgcuggguuuaucgaaaacggaugggagggcaugauggaugggugguauggauucagacaccagaauagcgagggccggggccaagccgcugaccugaaguccacccaggccgccauugaucagaucaacgggaaacucaacagacugauuggaaagacaaaugaaaaauuccaccagaucgagaaggaauuuucugagguggaaggccgcauucaagaccuugagaaguacguggaggauaccaaaaucgaccuguggagcuauaacgcugaacuccuggucgcgcuggagaaucagcauacgauugaucucacagacuccgaaaugaacaagcuguucgagaaaaccaagaaacagcuucgggaaaaugccgaggauauggggaacggaugcuuuaagaucuaccacaagugugacaaugcuugcaucggcagcauuagaaacgggaccuaugaucaugacguguaccgcgacgaggcccugaauaaccgguuccagaucaaaggcguugaacucaagucuggauacaaagauuggauucuguggaucuccuuugccauuagcugcuuccuucuguguguggcucuccugggcuuuaucaugugggccugccaaaaggggaauaucagauguaacauuugcaucuga

SEQ ID NO: 193721 - RNA, 1701 nt, Artificial Sequence; identical to SEQ ID NO: 190006
  derived and/or modified sequence opt5 from hemagglutinin__InfluenzaA__AHC59581

SEQ ID NO: 193722 - RNA, 1701 nt, Artificial Sequence; identical to SEQ ID NO: 189879
  derived and/or modified sequence opt5 from hemagglutinin__InfluenzaA__AHC59593

SEQ ID NO: 193723 - RNA, 1701 nt, Artificial Sequence; identical to SEQ ID NO: 192098
  derived and/or modified sequence opt5 from hemagglutinin__InfluenzaA__AHC59605

SEQ ID NO: 193724 - RNA, 1701 nt, Artificial Sequence; identical to SEQ ID NO: 190006
  derived and/or modified sequence opt5 from hemagglutinin__InfluenzaA__AHC59617

SEQ ID NO: 193725 - RNA, 1701 nt, Artificial Sequence; identical to SEQ ID NO: 190006
  derived and/or modified sequence opt5 from hemagglutinin__InfluenzaA__AHC59629

SEQ ID NO: 193726 - RNA, 1701 nt, Artificial Sequence; identical to SEQ ID NO: 193642
  derived and/or modified sequence opt5 from hemagglutinin__InfluenzaA__AHC59641

SEQ ID NO: 193727 - RNA, 1701 nt, Artificial Sequence
  derived and/or modified sequence opt5 from hemagglutinin__InfluenzaA__AHC59653
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccacccagagaagccagcaggcugugaucccgaauauuggcucccggccccgcgucagaaacaucccuucucgggugagcaucuauuggacaauugugaagcccggggacauccugcugauuaauuccaccggaaaccucaucgccccucgcggcuacuucaaaauuagaagcgggaagucuuccaucaugcggagcgaugcucccaucggaaaauguaauucugccugcauuaccccgaacggcagcaucccuaaugacaagcccuuucaaaacgucaaucgcauuacauacggcgcguguccuagauauguuaagcagaacacgcugaaacuugccaccgggaugcggaaugugcccgaaaagcagacacgcggaaucuucggcgcuauugccggguuuaucgagaacggaugggaaggcaugguggacgggugguacggauucagacaccaaaauuccgagggccggggccaggcugccgaucugaaaucuacccaggccgcuaucgaccagauuaacgggaagcucaacagacugaucggaaaaacaaaugagaaguuccaucaaauugaaaaagaguuuagcgaagucgagggccgcauccaggaucuugaaaaguauguggaggacaccaagauugaucugugguccuacaacgcggagcuccugguugcccuggaaaaucagcacacgaucgaccucacagauagcgagaugaacaaacuguucgaaaagaccaaaaagcagcuucgggagaaugcugaagacauggggaacggaugcuuuaaaauuuaucauaagugugauaaugccugcaucggcucuaucagaaacgggaccuacgaccacgauguguaucgcgacgaggcccugaauaaccgguuccaaauuaagggcgucgagcucaaauccggauacaaggacuggauccuguggauuagcuuugcuaucucuugcuuccuucuguguguggcccuccugggcuuuauuaugugggcgugccagaaagggaauaucagauguaacaucugcauuuga

SEQ ID NO: 193728 - RNA, 1701 nt, Artificial Sequence; identical to SEQ ID NO: 189879
  derived and/or modified sequence opt5 from hemagglutinin__InfluenzaA__AHC59665

SEQ ID NO: 193729 - RNA, 1701 nt, Artificial Sequence; identical to SEQ ID NO: 190006
  derived and/or modified sequence opt5 from hemagglutinin__InfluenzaA__AHC59677

SEQ ID NO: 193730 - RNA, 1701 nt, Artificial Sequence; identical to SEQ ID NO: 193727
  derived and/or modified sequence opt5 from hemagglutinin__InfluenzaA__AHC59689

SEQ ID NO: 193731 - RNA, 1701 nt, Artificial Sequence; identical to SEQ ID NO: 193642
  derived and/or modified sequence opt5 from hemagglutinin__InfluenzaA__AHC59701

SEQ ID NO: 193732 - RNA, 1701 nt, Artificial Sequence; identical to SEQ ID NO: 189879
  derived and/or modified sequence opt5 from hemagglutinin__InfluenzaA__AHC59713

SEQ ID NO: 193733 - RNA, 1701 nt, Artificial Sequence; identical to SEQ ID NO: 193653
  derived and/or modified sequence opt5 from hemagglutinin__InfluenzaA__AHC59737

SEQ ID NO: 193734 - RNA, 1701 nt, Artificial Sequence; identical to SEQ ID NO: 189879
  derived and/or modified sequence opt5 from hemagglutinin__InfluenzaA__AHC59749

SEQ ID NO: 193735 - RNA, 1701 nt, Artificial Sequence; identical to SEQ ID NO: 190006
  derived and/or modified sequence opt5 from hemagglutinin__InfluenzaA__AHC59761

SEQ ID NO: 193736 - RNA, 1701 nt, Artificial Sequence; identical to SEQ ID NO: 190006
  derived and/or modified sequence opt5 from hemagglutinin__InfluenzaA__AHC59773

SEQ ID NO: 193737 - RNA, 1701 nt, Artificial Sequence; identical to SEQ ID NO: 190806
  derived and/or modified sequence opt5 from hemagglutinin__InfluenzaA__AHC59785

SEQ ID NO: 193738 - RNA, 1701 nt, Artificial Sequence; identical to SEQ ID NO: 190006
  derived and/or modified sequence opt5 from hemagglutinin__InfluenzaA__AHC59797

SEQ ID NO: 193739 - RNA, 1701 nt, Artificial Sequence; identical to SEQ ID NO: 192098
  derived and/or modified sequence opt5 from hemagglutinin__InfluenzaA__AHC59809

SEQ ID NO: 193740 - RNA, 1701 nt, Artificial Sequence
  derived and/or modified sequence opt5 from hemagglutinin__InfluenzaA__AHC59821
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagauccuugauggggaaaacuguacccugauugacgcccuccugggagauccccagugcgacggccugcagaauaaaaagugggaucucuuugucgagagaucuaaagccuauagcaacuguuacccuuaugacgugcccgauuacgcuucccugcggucucuuguugccagcuccgggacgcuggaauuuaauaacgagagcuucaauuggaccggagugacacagaacggcaccucuuccgcuugcauccgcagaagcaauaacucuuucuuuucccggcucaauuggcugacacaucuuaacuucaaguauccugcccugaacgucaccaugcccaauaacgagcaguuugacaagcucuacauuuggggcgugcaccauccugggacggauaaagaccagaucuuccuguaugcgcaagccagcggacgcauuacaguuucuaccaagagaucccagcaggcugugaucccgaauauuggcagccggccccgcgucagaaacaucccuucccggaucucuauuuacuggacaaucgugaaacccggggauauucugcucaucaauagcaccggaaaccugauugccccucgcggcuacuuuaagaucagauccgggaaaagcucuaucaugcgguccgacgcucccauuggaaaguguaauagcgaaugcaucaccccgaacggcucuauuccuaaugacaagcccuuccagaacgugaaucgcaucacauauggcgccuguccuagauacgucaaacaaaacacgcuuaagcuggcgaccgggaugcggaauguucccgagaaacagacacgcggaauuuuuggcgccaucgcuggguucaucgaaaacggaugggagggcaugguggaugggugguauggauuuagacaccagaauagcgagggccggggccaagccgcugaccucaaguccacccaggccgccauugaucagaucaacgggaaacugaacagacuuauuggaaagacaaaugaaaaauuccaccagaucgagaaggaguucucugaaguggaaggccgcauucaagaccuggagaaguacgucgaggauaccaaaaucgaccucuggagcuauaacgcugaacugcugguggcgcucgagaaucagcauacgauugaucugacagacuccgaaaugaacaaacuuguugagaagaccaagaaacagcugcgggaaaaugccgaggauauggggaacggaugcuuuaagaucuaccacaagugugacaaugcuugcaucggcagcauuagaaacgggaccuaugaucaugacguguaccgcgacgaggcccucaauaaccgguuccagaucaaaggcgucgaacugaagucuggauacaaagauuggauucuuuggaucuccuuugccauuagcugcuuccugcucuguguggcucugcugggcuuuaucaugugggccugccaaaaggggaauaucagauguaacauuugcaucuga

SEQ ID NO: 193741 - RNA, 1701 nt, Artificial Sequence; identical to SEQ ID NO: 193642
  derived and/or modified sequence opt5 from hemagglutinin__InfluenzaA__AHC59833

SEQ ID NO: 193742 - RNA, 1701 nt, Artificial Sequence; identical to SEQ ID NO: 193641
  derived and/or modified sequence opt5 from hemagglutinin__InfluenzaA__AHC59845

SEQ ID NO: 193743 - RNA, 1701 nt, Artificial Sequence; identical to SEQ ID NO: 190806
  derived and/or modified sequence opt5 from hemagglutinin__InfluenzaA__AHC59857

SEQ ID NO: 193744 - RNA, 1701 nt, Artificial Sequence; identical to SEQ ID NO: 190006
  derived and/or modified sequence opt5 from hemagglutinin__InfluenzaA__AHC59869

SEQ ID NO: 193745 - RNA, 1701 nt, Artificial Sequence; identical to SEQ ID NO: 190006
  derived and/or modified sequence opt5 from hemagglutinin__InfluenzaA__AHC59881

SEQ ID NO: 193746 - RNA, 1701 nt, Artificial Sequence; identical to SEQ ID NO: 189879
  derived and/or modified sequence opt5 from hemagglutinin__InfluenzaA__AHC59892

SEQ ID NO: 193747 - RNA, 1701 nt, Artificial Sequence
  derived and/or modified sequence opt5 from hemagglutinin__InfluenzaA__AHC59904
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcggcucuaauaacuccuuuuucagcagacugaauuggcucacacaccugaacuuuaaguacccugcccuuaacgucaccaugcccaauaacgagcaguucgauaagcuguauauuuggggagugcaucacccugggacggacaaagaucagaucuuucucuacgcgcaagccucuggccggauuacaguuuccaccaagcgcagccagcaggcugugaucccgaauauuggguccagaccccggguccgcaacaucccuucuagagugagcaucuauuggacaauugugaaacccggagacauccugcugauuaauuccaccggcaaccucaucgccccucggggguacuucaagauucgcagcggaaaaucuuccaucaugagaagcgaugcucccaucggcaaguguaauucugccugcauuaccccgaacggcagcaucccuaaugacaagcccuuucagaacgucaaucggauuacauacggggcguguccucgcuauguuaaacaaaacacgcugaaacuugccaccggaaugagaaaugugcccgaaaaacagacacggggcaucuucggggcuauugccggauuuaucgagaacggcugggaagggaugauggacggaugguacggcuuccgccaccaaaauuccgagggcagagggcaggcugccgaucugaagucuacccaggccgcuaucgaccagauuaacggaaaacucaaccggcugaucggcaagacaaaugagaaauuccaucagauugaaaaggaguuuagcgaaguggaggggagaauccaagaucuugaaaaguaugucgaggacaccaaaauugaucugugguccuacaacgcggagcuccugguggcccuggaaaaucagcacacgaucgaccucacagauagcgagaugaacaagcuguucgaaaagaccaagaaacagcuucgcgagaaugcugaagacaugggaaacggcugcuuuaagauuuaucauaagugugauaaugccugcaucgggucuauccggaacggcaccuacgaccacgauguuuauagagacgaggcccugaauaaccgcuuccagauuaaaggaguggagcucaaguccggcuacaaagacuggauccuguggauuagcuuugcuaucucuugcuuccuucugugugucgcccuccugggguuuauuaugugggcgugccaaaagggaaauauccgguguaacaucugcauuuga

SEQ ID NO: 193748 - RNA, 1701 nt, Artificial Sequence
  derived and/or modified sequence opt5 from hemagglutinin__InfluenzaA__AHC59915
augaagaccgugaucgcccugagcuacauucucugccuggcuuucgcccagaaacuucccggcaacgacaauuccacagcgacgcugugucucgggcaccaugcugucccuaacggaaccaucguuaagacaauuaccaaugaucaaaucgaggugacaaacgccaccgaacuggugcagucuagcuccacaggcgagauuugcgacucuccgcaccagauccuugauggggaaaauuguacccugaucgacgcccuccugggagauccccagugcgacggcuuucaaaacaaaaagugggaucuguucgucgagagaagcaaggcuuauuccaauuguuacccuuaugacgugcccgauuacgccucucuccggagccugguugcuuccagcgggacgcuugaauuuaacaaugagucuuucaacuggaccggagugacacagaauggcaccuccagcgccugcauucgcagaucuaacaauuccuuuuucagccggcugaacuggcucacacaucugaauuuuaaguauccugcgcuuaacgucaccaugcccaacaaugagcaguucgacaagcuguacaucuggggcgugcaccauccugggacggauaaagaccagauuuuucucuaugcccaggcuucuggacgcaucacaguuuccaccaagagaagccaacaggccgugauuccgaacaucggcucccggccccgcgucagaaauauuccuucucggaucagcaucuacuggacaauugugaaacccggggauauccugcugauuaacuccaccggaaaucucaucgcuccucgcggcuacuucaagauuagaagcgggaaaucuuccaucaugcggagcgacgcccccaucggaaaguguaacucugaaugcauuaccccgaauggcagcaucccuaacgacaagcccuuucagaaugugaaccgcauuacauauggcgcguguccuagauacgucaaacaaaauacgcugaaacuugccaccgggaugcggaacguucccgagaaacagacacgcggaaucuucggcgcuauugccggguuuaucgaaaauggaugggagggcaugguggaugggugguauggauucagacaccagaacuccgagggccggggccaagcugccgaccugaagucuacccaggccgcuaucgaucagauuaaugggaaacucaacagacugaucggaaagacaaacgaaaaauuccaccagauugagaaggaauuuagcgagguggaaggccgcauccaagaccuugagaaguacgucgaggauaccaaaauugaccugugguccuauaaugcggaacuccugguggcccuggagaaccagcauacgaucgaucucacagacagcgaaaugaauaagcuguucgagaaaaccaagaaacagcuucgggaaaacgcugaggauauggggaauggaugcuuuaagauuuaccacaagugugacaacgccugcaucggcucuaucagaaaugggaccuaugaucaugacguuuaccgcgacgaggcccugaacaaucgguuccagauuaaaggcguggaacucaaguccggauacaaagauuggauccuguggauuagcuuugcuaucucuugcuuccuucugugugucgcccuccugggcuuuauuaugugggcgugccaaaaggggaacaucagauguaauaucugcauuuga

SEQ ID NO: 193749 - RNA, 1701 nt, Artificial Sequence; identical to SEQ ID NO: 190006
  derived and/or modified sequence opt5 from hemagglutinin__InfluenzaA__AHC59939

SEQ ID NO: 193750 - RNA, 1701 nt, Artificial Sequence
  derived and/or modified sequence opt5 from hemagglutinin__InfluenzaA__AHC59963
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacuccagcuuuuucucucggcugaauuggcucacacaucugaacuuuaaguauccugcccuuaaugucaccaugcccaacaacgagcaguucgacaagcuguacauuuggggcgugcaccauccugggacggauaaagaccagaucuuucucuaugcgcaauccagcggacgcauuacaguuuccaccaagagaucucagcaggccgugaucccgaauauuggcagccggccccgcaucagaaacaucccuucccggauuagcaucuacuggacaauugucaaacccggggauauccugcugauuaauucuaccggaaaccucaucgcuccucgcggcuacuucaagaucagauccgggaaaagcucuauuaugcggagcgacgcccccaucggaaaguguaauuccgaaugcauuaccccgaacggcucuaucccuaaugacaagcccuuucagaacgugaaucgcauuacauauggcgcuuguccuagauacaucaaacaaagcacgcugaagcuggccaccgggaugcggaacgugcccgagaaacagacacgcggaaucuucggcgcgauugccggguuuaucgaaaauggaugggagggcauggucgaugggugguauggauucagacaccagaacuccgagggccggggccaagcugccgaccuuaagagcacccaggcugccauugaucagaucaaugggaaacucaacagacugauuggaaagacaaaugaaaaauuccaccagaucgagaaggaauuuucugagguugaaggccgcauucaagaccuugagaaguacguggaggauaccaaaaucgaccugugguccuauaacgccgaacuccugguggcucuggagaaccagcauacgaucgaucucacagacagcgaaaugaauaagcuguucgagaaaaccaagaaacagcuucgggaaaacgcggaggauauggggaauggaugcuuuaagauuuaccacaagugugacaacgccugcaucggcucuauuagaaaugggaccuauaaccaugaugucuaccgcgacgaggcucugaauaaccgguuccagaucaaaggcguggaacucaaguccggauacaaagacuggauucuguggaucagcuuugccaucuccugcuuccuucuguguguugcccuccugggcuuuauuaugugggcuugccaaaaggggaauaucagauguaacauuugcaucuga

SEQ ID NO: 193751 - RNA, 1701 nt, Artificial Sequence; identical to SEQ ID NO: 189879
  derived and/or modified sequence opt5 from hemagglutinin__InfluenzaA__AHC59987

SEQ ID NO: 193752 - RNA, 1701 nt, Artificial Sequence; identical to SEQ ID NO: 189879
  derived and/or modified sequence opt5 from hemagglutinin__InfluenzaA__AHC59999

SEQ ID NO: 193753 - RNA, 1701 nt, Artificial Sequence; identical to SEQ ID NO: 190006
  derived and/or modified sequence opt5 from hemagglutinin__InfluenzaA__AHC60011

SEQ ID NO: 193754 - RNA, 1701 nt, Artificial Sequence; identical to SEQ ID NO: 189879
  derived and/or modified sequence opt5 from hemagglutinin__InfluenzaA__AHC60023

SEQ ID NO: 193755 - RNA, 1701 nt, Artificial Sequence; identical to SEQ ID NO: 190806
  derived and/or modified sequence opt5 from hemagglutinin__InfluenzaA__AHC60035

SEQ ID NO: 193756 - RNA, 1701 nt, Artificial Sequence; identical to SEQ ID NO: 190806
  derived and/or modified sequence opt5 from hemagglutinin__InfluenzaA__AHC60047

SEQ ID NO: 193757 - RNA, 1701 nt, Artificial Sequence
  derived and/or modified sequence opt5 from hemagglutinin__InfluenzaA__AHC60059
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagauccuugauggggaaaacuguacccugauugacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacgcuugaauuuaauaacgagagcuucaauuggaccggagugacacagaacggcaccucuuccgcuugcauccgcagaagcaauaacuccuuuuucucucggcugaauuggcucacacaucugaacuuuaaguauccugcccuuaacgucaccaugcccaauaacgagcaguucgacaagcuguacauuuggggcgugcaccauccugggacggauaaagaccagaucuuucucuaugcgcaagccagcggacgcauuacaguuucuaccaagagaucccagcaggcugugaucccgaauauuggcagccggccccgcgucagaaacaucccuucccggaucucuauuuacuggacaaucgugaaacccggggauauucugcugaucaauagcaccggaaaccucauugccccucgcggcuacuucaagaucagauccgggaaaagcucuaucaugcgguccgacgcucccauuggaaaguguaauagcgccugcaucaccccgaacggcucuauuccuaaugacaagcccuuucagaacgugaaucgcaucacauauggcgcguguccuagauacgucaaacaaaacacgcugaaacuugccaccgggaugcggaauguucccgaaaaacagacacgcggaauuuucggcgcuaucgccggguuuaucgagaacggaugggaaggcaugguggaugggugguauggauucagacaccagaauagcgagggccggggccaagcugccgaccugaaguccacccaggccgcuauugaucagaucaacgggaaacucaacagacugauuggaaagacaaaugagaaauuccaccagaucgaaaaggaguuuucugaaguggagggccgcauucaagaccuugaaaaguacgucgaggauaccaaaaucgaccuguggagcuauaacgcggagcuccugguggcccuggaaaaucagcauacgauugaucucacagacuccgagaugaacaagcuguucgaaaagaccaagaaacagcuucgggagaaugcugaagauauggggaacggaugcuuuaagaucuaccacaagugugacaaugccugcaucggcagcauuagaaacgggaccuauaaucaugauguuuaccgcgacgaggcccugaacaaucgguuccagaucaaaggcguggagcucaagucuggauacaaagacuggauucuguggaucuccuuugcuauuagcugcuuccuucugugugucgcccuccugggcuuuaucaugugggcgugccaaaaggggaacaucagauguaauauuugcaucuga

SEQ ID NO: 193758 - RNA, 1701 nt, Artificial Sequence; identical to SEQ ID NO: 192098
  derived and/or modified sequence opt5 from hemagglutinin__InfluenzaA__AHC60071

SEQ ID NO: 193759 - RNA, 1701 nt, Artificial Sequence; identical to SEQ ID NO: 193642
  derived and/or modified sequence opt5 from hemagglutinin__InfluenzaA__AHC60083

SEQ ID NO: 193760 - RNA, 1701 nt, Artificial Sequence; identical to SEQ ID NO: 190806
  derived and/or modified sequence opt5 from hemagglutinin__InfluenzaA__AHC60095

SEQ ID NO: 193761 - RNA, 1701 nt, Artificial Sequence
  derived and/or modified sequence opt5 from hemagglutinin__InfluenzaA__AHC60107
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagaucauugauggggaaaacuguacccuuaucgacgcccugcucggagauccccagugcgacggcuuucagaauaaaaagugggaucuguucgucgagagaucuaaagccuauagcaacuguuacccuuaugacgugcccgauuacgcuucccugcggucucucguugccagcuccgggacgcuggaauuuaauaacgagagcuucaauuggaccggagugacacagaacggcaccucuuccgcuugcauucgcagaagcaauaacucuuucuucucccggcuuaauuggcugacacaucucaacuuuaaguauccugcccugaacgucaccaugcccaauaacgagcaguucgacaaacuuuacaucuggggcgugcaccauccugggacggauaaggaccagauuuuucuguaugcgcaagccagcggacgcaucacaguuucuaccaagagaucccagcaggcugugauuccgaauaucggcagccggccccgcgucagaaacaucccuucccggauuucuaucuacuggacaauugugaaacccggggauauccuccugauuaauagcaccggaaaccugaucgccccucgcggcuacuucaagaucagauccgggaaaagcucuauuaugcgguccgacgcucccaucggaaaguguaauagcgaaugcauuaccccgaacggcucuaucccuaaugacaagcccuuucagaacgugaaucgcauuacauauggcgccuguccuagauacgucaaacaaaacacgcucaagcuggcgaccgggaugcggaauguucccgagaaacagacacgcggaaucuucggcgccaucgcuggguuuauugaaaacggaugggagggcaugguggaugggugguauggauucagacaccagaauagcgagggccggggccaagccgcugaccuuaaguccacccaggccgccaucgaucagauuaacgggaaacugaacagacucaucggaaagacaaaugaaaaauuccaccagauugagaaggaauuuucugagguggaaggccgcauccaagaccuggagaaguacgucgaggauaccaaaauugaccuuuggagcuauaacgcugaacugcucguggcgcuggagaaucagcauacgaucgaucugacagacuccgaaaugaacaagcucuuugagaaaaccaagaaacagcugcgggaaaaugccgaggauauggggaacggaugcuuuaagaucuaccacaagugugacaaugcuugcauuggcagcaucagaaacgggaccuaugaucaugacguuuaccgcgacgaggcccuuaauaaccgguucaaaauuaagggcguggaacugaaaucuggauacaaggauuggauccucuggauuuccuuugccaucagcugcuuccugcuuugugucgcucugcucggcuuuaucaugugggccugccagaaagggaauauuagauguaacaucugcauuuga

SEQ ID NO: 193762 - RNA, 1701 nt, Artificial Sequence; identical to SEQ ID NO: 190006
  derived and/or modified sequence opt5 from hemagglutinin__InfluenzaA__AHC60119

SEQ ID NO: 193763 - RNA, 1701 nt, Artificial Sequence; identical to SEQ ID NO: 190006
  derived and/or modified sequence opt5 from hemagglutinin__InfluenzaA__AHC60131

SEQ ID NO: 193764 - RNA, 1701 nt, Artificial Sequence; identical to SEQ ID NO: 193672
  derived and/or modified sequence opt5 from hemagglutinin__InfluenzaA__AHC60143

SEQ ID NO: 193765 - RNA, 1701 nt, Artificial Sequence
  derived and/or modified sequence opt5 from hemagglutinin__InfluenzaA__AHC60155
augaagaccgugaucgcccugagcuacauucucugccuggcuuucgcccagaaacuucccggcaacgacaauuccacagcgacgcugugucucgggcaccaugcugucccuaacggaaccaucguuaagacaauuaccaaugaucaaaucgaggugacaaacgccaccgaacuggugcagucuagcccgacaggcgagauuugcgacucuccccaccagauccuugauggggaaaauuguacccugaucgacgcccuccugggagauccucagugcgacggcuuucaaaacaaaaagugggaucuguucgucgagagaucuaaggcuuauagcaauuguuaccccuaugacgugccugauuacgccucccuccggucucugguugcuagcuccgggacgcuugaauuuaacaaugagagcuucaacuggaccggagugacacagaauggcaccucuuccgccugcauucgcagaagcaacaauuccuuuuucucccggcugaacuggcucacacaucugaauuuuaaguaucccgcgcuuaacgucaccaugccuaacaaugagcaguucgacaagcuguacaucuggggcgugcaccauccggggacggauaaagaccagauuuuucucuaugcccaagcuagcggacgcaucacaguuucuaccaagagaucccagcaggccgugauucccaacaucggcagccggccucgcgucagaaauauucccucccggaucucuaucuacuggacaauugugaaaccuggggauauccugcugauuaacagcaccggaaaucucaucgcuccccgcggcuacuucaagauuagauccgggaaaagcucuaucaugcgguccgacgccccgaucggaaaguguaacagcgaaugcauuaccccuaauggcucuauccccaacgacaagccuuuucagaaugugaaccgcauuacauauggcgcgugucccagauacgucaaacaaaauacgcugaaacuugccaccgggaugcggaacguucccgagaaacagacacgcggaaucuucggcgcuauugccggguuuaucgaaaauggaugggagggcaugguggaugggugguauggauucagacaccagaacagcgagggccggggccaagcugccgaccugaaguccacccaggccgcuaucgaucagauuaaugggaaacucaacagacugaucggaaagacaaacgaaaaauuccaccagauugagaaggaauuuucugagguggaaggccgcauccaagaccuugagaaguacgucgaggauaccaaaauugaccuguggagcuauaaugcggaacuccugguggcccuggagaaccagcauacgaucgaucucacagacuccgaaaugaauaagcuguucgagaaaaccaagaaacagcuucgggaaaacgcugaggauauggggaauggaugcuuuaagauuuaccacaagugugacaacgccugcaucggcagcaucagaaaugggaccuaugaucaugacguuuaccgcgacgaggcccugaacaaucgguuccagauuaaaggcguggaacucaagucuggauacaaagauuggauccuguggauuuccuuugcuaucagcugcuuccuucugugugucgcccuccugggcuuuauuaugugggcgugccaaaaggggaacaucagauguaauaucugcauuuga

SEQ ID NO: 193766 - RNA, 1701 nt, Artificial Sequence; identical to SEQ ID NO: 189879
  derived and/or modified sequence opt5 from hemagglutinin__InfluenzaA__AHC60167

SEQ ID NO: 193767 - RNA, 1701 nt, Artificial Sequence; identical to SEQ ID NO: 190806
  derived and/or modified sequence opt5 from hemagglutinin__InfluenzaA__AHC60179

SEQ ID NO: 193768 - RNA, 1701 nt, Artificial Sequence; identical to SEQ ID NO: 193717
  derived and/or modified sequence opt5 from hemagglutinin__InfluenzaA__AHC60191

SEQ ID NO: 193769 - RNA, 1701 nt, Artificial Sequence; identical to SEQ ID NO: 193717
  derived and/or modified sequence opt5 from hemagglutinin__InfluenzaA__AHC60203

SEQ ID NO: 193770 - RNA, 1701 nt, Artificial Sequence; identical to SEQ ID NO: 192098
  derived and/or modified sequence opt5 from hemagglutinin__InfluenzaA__AHC60215

SEQ ID NO: 193771 - RNA, 1701 nt, Artificial Sequence; identical to SEQ ID NO: 190806
  derived and/or modified sequence opt5 from hemagglutinin__InfluenzaA__AHC60239

SEQ ID NO: 193772 - RNA, 1701 nt, Artificial Sequence; identical to SEQ ID NO: 190806
  derived and/or modified sequence opt5 from hemagglutinin__InfluenzaA__AHC60251

SEQ ID NO: 193773 - RNA, 1701 nt, Artificial Sequence
  derived and/or modified sequence opt5 from hemagglutinin__InfluenzaA__AHC60263
augaagaccaucauugcccugagcuacauccucugccugguguucgcucagaaacuucccggcaacgaaaauuccacagccacgcugugucucgggcaccaugcggucccuaacggaaccauuguuaagacaaucaccaaugaccaaauugaagugacaaacgcuaccgagcuggugcaaaauucuagcacaggcgaaaucugcgauuccccgcaccagauccuugacggggagaacuguacccugauugaugcccuccugggagacccccagugcgauggcuuucagaauaaaaagugggaccuguucgucgaaagaucuaaagccuauagcaacuguuacccuuaugaugugcccgacuacgcuucccuccggucucugguugccagcuccgggacgcuugaguuuaauaacgagagcuucaauuggaccggagugacacagaacggcaccucuuccgcuugcauccgcagaagcaauaacuccuuuuucucucggcugaauuggcucacacaucugaacuuuaaguauccugcccuuaacgucaccaugcccaauaacgaacaguucgauaagcuguacauuuggggcgugcaccauccugggacggacaaagaucagaucuuucucuaugcgcaagccagcggacgcauuacaguuucuaccaagagaucccagcaggcugugaucccgaauauuggcagccggccccgcgucagaaacaucccuucccggaucucuauuuacuggacaaucgugaaacccggggacauucugcugaucaauagcaccggaaaccucauugccccucgcggcuacuucaagaucagauccgggaaaagcucuaucaugcgguccgaugcucccauuggaaaguguaauagcgagugcaucaccccgaacggcucuauuccuaaugacaagcccuuucagaacgugaaucgcaucacauauggcgccuguccuagauacgucaaacaaaacacgcugaaacuugcgaccgggaugcggaauguucccgaaaagcagacacgcggaauuuucggcgccaucgcuggguuuaucgagaacggaugggagggcaugguggacgggugguauggauucagacaccagaauagcgaaggccggggccaagccgcugaucugaaguccacccaggccgccauugaccagaucaacgggaaacucaacagacugauuggaaagacaaaugagaaauuccaccagaucgaaaaggaguuuucugaaguggagggccgcauucaagaucuugagaaguacgucgaagacaccaaaaucgaucuguggagcuauaacgcugagcuccugguggcgcuggaaaaucagcauacgauugaccucacagauuccgagaugaacaagcuguucgagaaaaccaagaaacagcuucgggagaaugccgaggacauggggaacggaugcuuuaagaucuaccacaagugugauaaugcuugcaucggcagcauuagaaacgggaccuaugaccaugauguuuaccgcgacgaagcccugaauaaccgguuccagaucaaaggcguggagcucaagucuggauacaaagacuggauucuguggaucuccuuugccauuagcugcuuccuucugugugucgcucuccugggcuuuaucaugugggccugccaaaaggggaauaucagauguaacauuugcaucuga

SEQ ID NO: 193774 - RNA, 1701 nt, Artificial Sequence; identical to SEQ ID NO: 189879
  derived and/or modified sequence opt5 from hemagglutinin__InfluenzaA__AHC60275

SEQ ID NO: 193775 - RNA, 1701 nt, Artificial Sequence; identical to SEQ ID NO: 193761
  derived and/or modified sequence opt5 from hemagglutinin__InfluenzaA__AHC60287

SEQ ID NO: 193776 - RNA, 1701 nt, Artificial Sequence; identical to SEQ ID NO: 193642
  derived and/or modified sequence opt5 from hemagglutinin__InfluenzaA__AHC60299

SEQ ID NO: 193777 - RNA, 1701 nt, Artificial Sequence
  derived and/or modified sequence opt5 from hemagglutinin__InfluenzaA__AHC60311
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagauccuugauggggaaaacuguacccugauugacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacgcuugaauuugacaaugagagcuucaacuggaccggagugacacagaauggcaccucuuccgcuugcauccgcagaagcaacaauuccuuuuucucucggcugaacuggcucacacaucugaauuuuaaguauccugcccuuaacgucaccaugcccaacaaugagcaguucgauaagcuguacauuuggggcgugcaccauccugggacggacaaagaucagaucuuucucuaugcgcaagccagcggacgcauuacaguuucuaccaagagaucccagcaggcugugaucccgaacauuggcagccggccccgcgucagaaauaucccuucccggaucucuauuuacuggacaaucgugaaacccggggacauucugcugaucaacagcaccggaaaucucauugccccucgcggcuacuucaagaucagauccgggaaaagcucuaucaugcgguccgacgcucccauuggaaaguguaacagcgaaugcaucaccccgaauggcucuauuccuaacgauaagcccuuucagaaugugaaccgcaucacauauggcgccuguccuagauacgucaaacaaaauacgcugaaacuugcgaccgggaugcggaacguucccgagaagcagacacgcggaauuuucggcgccaucgcuggguuuaucgaaaauggaugggagggcaugguggacgggugguauggauucagacaccagaacagcgagggccggggccaagccgcugaucugaaguccacccaggccgccauugaccagaucaaugggaaacucaacagacugauuggaaagacaaacgaaaaauuccaccagaucgagaaggaauuuucugagguggaaggccgcauucaagaucuugagaaguacgucgaggacaccaaaaucgaucuguggagcuauaaugcugaacuccugguggcgcuggagaaccagcauacgauugaccucacagauuccgaaaugaauaagcuguucgagaaaaccaagaaacagcuucgggaaaacgccgaggacauggggaauggaugcuuuaagaucuaccacaagugugauaacgcuugcaucggcagcauuagaaaugggaccuaugaccaugacguuuaccgcgaugaggcccugaacaaucgguuccagaucaaaggcguggaacucaagucuggauacaaagacuggauucuguggaucuccuuugccauuagcugcuuccuucugugugucgcucuccugggcuuuaucaugugggccugccaaaaggggaacaucagauguaauauuugcaucuga

SEQ ID NO: 193778 - RNA, 1701 nt, Artificial Sequence; identical to SEQ ID NO: 190806
  derived and/or modified sequence opt5 from hemagglutinin__InfluenzaA__AHC60323

SEQ ID NO: 193779 - RNA, 1701 nt, Artificial Sequence; identical to SEQ ID NO: 192098
  derived and/or modified sequence opt5 from hemagglutinin__InfluenzaA__AHC60335

SEQ ID NO: 193780 - RNA, 1701 nt, Artificial Sequence; identical to SEQ ID NO: 189879
  derived and/or modified sequence opt5 from hemagglutinin__InfluenzaA__AHC60347

SEQ ID NO: 193781 - RNA, 1701 nt, Artificial Sequence; identical to SEQ ID NO: 190006
  derived and/or modified sequence opt5 from hemagglutinin__InfluenzaA__AHC60359

SEQ ID NO: 193782 - RNA, 1701 nt, Artificial Sequence; identical to SEQ ID NO: 193703
  derived and/or modified sequence opt5 from hemagglutinin__InfluenzaA__AHC60371

SEQ ID NO: 193783 - RNA, 1701 nt, Artificial Sequence; identical to SEQ ID NO: 189879
  derived and/or modified sequence opt5 from hemagglutinin__InfluenzaA__AHC60383

SEQ ID NO: 193784 - RNA, 1701 nt, Artificial Sequence; identical to SEQ ID NO: 190006
  derived and/or modified sequence opt5 from hemagglutinin__InfluenzaA__AHC60395

SEQ ID NO: 193785 - RNA, 1701 nt, Artificial Sequence; identical to SEQ ID NO: 193717
  derived and/or modified sequence opt5 from hemagglutinin__InfluenzaA__AHC60407

SEQ ID NO: 193786 - RNA, 1701 nt, Artificial Sequence; identical to SEQ ID NO: 189879
  derived and/or modified sequence opt5 from hemagglutinin__InfluenzaA__AHC60419

SEQ ID NO: 193787 - RNA, 1701 nt, Artificial Sequence; identical to SEQ ID NO: 190006
  derived and/or modified sequence opt5 from hemagglutinin__InfluenzaA__AHC60431

SEQ ID NO: 193788 - RNA, 1701 nt, Artificial Sequence; identical to SEQ ID NO: 189879
  derived and/or modified sequence opt5 from hemagglutinin__InfluenzaA__AHC60455

SEQ ID NO: 193789 - RNA, 1701 nt, Artificial Sequence; identical to SEQ ID NO: 189879
  derived and/or modified sequence opt5 from hemagglutinin__InfluenzaA__AHC60467

SEQ ID NO: 193790 - RNA, 1701 nt, Artificial Sequence; identical to SEQ ID NO: 193641
  derived and/or modified sequence opt5 from hemagglutinin__InfluenzaA__AHC60479

SEQ ID NO: 193791 - RNA, 1701 nt, Artificial Sequence; identical to SEQ ID NO: 190806
  derived and/or modified sequence opt5 from hemagglutinin__InfluenzaA__AHC60491

SEQ ID NO: 193792 - RNA, 1701 nt, Artificial Sequence
  derived and/or modified sequence opt5 from hemagglutinin__InfluenzaA__AHC60503
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagccuauuccaacuguuacccuuaugaugugcccgacuacgcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaucugaacuuuaaguauccugcccuuaacgucaccaugcccaauaacgagcaguucgauaagcuguacauuuggggcgugcaccauccugggacggacaaagaucagaucuuucucuaugcgcaagccucuggacgcauuacaguuuccaccaagagaagccagcaggcugugaucccgaauauuggcucccggccccgcgucagaaacaucccuucucggaucagcauuuacuggacaaucgugaaacccggggacauucugcugaucaauuccaccggaaaccucauugccccucgcggcuacuucaagaucagaagcgggaaaucuuccaucaugcggagcgaugcucccauuggaaaguguaauucugccugcaucaccccgaacggcagcauuccuaaugacaagcccuuucagaacgugaaucgcaucacauauggcgcguguccuagauacgucaaacaaaacacgcugaaacuugccaccgggaugcggaauguucccgaaaaacagacacgcggaauuuucggcgcuaucgccggguuuaucgagaacggaugggaaggcaugguggacgggugguauggauucagacaccaaaauuccgagggccggggccaggcugccgaucugaagucuacccaggccgcuauugaccagaucaacgggaaacucaacagacugauuggaaagacaaaugagaaauuccaccagaucgaaaaggaguuuagcgaaguggagggccgcauucaagaucuugaaaaguacgucgaggacaccaaaaucgaucugugguccuauaacgcggagcuccugguggcccuggaaaaucagcauacgauugaccucacagauagcgagaugaacaagcuguucgaaaagaccaagaaacagcuucgggagaaugcugaagacauggggaacggaugcuuuaagaucuaccacaagugugauaaugccugcaucggcucuauuagaaacgggaccuaugaccaugauguuuaccgcgacgaggcccugaauaaccgguuccagaucaaaggcguggagcucaaguccggauacaaagacuggauucuguggaucagcuuugcuauuucuugcuuccuucugugugucgugcuccugggcuuuaucaugugggccugccaaaaggggaauaucagauguaacauuugcaucuga

SEQ ID NO: 193793 - RNA, 1701 nt, Artificial Sequence; identical to SEQ ID NO: 190006
  derived and/or modified sequence opt5 from hemagglutinin__InfluenzaA__AHC60515

SEQ ID NO: 193794 - RNA, 1701 nt, Artificial Sequence; identical to SEQ ID NO: 190806
  derived and/or modified sequence opt5 from hemagglutinin__InfluenzaA__AHC60527

SEQ ID NO: 193795 - RNA, 1701 nt, Artificial Sequence; identical to SEQ ID NO: 190006
  derived and/or modified sequence opt5 from hemagglutinin__InfluenzaA__AHC60539

SEQ ID NO: 193796 - RNA, 1701 nt, Artificial Sequence; identical to SEQ ID NO: 193653
  derived and/or modified sequence opt5 from hemagglutinin__InfluenzaA__AHC60551

SEQ ID NO: 193797 - RNA, 1701 nt, Artificial Sequence; identical to SEQ ID NO: 192098
  derived and/or modified sequence opt5 from hemagglutinin__InfluenzaA__AHC60563

SEQ ID NO: 193798 - RNA, 1701 nt, Artificial Sequence; identical to SEQ ID NO: 192098
  derived and/or modified sequence opt5 from hemagglutinin__InfluenzaA__AHC60575

SEQ ID NO: 193799 - RNA, 1701 nt, Artificial Sequence
  derived and/or modified sequence opt5 from hemagglutinin__InfluenzaA__AHC60587
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagauccuugauggggaaaacuguacccugauugacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacgcuugaauuuaauaacgagagcuucaauuggaccggagugacacagaacggcaccucuuccgcuugcauccgcagaagcaauaacuccuuuuucucucggcugaauuggcucacacaucugaacuuuaaguauccugcccuuaacgucaccaugcccaauaacgagcaguucgacaagcuguacauuuggggcgugcaccauccugggacggauaaagaccagaucuuucucuaugcgcaagccagcggacgcauuacaguuucuaccaagagaucccagcaggcugugaucccgaauauuggcagccggccccgcgucagaaacaucccuucccggaucucuauuuacuggacaaucgugaaacccggggauauucugcugaucaauagcaccggaaaccucauugccccucgcggcuacuucaagaucagauccgggaaaagcucuaucaugcgguccgacgcucccauuggaaaguguaauagcgaaugcaucaccccgaacggcucuauuccuaaugacaagcccuuucagaacgugaaucgcaucacauauggcgccuguccuagauacgucaaacaaaacacgcugaaacuugcgaccgggaugcggaauguucccgagaagcagacacgcggaauuuucggcgccaucgcuggguuuaucgaaaacggaugggagggcaugguggaugggugguauggauucagacaccagaauagcgagggccggggccaagccgcugaccugaaguccacccaggccgccauugaucagaucaacgggaaacucaacagacugauuggaaagacaaaugaaaaauuccaccagaucgagaaggaauuuucugagguggaaggccgcauucaaaaccuugagaaguacgucgaggacaccaaaaucgaucuguggagcuauaaugcugaacuccugguggcgcuggagaaccagcauacgauugaccucacagauuccgaaaugaauaagcuguucgagaaaaccaagaaacagcuucgggaaaacgccgaggacauggggaauggaugcuuuaagaucuaccacaagugugauaacgcuugcaucggcagcauuagaaaugggaccuaugaccaugauguuuaccgcgacgaggcccugaacaaucgguuccagaucaaaggcguggaacucaagucuggauacaaagacuggauucuguggaucuccuuugccauuagcugcuuccuucugugugucgcucuccugggcuuuaucaugugggccugccaaaaggggaacaucagauguaauauuugcaucuga

SEQ ID NO: 193800 - RNA, 1701 nt, Artificial Sequence; identical to SEQ ID NO: 192098
  derived and/or modified sequence opt5 from hemagglutinin__InfluenzaA__AHC60599

SEQ ID NO: 193801 - RNA, 1701 nt, Artificial Sequence; identical to SEQ ID NO: 189879
  derived and/or modified sequence opt5 from hemagglutinin__InfluenzaA__AHC60611

SEQ ID NO: 193802 - RNA, 1701 nt, Artificial Sequence
  derived and/or modified sequence opt5 from hemagglutinin__InfluenzaA__AHC60623
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacuccagcuuuuucucucggcugaauuggcucacacaucugaacuuuaaguauccugcccuuaaugucaccaugcccaacaacgagcaguucgacaagcuguacauuuggggcgugcaccauccugggacggauaaagaccagaucuuucucuaugcgcaauccagcggacgcauuacaguuuccaccaagagaucucagcaggccgugaucccgaauauuggcagccggccccgcaucagaaacaucccuucccggauuagcaucuacuggacaauugucaaacccggggauauccugcugauuaauucuaccggaaaccucaucgcuccucgcggcuacuucaagaucagaaaugggaaauccagcauuaugcggucugacgcccccaucggaaaguguaacagcgaaugcauuaccccgaauggcuccaucccuaacgacaagcccuuucagaaugugaaccgcauuacauauggcgcuuguccuagauacgugaaacaaucuacgcugaaacuugccaccgggaugcggaauguccccgagaagcagacacgcggaaucuucggcgcgaucgccggguuuauugaaaacggaugggagggcaugguugaugggugguauggauucagacaccagaauagcgagggccggggccaagcugccgaccugaaguccacccaggcugccaucgaucagauuaacgggaaacucaauagacugaucggaaagacaaacgaaaaauuccaccagauugagaaggaauuuagcgagguggaaggccgcauccaagaccuugagaaguacguggaggauaccaaaauugaccuguggucuuauaacgccgaacuccuggucgcucuggagaaucagcauacgaucgaucucacagacuccgaaaugaacaagcuguucgagaaaaccaagaaacagcuucgggaaaaugcggaggauauggggaacggaugcuuuaagaucuaccacaagugugacaaugccugcauuggcagcaucagaaacgggaccuauaaucaugauguguaccgcgacgaggcucugaacaaucgguuccagauuaaaggcguugaacucaagucuggauacaaagacuggauccuguggauuuccuuugccaucagcugcuuccuucuguguguggcccuccugggcuuuaucaugugggcuugccaaaaggggaacauuagauguaauaucugcauuuga

SEQ ID NO: 193803 - RNA, 1701 nt, Artificial Sequence; identical to SEQ ID NO: 192098
  derived and/or modified sequence opt5 from hemagglutinin__InfluenzaA__AHC60635

SEQ ID NO: 193804 - RNA, 1701 nt, Artificial Sequence
  derived and/or modified sequence opt5 from hemagglutinin__InfluenzaA__AHC60647
augaagaccaucauugcccugagcuacauccucugccugguguucacacagaaacuucccggcaacgacaauuccacggcuacccugugucucgggcaccaugccgucccuaacggaacaauuguuaagaccaucacaaaugaucaaauugaggugaccaacgcgacagaacuggugcaaaauucuagcaccggcgagaucugcgacuccccgcaccagauccuugauggggaaaacuguacgcugauugacgcucuccugggagauccccagugcgacggcuuucagaauaaaaagugggaucuguucgucgagagaucuaaagccuauagcaacuguuacccuuaugacgugcccgauuacgccucccuccggucucugguugcuagcuccgggacccuugaauuuaauaacgagagcuucaauuggacaggagugacccagaacggcacaucuuccgccugcauccgcagaagcaauaacuccuuuuucucucggcugaauuggcucacccaucugaacuuuaaguauccugcucuuaacgucacgaugcccaauaacgagcaguucgacaagcuguacauuuggggcgugcaccauccugggacagauaaagaccagaucuuucucuaugcccaagcgagcggacgcauuaccguuucuacaaagagaucccagcaggccgugaucccgaauauuggcagccggccccgcgucagaaacaucccuucccggaucucuauuuacuggaccaucgugaaacccggggauauucugcugaucaauagcaccggaaaccucauugcuccucgcggcuacuucaagaucagauccgggaaaagcucuaucaugcgguccgacgcccccauuggaaaguguaauagcgaaugcaucacaccgaacggcucuauuccuaaugacaagcccuuucagaacgugaaucgcaucacguauggcgcuuguccuagauacgucaaacaaaacacccugaaacuugccacagggaugcggaauguucccgagaagcagacccgcggaauuuucggcgcgaucgccggguuuaucgaaaacggaugggagggcaugguggaugggugguauggauucagacaccagaauagcgagggccggggccaagcugccgaccugaaguccacacaggcugccauugaucagaucaacgggaaacucaacagacugauuggaaagaccaaugaaaaauuccaccagaucgagaaggaauuuucugagguggaaggccgcauucaagaccuugagaaguacgucgaggauacgaaaaucgaccuguggagcuauaacgccgaacuccugguggcucuggagaaucagcauacaauugaucucaccgacuccgaaaugaacaagcuguucgagaaaaccaagaaacagcuucgggaaaaugcggaggauauggggaacggaugcuuuaagaucuaccacaagugugacaaugccugcaucggcagcauuagaaacgggacauaugaucaugacguuuaccgcgacgaggcucugaauaaccgguuccagaucaaaggcguggaacucaagucuggauacaaagauuggauucuguggaucuccuuugccauuagcugcuuccuucugugugucgcccuccugggcuuuaucaugugggcuugccaaaaggggaauaucagauguaacauuugcaucuga

SEQ ID NO: 193805 - RNA, 1701 nt, Artificial Sequence
  derived and/or modified sequence opt5 from hemagglutinin__InfluenzaA__AHC60659
augaagaccaucauugcccugagcuacauccucugccugguguucacacagaaacuucccggcaacgacaauuccacggcuacccugugucucgggcaccaugccgucccuaacggaacaauuguuaagaccaucacaaaugaucaaauugaggugaccaacgcgacagaacuggugcagucuagcuccaccggcgagaucugcaauucuccgcaccagauccuugacggggaaaacuguacgcugauugaugcucuccugggagacccccagugcgauggcuuucaaaauaaaaagugggaccuguucgucgagagaagcaaagcccauuccaacuguuauccuuacgaugugcccgacuaugccucucuccggagccugguugcuuccagcgggacccuugaauuuaauaacgagucuuucaauuggacaggagugacccagaacggcacauccagcgccugcauccgcagaucuaauaacuccuuuuucagccggcugaauuggcucacccaccugaacuuuaaguacccugcucuuaacgucacgaugcccaauaacgagcaguucgauaagcuguauauuuggggcgugcaucacccugggacagacaaagaucagaucuuucucuacgcccaagcggccggacgcauuaccguuucuacaaagagaucccagcaggcugugaucccgaauauuggcagccggccccgcgucagaaacaucccuucccgggugucuaucuauuggaccauugugaaacccggggacauccugcugauuaauagcaccggaaaccucaucgccccucgcggcuacuucaagauuagauccgggaaaagcucuaucaugcgguccgaugcucccaucggaaaguguaauagcgccugcauuacaccgaacggcucuaucccuaaugacaagcccuuucagaacgucaaucgcauuacguacggcgcguguccuagauauguuaaacaaaacacccugaaacuugccacagggaugcggaaugugcccgaaaaacagacccgcggaaucuucggcgcuauugccggguuuaucgagaacggaugggaaggcaugguggacgggugguacggauucagacaccagaauagcgagggccggggccaagcugccgaucugaaguccacacaggccgcuaucgaccagauuaacgggaaacucaacagacugaucggaaagaccaaugagaaauuccaucagauugaaaaggaguuuucugaagucgagggccgcauccaagaucuugaaaaguauguggaggacacgaaaauugaucuguggagcuacaacgcggagcuccugguugcccuggaaaaucagcacacaaucgaccucaccgauuccgagaugaacaagcuguucgaaaagaccaagaaacagcuucgggagaaugcugaagacauggggaacggaugcuuuaagauuuaucauaagugugauaaugccugcaucggcagcaucagaaacgggacauacgaccacgauguguaucgcgacgaggcccugaauaaccgguuccagauuaaaggcgucgagcucaagucuggauacaaagacuggauccuguggauuuccuuugcuaucagcugcuuccuucuguguguggcccuccugggcuuuauuaugugggcgugccaaaaggggaauaucagauguaacaucugcauuuga

SEQ ID NO: 193806 - RNA, 1701 nt, Artificial Sequence
  derived and/or modified sequence opt5 from hemagglutinin__InfluenzaA__AHC60671
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaagagugggaccuguucgucgaaagaagcaaggcccauuccaacuguuauccuuacgaugugcccgacuaugcuucucuccggagccugguugccuccagcgggacgcuugaguuuaauaacgagucuuucaauuggaccggagugacacagaacggcaccuccagcgcuugcauccgcagaucuaauaacuccuuuuucagccggcugaauuggcucacacaccugaacuuuaaauacccugcccuuaacgucaccaugcccaauaacgaacaguucgauaagcuguauauuuggggcgugcaucacccugggacggacaaggaucagaucuuucucuacgcgcaagccucuggacgcauuacaguuuccaccaaaagaagccagcaggcugugaucccgaauauuggcucccggccccgcgucagaaacaucccuucucgggugagcaucuauuggacaauugugaagcccggggacauccugcugauuaauuccaccggaaaccucaucgccccucgcggcuacuucaaaauuagaagcgggaagucuuccaucaugcggagcgaugcucccaucggaaaauguaauucugccugcauuaccccgaacggcagcaucccuaaugacaagcccuuucagaacgucaaucgcauuacauacggcgcguguccuagauauguuaagcaaaacacgcugaaacuugccaccgggaugcggaaugugcccgagaagcagacacgcggaaucuucggcgcuauugccggguuuaucgaaaacggaugggagggcaugguggacgggugguacggauucagacaccaaaauuccgagggccggggccaggcugccgaucugaaaucuacccaggccgcuaucgaccagauuaacgggaagcucaacagacugaucggaaaaacaaaugaaaaguuccaucagauugagaaagaauuuagcgaggucgaaggccgcauccaagaucuugagaaguauguggaggacaccaagauugaucugugguccuacaacgcggaacuccugguugcccuggagaaucagcacacgaucgaccucacagauagcgaaaugaacaaacuguucgagaagaccaaaaagcagcuucgggaaaaugcugaggacauggggaacggaugcuuuaaaauuuaucauaagugugauaaugccugcaucggcucuaucagaaacgggaccuacgaccacgauguguaucgcgacgaggcccugaauaaccgguuccagauuaagggcgucgaacucaaauccggauacaaggacuggauccuguggauuagcuuugcuaucucuugcuuccuucuguguguggcccuccugggcuuuauuaugugggcgugccaaaaagggaauaucagauguaacaucugcauuuga

SEQ ID NO: 193807 - RNA, 1701 nt, Artificial Sequence
  derived and/or modified sequence opt5 from hemagglutinin__InfluenzaA__AHC60683
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccgcuggacgcauuacaguuucuaccaagagaucccagcaggccgugaucccgaauauuggcagccggccccgcgucagaaacaucccuucccgggugucuaucuauuggacaauugugaaacccggggacauccugcugauuaauagcaccggaaaccucaucgcuccucgcggcuacuucaagauuagauccgggaaaagcucuaucauccgguccgaugcccccauuggaaaguguaauagcgcgugcaucaccccgaacggcucuauuccuaaugacaagcccuuucagaacgucaaucgcaucacauacggcgccuguccuagauauguuaaacaaaacacgcugaaacuugcuaccgggaugcggaaugugcccgaaaaacagacacgcggaauuuucggcgccaucgcuggguuuaucgagaacggaugggaaggcaugguggacgggugguacggauucagacaccagaauagcgagggccggggccaagccgccgaucugaaguccacccaggcugcgauugaccagaucaacgggaaacucaacagacugauuggaaagacaaaugagaaauuccaucagaucgaaaaggaguuuucugaagucgagggccgcauucaagaucuugaaaaguauguggaggacaccaaaaucgaucuguggagcuacaacgccgagcuccugguugcucuggaaaaucagcacacgauugaccucacagauuccgagaugaacaagcuguucgaaaagaccaagaaacagcuucgggagaaugccgaagacauggggaacggaugcuuuaagaucuaucauaagugugauaaugccugcaucggcagcauuagaaacgggaccuacgaccacgauguguaucgcgacgaggcucugaauaaccgguuccagaucaaaggcgucgagcucaagucuggauacaaagacuggauucuguggaucuccuuugccauuagcugcuuccuucuguguguggcgcuccugggcuuuaucaugugggcuugccaaaaggggaauaucagauguaacauuugcaucuga

SEQ ID NO: 193808 - RNA, 1701 nt, Artificial Sequence
  derived and/or modified sequence opt5 from hemagglutinin__InfluenzaA__AHC60695
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcaugcgcggcucuaauaacuccuuuuucagcagacugaauuggcucacacaccugaacuuuaaguacccugcccuuaacgucaccaugcccaauaacgagcaguucgauaagcuguauaucuggggagugcaucacccugggacggacaaagaucagauuuuucucuacgcgcaagccucuggccggaucacaguuuccaccaagcgcagccagcaggcugugauuccgaauaucggguccagaccccggguccgcaacauuccuucuagagugagcaucuauuggacaaucgugaaacccggagacauucugcugaucaauuccaccggcaaccucauugccccucggggguacuucaagauccgcagcggaaaaucuuccauuaugagaagcgaugcucccaucggcaaguguaauucugccugcaucaccccgaacggcagcauuccuaaugacaagcccuuucagaacgucaaucggaucacauacggggcguguccucgcuauguuaaacaaaacacgcugaaacuugccaccggaaugagaaaugugcccgaaaaacagacacggggcauuuucggggcuaucgccggauuuauugagaacggcugggaagggaugguggacggaugguacggcuuccgccaccaaaauuccgagggcagagggcaggcugccgaucugaagucuacccaggccgcuaucgaccagaucaacggaaaacucaaccggcugauuggcaagacaaaugagaaauuccaucagaucgaaaaggaguuuagcgaagucgaggggcgcauucaagaucuugaaaaguauguggaggacaccaaaaucgaucugugguccuacaacgcggagcuccugguugcccuggaaaaucagcacacgauugaccucacagauagcgagaugaacaagcuguucgaaaagaccaagaaacagcuuagagagaaugcugaagacaugggaaacggcugcuuuaagaucuaucauaagugugauaaugccugcauugggucuauccggaacggcaccuacgaccacgauguguauagagacgaggcccugaauaaccgcuuccagaucaaaggagucgagcucaaguccggcuacaaagacuggauucuguggaucagcuuugcuauuucuugcuuccuucuguguguggcccuccugggguuuaucaugugggcgugccaaaagggaaauauucgguguaacaucugcaucuga

SEQ ID NO: 193809 - RNA, 1701 nt, Artificial Sequence
  derived and/or modified sequence opt5 from hemagglutinin__InfluenzaA__AHC60707
augaagaccaucauugcccugagcuacauccucugccugguguucgcucagaaacuucccggcaacgacaauuccacagccacgcugugucucgggcaccaugcggucccuaacggaaccauuguuaagacaaucaccgaugaccaaauugaggugacaaaugcuaccgaacuggugcagaacucuagcacaggcgagaucugcgauuccccgcaccagauccuugacggggaaaauuguacccugauugaugcccuccugggagacccccagugcgauggcuuucaaaacaaaaagugggaccuguucgucgagagaucuaaagccuauagcaauuguuacccuuaugaugugcccgacuacgcuucccuccggucucugguugccagcuccgggacgcuugaauuuaacaaugagagcuucaacuggaccggagugacacagaauggcaccucuuccgcuugcauccgcagaagcaacaauuccuuuuucucucggcugaacuggcucacacaucugaauuuuaaguauccugcccuuaacgucaccaugcccaacaaugagcaguucgauaagcuguacauuuggggcgugcaccauccugggacggacaaagaucagaucuuucucuaugcgcaagccagcggacgcauuacaguuucuaccaagagaucccagcaggcugugaucccgaacauuggcagccggccccgcgucagaaauaucccuucccggaucucuauuuacuggacaaucgugaaacccggggacauucugcugaucaacagcaccggaaaucucauugccccucgcggcuacuucaagaucagauccgggaaaagcucuaucaugcgguccgacgcucccauuggaaaguguaacagcgaaugcaucaccccgaauggcucuauuccuaacgauaagcccuuucagaaugugaaccgcaucacauauggcgccuguccuagauacgucaaacaaaauacgcugaaacuugcgaccgggaugcggaacguucccgagaagcagacacgcggaauuuucggcgccaucgcuggguuuaucgaaaauggaugggagggcaugguggacgggugguauggauucagacaccagaacagcgagggccggggccaagccgcugaucugaaguccacccaggccgccauugaccagaucaaugggaaacucaacagacugauuggaaagacaaacgaaaaauuccaccagaucgagaaggaauuuucugagguggaaggccgcauucaagaucuugagaaguacgucgaggacaccaaaaucgaucuguggagcuauaaugcugaacuccugguggcgcuggagaaccagcauacgauugaccucacagauuccgaaaugaauaagcuguucgagaaaaccaagaaacagcuucgggaaaacgccgaggacauggggaauggaugcuuuaagaucuaccacaagugugauaacgcuugcaucggcagcauuagaaaugggaccuaugaccaugacguuuaccgcgaugaggcccugaacaaucgguuccagaucaaaggcguggaacucaagucuggauacaaagacuggauuaucuggauuuccuuugccaucagcugcuuccugcuuugugucgcucugcucggcuuuaucaugugggccugccaaaaggggaacauuagauguaauaucugcauuuga

SEQ ID NO: 193810 - RNA, 1701 nt, Artificial Sequence; identical to SEQ ID NO: 189879
  derived and/or modified sequence opt5 from hemagglutinin__InfluenzaA__AHC60719

SEQ ID NO: 193811 - RNA, 1701 nt, Artificial Sequence; identical to SEQ ID NO: 190006
  derived and/or modified sequence opt5 from hemagglutinin__InfluenzaA__AHC60731

SEQ ID NO: 193812 - RNA, 1701 nt, Artificial Sequence; identical to SEQ ID NO: 193717
  derived and/or modified sequence opt5 from hemagglutinin__InfluenzaA__AHC60743

SEQ ID NO: 193813 - RNA, 1701 nt, Artificial Sequence; identical to SEQ ID NO: 186435
  derived and/or modified sequence opt5 from hemagglutinin__InfluenzaA__AHC60767

SEQ ID NO: 193814 - RNA, 1701 nt, Artificial Sequence
  derived and/or modified sequence opt5 from hemagglutinin__InfluenzaA__AHC60779
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagcgcuucaauuggaccggagugacacagaacggcaccucuuccgcuugcaucagacggagcaauaacagcuuuuucucccgccugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccgcuggaagaauuacaguuagcaccaagcggucucagcaggccgugaucccgaauauuggcucccgccccagaguccggaacaucccuagccgcguguccaucuauuggacaauugugaaacccggggacauccugcugauuaauucuaccggaaaccucaucgcuccuagaggcuacuucaagauucggagcgggaaauccagcaucaugcgcucugaugcccccaucggaaaguguaauuccgcgugcauuaccccgaacggcagcaucccuaaugacaagcccuuucagaacgucaauagaauuacauacggcgccuguccucgguauguuaaacaaaacacgcugaaacuugcuaccgggaugcgcaaugugcccgaaaaacagacaagaggaaucuucggcgccauugcuggguuuaucgagaacggaugggaaggcaugguggacgggugguacggauuccggcaccaaaauucugagggcagaggccaggccgccgaucugaagucuacccaggcugcgaucgaccagauuaacgggaaacucaaccgccugaucggaaagacaaaugagaaauuccaucagauugaaaaggaguuuuccgaagucgagggccggauccaagaucuugaaaaguauguggaggacaccaaaauugaucuguggucuuacaacgccgagcuccugguugcucuggaaaaucagcacacgaucgaccucacagauagcgagaugaacaagcuguucgaaaagaccaagaaacagcuuagagagaaugccgaagacauggggaacggaugcuuuaagauuuaucauaagugugauaaugccugcaucggcuccauccgcaacgggaccuacgaccacgauguguaucgggacgaggcucugaauaacagauuccagauuaaaggcgucgagcucaagagcggauacaaagacuggauccuguggauuucuuuugccaucuccugcuuccuucuguguguggcgcuccugggcuuuauuaugugggcuugccaaaaggggaauauccgcuguaacaucugcauuuga

SEQ ID NO: 193815 - RNA, 1701 nt, Artificial Sequence; identical to SEQ ID NO: 190006
  derived and/or modified sequence opt5 from hemagglutinin__InfluenzaA__AHC60791

SEQ ID NO: 193816 - RNA, 1701 nt, Artificial Sequence; identical to SEQ ID NO: 193675
  derived and/or modified sequence opt5 from hemagglutinin__InfluenzaA__AHC60803

SEQ ID NO: 193817 - RNA, 1701 nt, Artificial Sequence; identical to SEQ ID NO: 189879
  derived and/or modified sequence opt5 from hemagglutinin__InfluenzaA__AHC60815

SEQ ID NO: 193818 - RNA, 1701 nt, Artificial Sequence
  derived and/or modified sequence opt5 from hemagglutinin__InfluenzaA__AHC60827
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacagacgagaucugcaauucuccgcaccagauccuugauggcgaaaacuguacccugauugacgcccuccugggggauccccagugcgacggauuucaaaauaaaaagugggaucuguucgucgagagaagcaaagcccauuccaacuguuauccuuacgacgugcccgauuaugcuucucuccggagccugguugccuccagcggcacgcuugaauuuaauaacgagucuuucaauuggaccggggugacacagaacggaaccuccagcgcuugcauccgcggcucuaauaacuccuuuuucagcagacugaauuggcucacacaccugaacuuuaaguacccugcccuuaacgucaccaugcccaauaacgagcaguucgacaagcuguauauuuggggcgugcaucacccugggacggauaaagaccagaucuuucucuacgcgcaagccucuggacggauuacaguuuccaccaagcgcagccagcaggcugugaucccgaauauuggcuccagaccccggguccgcaacaucccuucuagagugagcaucuauuggacaauugugaaacccggggauauccugcugauuaauuccaccggaaaccucaucgccccucggggcuacuucaagauucgcagcgggaaaucuuccaucaugagaagcgacgcucccaucggaaaguguaauucugccugcauuaccccgaacggcagcaucccuaaugacaagcccuuucagaacgucaaucggauuacauacggcgcguguccucgcuauguuaaacaaaacacgcugaaacuugccaccgggaugagaaaugugcccgaaaaacagacacggggaaucuucggcgcuauugccggguuuaucgagaacggaugggaaggcaugguggaugggugguacggauuccgccaccaaaauuccgagggcagaggccaggcugccgaccugaagucuacccaggccgcuaucgaucagauuaacgggaaacucaaccggcugaucggaaagacaaaugagaaauuccaucagauugaaaaggaguuuagcgaagucgagggcagaauccaagaccuugaaaaguauguggaggauaccaaaauugaccugugguccuacaacgcggagcuccugguugcccuggaaaaucagcacacgaucgaucucacagacagcgagaugaacaagcuguucgaaaagaccaagaaacagcuucgcgagaaugcugaagauauggggaacggaugcuuuaagauuuaucauaagugugacaaugccugcaucggcucuauccggaacgggaccuacgaucacgacguguauagagacgaggcccugaauaaccgcuuccagauuaaaggcgucgagcucaaguccggauacaaagauuggauccuguggauuagcuuugcuaucucuugcuuccuucuguguguggcccuccugggcuuuauuaugugggcgugccaaaaggggaauauccgguguaacaucugcauuuga

SEQ ID NO: 193819 - RNA, 1701 nt, Artificial Sequence; identical to SEQ ID NO: 193653
  derived and/or modified sequence opt5 from hemagglutinin__InfluenzaA__AHC60839

SEQ ID NO: 193820 - RNA, 1701 nt, Artificial Sequence; identical to SEQ ID NO: 190006
  derived and/or modified sequence opt5 from hemagglutinin__InfluenzaA__AHC60851

SEQ ID NO: 193821 - RNA, 1701 nt, Artificial Sequence
  derived and/or modified sequence opt5 from hemagglutinin__InfluenzaA__AHC60863
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccgcuggacgcauuacaguuucuaccaagagaucccagcaggccgugaucccgaauauuggcagccggccccgcgucagaaacaucccuucccgggugucuaucuauuggacaauugugaaacccggggacauccugcugauuaauagcaccggaaaccucaucgcuccucgcggcuacuucaagauuagauccgggaaaagcucuaucaugcgguccgaugcccccaucggaaaguguaauagcgcgugcauuaccccgaacggcucuaucccuaaugacaagcccuuucagaacgucaaucgcauuacauacggcgccuguccuagauauguuaaacaaaacacgcugaaacuugcuaccgggaugcggaaugugcccgaaaaacagacacgcggaaucuucggcgccauugcuggguuuaucgagaacggaugggaaggcaugguggacgggugguacggauucagacaccagaauagcgagggccggggccaagccgccgaucugaaguccacccaggcugcgaucgaccagauuaacgggaaacucaacagacugaucggaaagacaaaugagaaauuccaucagauugaaaaggaguuuucugaagucgagggccgcauccaagaucuugaaaaguauguggaggacaccaaaauugaucuguggagcuacaacgccgagcuccugguugcucuggaaaaucagcacacgaucgaccucacagauuccgagaugaacaagcuguucgaaaagaccaagaaacagcuucgggagaaugccgaagacauggggaacggaugcuuuaagauuuaucauaagugugauaaugccugcaucggcagcaucagaaacgggaccuacgaccacgauguguaucgcgacgaggcucugaauaaccgguuccagauuaaaggcgucgagcucaaggccggauacaaagacuggauccuguggauuucuuuugcgaucuccugcuuccuucuguguguggcucuccugggcuuuauuaugugggccugccaaaaggggaauaucagauguaacaucugcauuuga

SEQ ID NO: 193822 - RNA, 1701 nt, Artificial Sequence; identical to SEQ ID NO: 190006
  derived and/or modified sequence opt5 from hemagglutinin__InfluenzaA__AHC60875

SEQ ID NO: 193823 - RNA, 1701 nt, Artificial Sequence; identical to SEQ ID NO: 190006
  derived and/or modified sequence opt5 from hemagglutinin__InfluenzaA__AHC60887

SEQ ID NO: 193824 - RNA, 1701 nt, Artificial Sequence; identical to SEQ ID NO: 186435
  derived and/or modified sequence opt5 from hemagglutinin__InfluenzaA__AHC60899

SEQ ID NO: 193825 - RNA, 1701 nt, Artificial Sequence; identical to SEQ ID NO: 190806
  derived and/or modified sequence opt5 from hemagglutinin__InfluenzaA__AHC60911

SEQ ID NO: 193826 - RNA, 1701 nt, Artificial Sequence; identical to SEQ ID NO: 193642
  derived and/or modified sequence opt5 from hemagglutinin__InfluenzaA__AHC60923

SEQ ID NO: 193827 - RNA, 1701 nt, Artificial Sequence; identical to SEQ ID NO: 190806
  derived and/or modified sequence opt5 from hemagglutinin__InfluenzaA__AHC60935

SEQ ID NO: 193828 - RNA, 1701 nt, Artificial Sequence; identical to SEQ ID NO: 190006
  derived and/or modified sequence opt5 from hemagglutinin__InfluenzaA__AHC60947

SEQ ID NO: 193829 - RNA, 1701 nt, Artificial Sequence; identical to SEQ ID NO: 190806
  derived and/or modified sequence opt5 from hemagglutinin__InfluenzaA__AHC60959

SEQ ID NO: 193830 - RNA, 1701 nt, Artificial Sequence; identical to SEQ ID NO: 189879
  derived and/or modified sequence opt5 from hemagglutinin__InfluenzaA__AHC60971

SEQ ID NO: 193831 - RNA, 1701 nt, Artificial Sequence; identical to SEQ ID NO: 190806
  derived and/or modified sequence opt5 from hemagglutinin__InfluenzaA__AHC60983

SEQ ID NO: 193832 - RNA, 1701 nt, Artificial Sequence; identical to SEQ ID NO: 190006
  derived and/or modified sequence opt5 from hemagglutinin__InfluenzaA__AHC61007

SEQ ID NO: 193833 - RNA, 1701 nt, Artificial Sequence; identical to SEQ ID NO: 189879
  derived and/or modified sequence opt5 from hemagglutinin__InfluenzaA__AHC61019

SEQ ID NO: 193834 - RNA, 1701 nt, Artificial Sequence
  derived and/or modified sequence opt5 from hemagglutinin__InfluenzaA__AHC61031
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccgcuggacgcauuacaguuucuaccaagagaucccagcaggccgugaucccgaauauuggcagccggccccgcgucagaaacaucccuucccgggugucuaucuauuggacaauugugaaacccggggacauccugcugauuaauagcaccggaaaccucaucgcuccucgcggcuacuucaagauuagauccgggaaaagcucuaucaugcgguccgaugcccccaucggaaaguguaauagcgcgugcauuaccccgaacggcucuaucccuaaugacaagcccuuucagaacgucaaucgcauuacauacggcgccuguccuagauauguuaaacaaaacacgcugaaacuugcuaccgggaugcggaaugugcccgaaaaacagacacgcggaaucuucggcgccauugcuggguuuaucgagaacggaugggaaggcaugguggacgggugguacggauucagacaccagaauagcgagggccggggccaagccgccgaucugaaguccacccaggcugcgaucgaccagauuaacgggaaacucaacagacugaucggaaagacaaaugagaaauuccaucagauugaaaaggaguuuucugaagucgagggccgcauccaagaucuugaaaaguauguggaggacaccaaaauugaucuguggagcuacaacgccgagcuccugguugcucuggaaaaucagcacacgaucgaccucacagauuccgagaugaacaagcuguucgaaaagaccaagaaacagcuucgggagaaugccgaagacauggggaacggaugcuuuaagauuuaucauaagugugauaaugccugcaucggcagcaucagaaacgggaccuacgaccacgauguguaucgcgacgaggcucugaauaaccgguuccagauuaaaggcgucgagcucaagucuggauacaaagacuggauccuguggauuuccuuugccaucagcugcuuccuucugugugugguucuccugggcuuuauuaugugggcgugccaaaaggggaauaucagauguaacaucugcauuuga

SEQ ID NO: 193835 - RNA, 1701 nt, Artificial Sequence; identical to SEQ ID NO: 190806
  derived and/or modified sequence opt5 from hemagglutinin__InfluenzaA__AHC61043

SEQ ID NO: 193836 - RNA, 1701 nt, Artificial Sequence
  derived and/or modified sequence opt5 from hemagglutinin__InfluenzaA__AHC61055
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccgcuggacgcauuacaguuucuaccaagagaucccagcaggccgugaucccgaauauuggcagccggccccgcgucagaaacaucccuucccgggugucuaucuauuggacaauugugaaacccggggacauccugcugauuaauagcaccggaaaccucaucgcuccucgcggcuacuucaagauuagauccgggaaaagcucuaucaugcgguccgaugcccccaucggaaaguguaauagcgcgugcauuaccccgaacggcucuaucccuaaugacaagcccuuucagaacgucaaucgcauuacauacggcgccuguccuagauauguuaaacaaaacacgcugaaacuugcuaccgggaugcggaaugugcccgaaaaacagacacgcggaaucuucggcgccauugcuggguuuaucgagaacggaugggaaggcaugguggacgggugguacggauucagacaccagaauagcgagggccggggccaagccgccgaucugaaguccacccaggcugcgaucgaccagauuaacgggaaacucaacagacugaucggaaagacaaaugagaaauuccaucagauugaaaaggaguuuucugaagucgagggccgcauccaaaaccuugaaaaguauguggaggauaccaaaauugaccuguggagcuacaaugccgagcuccugguugcucuggaaaaccagcacacgaucgaucucacagacuccgagaugaauaagcuguucgaaaagaccaagaaacagcuucgggagaacgccgaagauauggggaauggaugcuuuaagauuuaucauaagugugacaacgccugcaucggcagcaucagaaaugggaccuacgaucacgacguguaucgcgaugaggcucugaacaaucgguuccagauuaaaggcgucgagcucaagucuggauacaaagacuggauccuguggauuuccuuugccaucagcugcuuccuucuguguguggcgcuccugggcuuuauuaugugggcuugccaaaaggggaacaucagauguaauaucugcauuuga

SEQ ID NO: 193837 - RNA, 1701 nt, Artificial Sequence; identical to SEQ ID NO: 193703
  derived and/or modified sequence opt5 from hemagglutinin__InfluenzaA__AHC61067

SEQ ID NO: 193838 - RNA, 1701 nt, Artificial Sequence; identical to SEQ ID NO: 192098
  derived and/or modified sequence opt5 from hemagglutinin__InfluenzaA__AHC61079

SEQ ID NO: 193839 - RNA, 1701 nt, Artificial Sequence; identical to SEQ ID NO: 190006
  derived and/or modified sequence opt5 from hemagglutinin__InfluenzaA__AHC61103

SEQ ID NO: 193840 - RNA, 1701 nt, Artificial Sequence; identical to SEQ ID NO: 190006
  derived and/or modified sequence opt5 from hemagglutinin__InfluenzaA__AHC61115

SEQ ID NO: 193841 - RNA, 1701 nt, Artificial Sequence; identical to SEQ ID NO: 190806
  derived and/or modified sequence opt5 from hemagglutinin__InfluenzaA__AHC61127

SEQ ID NO: 193842 - RNA, 1701 nt, Artificial Sequence
  derived and/or modified sequence opt5 from hemagglutinin__InfluenzaA__AHC61139
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccacccagagaagccagcaggcugugaucccgaauauuggcucccggccccgcgucagaaacaucccuucucgggugagcaucuauuggacaauugugaagcccggggacauccugcugauuaauuccaccggaaaccucaucgccccucgcggcuacuucaaaauuagaagcgggaagucuuccaucaugcggagcgaugcucccaucggaaaauguaauucugccugcauuaccccgaacggcagcaucccuaaugacaagcccuuucaaaacgucaaucgcauuacauacggcgcguguccuagauauguuaagcagaacacgcugaaacuugccaccgggaugcggaaugugcccgaaaagcagacacgcggaaucuucggcgcuauugccggguuuaucgagaacggaugggaaggcaugguggacgggugguacggauucagacaccaaaauuccgagggccggggccaggcugccgaucugaaaucuacccaggccgcuaucgaccagauuaacgggaagcucaacagacugaucggaaaaacaaaugagaaguuccaucaaauugaaaaagaguuuagcgaagucgagggccgcauccaggaucuugaaaaguauguggaggacaccaagauugaucugugguccuacaacgcggagcuccugguugcccuggaaaaucagcacacgaucgaccucacagauagcgagaugaacaaacuguucgaaaagaccaaaaagcagcuucgggagaaugcugaagacauggggaacggaugcuuuaaaauuuaucauaagugugauaaugccugcaucggcucuaucagaaacgggaccuacaaucacgacguguaucgcgaugaggcccugaacaaucgguuccaaauuaagggcgucgagcucaaauccggauacaaggacuggauccuguggauuagcuuugcuaucucuugcuuccuucuguguguggcccuccugggcuuuauuaugugggcgugccagaaagggaacaucagauguaauaucugcauuuga

SEQ ID NO: 193843 - RNA, 1701 nt, Artificial Sequence; identical to SEQ ID NO: 190006
  derived and/or modified sequence opt5 from hemagglutinin__InfluenzaA__AHC61151

SEQ ID NO: 193844 - RNA, 1701 nt, Artificial Sequence
  derived and/or modified sequence opt5 from hemagglutinin__InfluenzaA__AHC61163
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaagaaugagucuuucaacuggaccggagugacacagaauggcaccuccagcgcuugcauccgcagaucuaacaauuccuuuuucagccggcugaacuggcucacacaccugaauuuuaaguacccugcccuuaacgucaccaugcccaacaaugagcaguucgauaaacuguauauuuggggcgugcaucacccugggacggacaaggaucagaucuuucucuacgcgcaagccucuggacgcauuacaguuuccaccaaaagaagccagcaggcuguggucccgaacaucggcucccggccccgcgugagaaauauuccuucucgggugagcaucuauuggacaaucgucaagcccggggacauucugcugaucaacuccaccggaaaucucauugccccucgcggcuacuucaaaaucagaagcgggaagucuuccauuaugcggagcgaugcucccaucggaaaguguaacucugccugcaucaccccgaauggcagcauuccuaacgacaaacccuuucagaauguuaaccgcaucacauacggcgcguguccuagauaugugaagcaaaauacgcugaaacuugccaccgggaugcggaacgugcccgaaaagcagacacgcggaauuuucggcgcuaucgccggguuuauugagaauggaugggaaggcauggucgacgggugguacggauucagacaccagaacuccgagggccggggccaagcugccgaucugaaaucuacccaggccgcuaucgaccagaucaaugggaagcucaacagacugauuggaaaaacaaacgagaaguuccaucagaucgaaaaggaguuuagcgaaguggagggccgcauucaagaucuugaaaaauauguugaggacaccaagaucgaucugugguccuacaaugcggagcuccugguggcccuggaaaaccagcacacgauugaccucacagauagcgagaugaauaaacuguucgaaaagaccaaaaagcagcuucgggagaacgcugaagacauggggaauggaugcuuuaagaucuaucauaaaugugauaacgccugcauuggcucuaucagaaaugggaccuacgaccacgaugucuaucgcgacgaggcccugaacaaucgguuccagaucaagggcguggagcucaaauccggauacaaggacuggauucuguggaucagcuuugcuauuucuugcuuccuucuguguguugcccuccugggcuuuaucaugugggcgugccaaaaagggaacauuagauguaauaucugcaucuga

SEQ ID NO: 193845 - RNA, 1701 nt, Artificial Sequence; identical to SEQ ID NO: 190806
  derived and/or modified sequence opt5 from hemagglutinin__InfluenzaA__AHC61175

SEQ ID NO: 193846 - RNA, 1701 nt, Artificial Sequence; identical to SEQ ID NO: 190006
  derived and/or modified sequence opt5 from hemagglutinin__InfluenzaA__AHC61187

SEQ ID NO: 193847 - RNA, 1701 nt, Artificial Sequence; identical to SEQ ID NO: 189879
  derived and/or modified sequence opt5 from hemagglutinin__InfluenzaA__AHC61199

SEQ ID NO: 193848 - RNA, 1701 nt, Artificial Sequence; identical to SEQ ID NO: 193642
  derived and/or modified sequence opt5 from hemagglutinin__InfluenzaA__AHC61211

SEQ ID NO: 193849 - RNA, 1701 nt, Artificial Sequence; identical to SEQ ID NO: 189879
  derived and/or modified sequence opt5 from hemagglutinin__InfluenzaA__AHC61223

SEQ ID NO: 193850 - RNA, 1701 nt, Artificial Sequence; identical to SEQ ID NO: 190006
  derived and/or modified sequence opt5 from hemagglutinin__InfluenzaA__AHC61235

SEQ ID NO: 193851 - RNA, 1701 nt, Artificial Sequence; identical to SEQ ID NO: 190806
  derived and/or modified sequence opt5 from hemagglutinin__InfluenzaA__AHC61247

SEQ ID NO: 193852 - RNA, 1701 nt, Artificial Sequence; identical to SEQ ID NO: 190806
  derived and/or modified sequence opt5 from hemagglutinin__InfluenzaA__AHC61259

SEQ ID NO: 193853 - RNA, 1701 nt, Artificial Sequence; identical to SEQ ID NO: 190006
  derived and/or modified sequence opt5 from hemagglutinin__InfluenzaA__AHC61271

SEQ ID NO: 193854 - RNA, 1701 nt, Artificial Sequence; identical to SEQ ID NO: 189879
  derived and/or modified sequence opt5 from hemagglutinin__InfluenzaA__AHC61283

SEQ ID NO: 193855 - RNA, 1701 nt, Artificial Sequence; identical to SEQ ID NO: 192098
  derived and/or modified sequence opt5 from hemagglutinin__InfluenzaA__AHC61295

SEQ ID NO: 193856 - RNA, 1701 nt, Artificial Sequence; identical to SEQ ID NO: 193710
  derived and/or modified sequence opt5 from hemagglutinin__InfluenzaA__AHC61307

SEQ ID NO: 193857 - RNA, 1701 nt, Artificial Sequence; identical to SEQ ID NO: 190006
  derived and/or modified sequence opt5 from hemagglutinin__InfluenzaA__AHC61319

SEQ ID NO: 193858 - RNA, 1701 nt, Artificial Sequence; identical to SEQ ID NO: 193642
  derived and/or modified sequence opt5 from hemagglutinin__InfluenzaA__AHC61331

SEQ ID NO: 193859 - RNA, 1701 nt, Artificial Sequence
  derived and/or modified sequence opt5 from hemagglutinin__InfluenzaA__AHC61343
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcggcucuaauaacuccuuuuucagcagacugaauuggcucacacaccugaacuuuaaguacccugcccuuaacgucaccaugcccaauaacgagcaguucgauaagcuguauauuuggggagugcaucacccugggacggacaaagaucagaucuuucucuacgcgcaagccucuggccggauuacaguuuccaccaagcgcagccagcaggcugugaucccgaauauuggguccagaccccggguccgcaacaucccuucuagaaucagcauuuauuggacaaucgugaaacccggagacauucugcugaucaauuccaccggcaaccucauugccccucggggguacuucaagauccgcagcggaaaaucuuccaucaugagaagcgaugcucccauuggcaaguguaauucugccugcaucaccccgaacggcagcauuccuaaugacaagcccuuucagaacgugaaucggaucacauacggggcguguccucgcuaugucaaacaaaacacgcugaaacuugccaccggaaugagaaauguucccgaaaaacagacacggggcauuuucggggcuaucgccggauuuaucgagaacggcugggaagggaugguggacggaugguacggcuuccgccaccaaaauuccgagggcagagggcaggcugccgaucugaagucuacccaggccgcuauugaccagaucaacggaaaacucaaccggcugauuggcaagacaaaugagaaauuccaucagaucgaaaaggaguuuagcgaaguggaggggcgcauucaagaucuugaaaaguaugucgaggacaccaaaaucgaucugugguccuacaacgcggagcuccugguggcccuggaaaaucagcacacgauugaccucacagauagcgagaugaacaagcuguucgaaaagaccaagaaacagcuuagagagaaugcugaagacaugggaaacggcugcuuuaagaucuaucauaagugugauaaugccugcaucgggucuauucggaacggcaccuacgaccacgauguuuauagagacgaggcccugaauaaccgcuuccagaucaaaggaguggagcucaaguccggcuacaaagacuggauucuguggaucagcuuugcuauuucuugcuuccuucugugugucgcccuccugggguuuaucaugugggcgugccaaaagggaaauauccgguguaacauuugcaucuga

SEQ ID NO: 193860 - RNA, 1701 nt, Artificial Sequence; identical to SEQ ID NO: 189879
  derived and/or modified sequence opt5 from hemagglutinin__InfluenzaA__AHC61355

SEQ ID NO: 193861 - RNA, 1701 nt, Artificial Sequence; identical to SEQ ID NO: 189879
  derived and/or modified sequence opt5 from hemagglutinin__InfluenzaA__AHC61367

SEQ ID NO: 193862 - RNA, 1701 nt, Artificial Sequence; identical to SEQ ID NO: 190006
  derived and/or modified sequence opt5 from hemagglutinin__InfluenzaA__AHC61379

SEQ ID NO: 193863 - RNA, 1701 nt, Artificial Sequence; identical to SEQ ID NO: 189879
  derived and/or modified sequence opt5 from hemagglutinin__InfluenzaA__AHC61391

SEQ ID NO: 193864 - RNA, 1701 nt, Artificial Sequence
  derived and/or modified sequence opt5 from hemagglutinin__InfluenzaA__AHC61403
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccaccaagagaagccagcaggcugugaucccgaauauuggcucccggccccgcgucagaaacaucccuucucgggugagcaucuauuggacaauugugaaacccggggacauccugcugauuaauuccaccggaaaccucaucgccccucgcggcuacuucaagauuagaagcgggaaaucuuccaucaugcggagcgaugcucccaucggaaaguguaauucugccugcauuaccccgaacggcagcaucccuaaugacaagcccuuucagaacgucaaucgcauuacauacggcgcguguuccagauauguuaaacaaaacacgcugaaacuugccaccgggaugcggaaugugccugaaaaacagacacgcggaaucuucggcgcuauugccggguuuaucgagaacggaugggaaggcaugguggacgggugguacggauucagacaccagaauagcgagggccggggccaagcugccgaucugaagucuacccaggccgcuaucgaccagauuaacgggaaacucaacagacugaucggaaagacaaaugagaaauuccaucagauugaaaaggaguuuuccgaagucgagggccgcauccaagaucuugaaaaguauguggaggacaccaaaauugaucuguggagcuacaacgcggagcuccugguugcccuggaaaaucagcacacgaucgaccucacagauucugagaugaacaagcuguucgaaaagaccaagaaacagcuucgggagaaugcugaagacauggggaacggaugcuuuaagauuuaucauaagugugauaaugccugcaucggcuccaucagaaacgggaccuacgaccacgauguguaucgcgacgaggcccugaauaaccgguuccagauuaaaggcgucgagcucaagagcggauacaaagacuggauccuguggauuucuuuugcuaucuccugcuuccuucuguguguggcccuccugggcuuuauuaugugggcgugccaaaaggggaauaucagauguaacaucugcauuuga

SEQ ID NO: 193865 - RNA, 1701 nt, Artificial Sequence; identical to SEQ ID NO: 190006
  derived and/or modified sequence opt5 from hemagglutinin__InfluenzaA__AHC61415

SEQ ID NO: 193866 - RNA, 1701 nt, Artificial Sequence
  derived and/or modified sequence opt5 from hemagglutinin__InfluenzaA__AHC61427
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaacaaaugggaccuguucgucgagagaagcaaggcccauuccaauuguuauccuuacgaugugcccgacuaugcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaccugaacuuuaaauacccugcccuuaaugucaccaugcccaacaaugagcaguucgauaagcuguauauuuggggcgugcaucacccugggacggacaaggaucagaucuuucucuacgcgcaagccgcuggacgcauuacaguuucuaccaaaagaucccagcaggccgugaucccgaacauuggcagccggccccgcgucagaaauaucccuucccgggugucuaucuauuggacaauugugaagcccggggacauccugcugauuaacagcaccggaaaucucaucgcuccucgcggcuacuucaaaauuagauccggaaagagcucuaucauccgguccgaugcccccauugggaaauguaacagcgcgugcaucaccccgaauggcucuauuccuaacgacaagcccuuucagaaugucaaccgcaucacauacggcgccuguccuagauauguuaagcaaaauacgcugaaacuugcuaccgggaugcggaacgugcccgaaaagcagacacgcggaauuuucggcgccaucgcuggguuuaucgagaauggaugggaaggcaugguggacgggugguacggauucagacaccagaacagcgagggccggggccaagccgccgaucugaaauccacccaggcugcgauugaccagaucaacgggaagcucaauagacugauuggaaaaacaaacgagaaguuccaucagaucgaaaaagaguuuucugaagucgagggccgcauucaagaucuugaaaaguauguggaggacaccaagaucgaucuguggagcuacaaugccgagcuccugguugcucuggaaaaccagcacacgauugaccucacagauuccgagaugaauaaacuguucgaaaagaccaaaaagcagcuucgggagaacgccgaagacauggggaauggaugcuuuaaaaucuaucauaagugugauaacgccugcaucggcagcauuagaaaugggaccuacgaccacgauguguaucgcgacgaggcucugaacaaucgguuccagaucaagggcgucgagcucaaaucuggauacaaggacuggauucuguggaucuccuuugccauuagcugcuuccuucuguguguggcgcuccugggcuuuaucaugugggcuugccaaaaagggaacaucagauguaauauuugcaucuga

SEQ ID NO: 193867 - RNA, 1701 nt, Artificial Sequence
  derived and/or modified sequence opt5 from hemagglutinin__InfluenzaA__AHC61439
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccgcuggacgcauuacaguuucuaccaagagaucccagcaggccgugaucccgaauauuggcagccggccccgcgucagaaacaucccuucccgggugucuaucuauuggacaauugugaaacccggggacauccugcugauuaauagcaccggaaaccucaucgcuccucgcggcuacuucaagauuagauccgggaaaagcucuaucaugcgguccgaugcccccaucggaaaguguaauucuaccugcauuacaccgaacggcagcaucccuaaugacaagcccuuucagaacgucaaucgcauuacguacggcgcguguccuagauauguuaaacaaaacacccugaaacuugccacagggaugcggaaugugcccgaaaaacagacccgcggaaucuucggcgcuauugccggguuuaucgagaacggaugggaaggcaugguggacgggugguacggauucagacaccagaauagcgagggccggggccaagcugccgaucugaaguccacacaggccgcuaucgaccagauuaacgggaaacucaacagacugaucggaaagaccaaugagaaauuccaucagauugaaaaggaguuuucugaagucgagggccgcauccaagaucuugaaaaguauguggaggacacgaaaauugaucuguggagcuacaacgcggagcuccugguugcccuggaaaaucagcacacaaucgaccucaccgauuccgagaugaacaagcuguucgaaaagaccaagaaacagcuucgggagaaugcugaagacauggggaacggaugcuuuaagauuuaucauaagugugauaaugccugcaucggcagcaucagaaacgggacauacgaccacgauguguaucgcgacgaggcccugaauaaccgguuccagauuaaaggcgucgagcucaagucuggauacaaagacuggauccuguggauuuccuuugcuaucagcugcuuccuucuguguguggcccuccugggcuuuauuaugugggcgugccaaaaggggaauaucagauguaacaucugcauuuga

SEQ ID NO: 193868 - RNA, 1701 nt, Artificial Sequence; identical to SEQ ID NO: 189879
  derived and/or modified sequence opt5 from hemagglutinin__InfluenzaA__AHC61451

SEQ ID NO: 193869 - RNA, 1701 nt, Artificial Sequence; identical to SEQ ID NO: 189879
  derived and/or modified sequence opt5 from hemagglutinin__InfluenzaA__AHC61463

SEQ ID NO: 193870 - RNA, 1701 nt, Artificial Sequence; identical to SEQ ID NO: 190806
  derived and/or modified sequence opt5 from hemagglutinin__InfluenzaA__AHC61475

SEQ ID NO: 193871 - RNA, 1701 nt, Artificial Sequence; identical to SEQ ID NO: 190006
  derived and/or modified sequence opt5 from hemagglutinin__InfluenzaA__AHC61487

SEQ ID NO: 193872 - RNA, 1701 nt, Artificial Sequence; identical to SEQ ID NO: 190806
  derived and/or modified sequence opt5 from hemagglutinin__InfluenzaA__AHC61499

SEQ ID NO: 193873 - RNA, 1701 nt, Artificial Sequence; identical to SEQ ID NO: 189879
  derived and/or modified sequence opt5 from hemagglutinin__InfluenzaA__AHC61511

SEQ ID NO: 193874 - RNA, 1701 nt, Artificial Sequence; identical to SEQ ID NO: 192098
  derived and/or modified sequence opt5 from hemagglutinin__InfluenzaA__AHC61523

SEQ ID NO: 193875 - RNA, 1701 nt, Artificial Sequence
  derived and/or modified sequence opt5 from hemagglutinin__InfluenzaA__AHC61535
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccaccaagagaagccagcaggcugugaucccgaauauuggcucccggccccgcgucagaaacaucccuucucgggugagcaucuauuggacaauugugaaacccggggacauccugcugauuaauuccaccggaaaccucaucgccccucgcggcuacuucaagauuagaagcgggaaaucuuccaucaugcggagcgaugcucccaucggaaaguguaauucugccugcauuaccccgaacggcagcaucccuaaugacaagcccuuucagaacgucaaucgcauuacauacggcgcguguccuagauauguuaaacaaaacacgcugaaacuugccaccgggaugcggaaugugcccgaaaaacagacacgcggaaucuucggcgcuauugccggguuuaucgagaacggaugggaaggcaugguggacgggugguacggauucagacaccaaaauuccgagggccggggccaggcugccgaucugaagucuacccaggccgcuaucgaccagauuaacgggaaacucaacagacugaucggaaagacaaaugagaaauuccaucagauugaaaaggaguuuagcgaagucgagggccgcauccaagaucuugaaaaguauguggaggacaccaaaauugaucugugguccuacaacgcggagcuccugguugcccuggaaaaucagcacacgaucgaccucacagauagcgagaugaccaagcuguucgaaaagaccaagaaacagcuucgggagaacgcugaagacauggggaauggaugcuuuaagauuuaucauaagugugauaacgccugcaucggcucuaucagaaaugggacauacgaccacgauguguaucgcgacgaggcccugaacaaucgguuccagauuaaaggcgucgagcucaaguccggauacaaagacuggauccuguggauuagcuuugcuaucucuugcuuccuucuguguguggcccuccugggcuuuauuaugugggcgugccaaaaggggaacaucagauguaauaucugcauuuga

SEQ ID NO: 193876 - RNA, 1701 nt, Artificial Sequence; identical to SEQ ID NO: 189879
  derived and/or modified sequence opt5 from hemagglutinin__InfluenzaA__AHC61547

SEQ ID NO: 193877 - RNA, 1701 nt, Artificial Sequence
  derived and/or modified sequence opt5 from hemagglutinin__InfluenzaA__AHC61559
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagaucauugauggggaaaacuguacccuuaucgacgcccugcucggagauccccagugcgacggcuuucagaauaaaaagugggaucuguucgucgagagaucuaaagccuauagcaacuguuacccuuaugacgugcccgauuacgcuucccugcggucucucguugccagcuccgggacgcuggaauuuaauaacgagagcuucaauuggaccggagugacacagaacggcaccucuuccgcuugcauucgcagaagcaauaacucuuucuucucccggcuuaauuggcugacacaucucaacuuuaaguauccugcccugaacgucaccaugcccaauaacgagcaguucgacaaacuuuacaucuggggcgugcaccauccugggacggauaaggaccagauuuuucuguaugcgcaagccagcggacgcaucacaguuucuaccaagagaucccagcaggcugugauuccgaauaucggcagccggccccgcgucagaaacaucccuucccggauuucuaucuacuggacaauugugaaacccggggauauccuccugauuaauagcaccggaaaccugaucgccccucgcggcuacuucaagaucagauccgggaaaagcucuauuaugcgguccgacgcucccaucggaaaguguaauagcgaaugcauuaccccgaacggcucuaucccuaaugacaagcccuuucagaacgugaaucgcauuacauauggcgccuguccuagauacgucaaacaaaacacgcucaagcuggcgaccgggaugcggaauguucccgagaaacagacacgcggaaucuucggcgccaucgcuggguuuauugaaaacggaugggagggcaugguggaugggugguauggauucagacaccagaauagcgagggccggggccaagccgcugaccuuaaguccacccaggccgccaucgaucagauuaacgggaaacugaacagacucauccgcaagacaaaugaaaaauuccaccagauugagaaggaauuuucugagguggaaggacggauccaagaccuggagaaguacgucgaggauaccaaaauugaccuuuggagcuauaacgcugaacugcucguggcgcuggagaaucagcauacgaucgaucugacagacuccgaaaugaacaagcucuuugagaaaaccaagaaacagcugagagaaaaugccgaggauaugggcaacgggugcuuuaagaucuaccacaagugugacaaugcuugcauuggaagcauccgcaacggcaccuaugaucaugacguuuaccgggacgaggcccuuaauaacagauuccagauuaaagggguggaacugaagucuggccacaaagauuggauccucuggauuuccuuugccaucagcugcuuccugcuuugugucgcucugcucggauuuaucaugugggccugccaaaagggcaauauucgcuguaacaucugcauuuga

SEQ ID NO: 193878 - RNA, 1701 nt, Artificial Sequence; identical to SEQ ID NO: 192098
  derived and/or modified sequence opt5 from hemagglutinin__InfluenzaA__AHC61571

SEQ ID NO: 193879 - RNA, 1701 nt, Artificial Sequence; identical to SEQ ID NO: 189879
  derived and/or modified sequence opt5 from hemagglutinin__InfluenzaA__AHC61583

SEQ ID NO: 193880 - RNA, 1701 nt, Artificial Sequence; identical to SEQ ID NO: 192098
  derived and/or modified sequence opt5 from hemagglutinin__InfluenzaA__AHC61595

SEQ ID NO: 193881 - RNA, 1701 nt, Artificial Sequence
  derived and/or modified sequence opt5 from hemagglutinin__InfluenzaA__AHC61607
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagauccuugauggggaaaacuguacccugauugacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacgcuugaauuuaauaacgagagcuucaauuggaccggagugacacagaacggcaccucuuccgcuugcauccgcagaagcaauaacuccuuuuucucucggcugaauuggcucacacaucugaacuuuaaguauccugcccuuaacgucaccaugcccaauaacgagcaguucgacaagcuguacauuuggggcgugcaccauccugggacggauaaagaccagaucuuucucuaugcgcaagccagcggacgcauuacaguuucuaccaagagaucccagcaggcugugaucccgaauauuggcagccggccccgcgucagaaacaucccuucccggaucucuauuuacuggacaaucgugaaacccggggauauucugcugaucaauagcaccggaaaccucauugccccucgcggcuacuucaagaucagauccgggaaaagcucuaucaugcgguccgacgcucccauuggaaaguguaauagcgaaugcaucaccccgaacggcucuauuccuaaugacaagcccuuucagaacgugaaucgcaucacauauggcgccuguccuagauacgucaaacaacacacgcugaaacuugcgaccgggaugcggaacguucccgagaagcagacacgcggaauuuucggcgccaucgcuggguuuaucgaaaauggaugggagggcaugguggaugggugguauggauucagacaccagaacagcgagggccggggccaagccgcugaccugaaguccacccaggccgccauugaucagaucaaugggaaacucaacagacugauuggaaagacaaacgaaaaauuccaucagaucgagaaggaauuuucugagguggaaggccgcauucaagaccuugagaaguacgucgaggauaccaaaaucgaccuguggagcuauaaugcugaacuccugguggcgcuggagaaccagcacacgauugaucucacagacuccgaaaugaauaagcuguucgagaaaaccaagaaacagcuucgggaaaacgccgaggauauggggaauggaugcuuuaagaucuaccauaagugugacaacgcuugcaucggcagcauuagaaaugggaccuaugaucacgacguuuaccgcgacgaggcccugaacaaucgguuccagaucaaaggcguggaacucaagucuggauacaaagauuggauucuguggaucuccuuugccauuagcugcuuccuucugugugucgcucuccugggcuuuaucaugugggccugccaaaaggggaacaucagauguaauauuugcaucuga

SEQ ID NO: 193882 - RNA, 1701 nt, Artificial Sequence; identical to SEQ ID NO: 192098
  derived and/or modified sequence opt5 from hemagglutinin__InfluenzaA__AHC61619

SEQ ID NO: 193883 - RNA, 1701 nt, Artificial Sequence
  derived and/or modified sequence opt5 from hemagglutinin__InfluenzaA__AHC61631
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguaccauuaucgaugcccugcucggagacccccagugcgauggcuuucaaaauaaaaagugggaccuguucgucgagagaagcaaagcccauuccaacuguuauccuuacgaugugcccgacuaugcuucucugcggagccucguugccuccagcgggacgcuggaauuuaauaacgagucuuucaauuggaccggagugacacagaacggcaccuccagcgcuugcauucgcagaucuaauaacuccuuuuucagccggcuuaauuggcugacacaccucaacuuuaaguacccugcccugaacgucaccaugcccaauaacgagcaguucgauaaacuuuauaucuggggcgugcaucacccugggacggacaaagaucagauuuuucuguacgcgcaagccgcuggacgcaucacaguuucuaccaagagaucccagcaggccgugauuccgaauaucggcagccggccccgcgucagaaacaucccuucccgggugucuauuuauuggacaaucgugaaacccggggacauucuccugaucaauagcaccggaaaccugauugcuccucgcggcuacuucaagaucagauccgggaaaagcucuaucaugcgguccgaugcccccauuggaaaguguaauagcgcgugcaucaccccgaacggcucuauuccuaaugacaagcccuuucagaacgucaaucgcaucacauacggcgccuguccuagauauguuaaacaaaacacgcucaagcuggcuaccgggaugcggaaugugcccgaaaaacagacacgcggaauuuucggcgccaucgcuggguuuaucgagaacggaugggaaggcaugguggacgggugguacggauucagacaccagaauagcgagggccggggccaagccgccgaucuuaaguccacccaggcugcgauugaccagaucaacgggaaacugaacagacucauuggaaagacaaaugagaaauuccaucagaucgaaaaggaguuuucugaagucgagggccgcauucaagaucuggaaaaguauguggaggacaccaaaaucgaucuuuggagcuacaacgccgagcugcucguugcucuggaaaaucagcacacgauugaccugacagauuccgagaugaacaaacucuucgaaaagaccaagaagcagcugcgggagaaugccgaagacauggggaacggaugcuuuaagaucuaucauaagugugauaaugccugcaucggcagcauuagaaacgggaccuacgaccacgauguguaucgcgacgaggcucuuaauaaccgguuccagaucaaaggcgucgagcugaagucuggauacaaagacuggauucucuggaucuccuuugccauuagcugcuuccugcuuuguguggcgcugcucggcuuuaucaugugggcuugccaaaaggggaauaucagauguaacauuugcaucuga

SEQ ID NO: 193884 - RNA, 1701 nt, Artificial Sequence
  derived and/or modified sequence opt5 from hemagglutinin__InfluenzaA__AHC61643
augaagaccaucauugcccugagcuacgugcucugccuggucuucgcucagaaacuucccggcaacgacaauuccacagccacgcugugucucgggcaccaugcgguuccuaacggaaccaucgugaagacaauuaccaaugaucaaaucgaggugacaaacgcuaccgaacugguccagucuagcuccacaggcgagauuugcaauucuccgcaccagauccuugacggggaaaacuguacccugaucgaugcccuccugggagacccccagugcgauggcuuucaaaauaaaaagugggaccuguucguggagagaagcaaagcccauuccaacuguuauccuuacgauguucccgacuaugcuucucuccggagccugguggccuccagcgggacgcuugaauuuaauaacgagucuuucaauuggaccggagucacacagaacggcaccuccagcgcuugcauucgcagaucuaauaacuccuuuuucagccggcugaauuggcucacacaccugaacuuuaaguacccugcccuuaacgugaccaugcccaauaacgagcaguucgauaagcuguauaucuggggcguucaucacccugggacggacaaagaucagauuuuucucuacgcgcaagccgcuggacgcaucacagugucuaccaagagaucccagcaggccgucauuccgaauaucggcagccggccccgcgugagaaacauuccuucccgggugucuaucuauuggacaaucgucaaacccggggacauucugcugaucaauagcaccggaaaccucauugcuccucgcggcuacuucaagaucagauccgggaaaagcucuauuaugcgguccgaugcccccaucggaaaguguaauagcgcgugcaucaccccgaacggcucuauuccuaaugacaagcccuuucagaacguuaaucgcaucacauacggcgccuguccuagauaugugaaacaaaacacgcugaaacuugcuaccgggaugcggaaugugcccgaaaaacagacacgcggaauuuucggcgccaucgcuggguuuauugagaacggaugggaaggcauggucgacgggugguacggauucagacaccagaauagcgagggccggggccaagccgccgaucugaaguccacccaggcugcgaucgaccagaucaacgggaaacucaacagacugauuggaaagacaaaugagaaauuccaucagaucgaaaaggaguuuucugaaguggagggccgcauucaagaucuugaaaaguauguugaggacaccaaaaucgaucuguggagcuacaacgccgagcuccugguggcucuggaaaaucagcacacgauugaccucacagauuccgagaugaacaagcuguucgaaaagaccaagaaacagcuucgggagaaugccgaagacauggggaacggaugcuuuaagaucuaucauaagugugauaaugccugcauuggcagcaucagaaacgggaccuacgaccacgaugucuaucgcgacgaggcucugaauaaccgguuccagaucaaaggcguggagcucaagucuggauacaaagacuggauucuguggaucuccuuugccauuagcugcuuccuucuguguguugcgcuccugggcuuuaucaugugggcuugccaaaaggggaauauuagauguaacaucugcaucuga

SEQ ID NO: 193885 - RNA, 1701 nt, Artificial Sequence
  derived and/or modified sequence opt5 from hemagglutinin__InfluenzaA__AHC61655
augaagaccaucauugcccugagcuacauccucugccugguguucacacagaaacuucccggcaacgacaauuccacggcuacccugugucucgggcaccaugccgucccuaacggaacaauuguuaagaccaucacaaaugaucaaauugaggugaccaacgcgacagaacuggugcagucuagcuccaccggcgagaucugcaauucuccgcaccagauccuugacggggaaaacuguacgcugauugaugcucuccugggagacccccagugcgauggcuuucaaaauaacaaaugggaccuguucgucgagagaagcaaggcccauuccaauuguuauccuuacgaugugcccgacuaugccucucuccggagccugguugcuuccagcgggacccuugaauuuaacaaugagucuuucaacuggacaggagugacccagaauggcacauccagcgccugcauccgcagaucuaacaauuccuuuuucagccggcugaacuggcucacccaccugaacuuuaaauacccugcucuuaaugucacgaugcccaacaaugagcaguucgauaagcuguauauuuggggcgugcaucacccugggacagacaaggaucagaucuuucucuacgcccaagcggccggacgcauuaccguuucuacaaaaagaucccagcaggcugugaucccgaacauuggcagccggccccgcgucagaaauaucccuucccgggugucuaucuauuggaccauugugaagcccggggacauccugcugauuaacagcaccggaaaucucaucgccccucgcggcuacuucaaaauuagauccggaaagagcucuaucauccgguccgaugcucccauugggaaauguaacagcgccugcaucacaccgaauggcucuauuccuaacgacaagcccuuucagaaugucaaccgcaucacguacggcgcguguccuagauauguuaagcaaaauacccugaaacuugccacagggaugcggaacgugcccgaaaagcagacccgcggaauuuucggcgcuaucgccggguuuaucgagaauggaugggaaggcaugguggacgggugguacggauucagacaccagaacagcgagggccggggccaagcugccgaucugaaauccacacaggccgcuauugaccagaucaacgggaagcucaauagacugauuggaaaaaccaacgagaaguuccaucagaucgaaaaagaguuuucugaagucgagggccgcauucaagaucuugaaaaguauguggaggacacgaagaucgaucuguggagcuacaaugcggagcuccugguugcccuggaaaaccagcacacaauugaccucaccgauuccgagaugaauaaacuguucgaaaagaccaaaaagcagcuucgggagaacgcugaagacauggggaauggaugcuuuaaaaucuaucauaagugugauaacgccugcaucggcagcauuagaaaugggacauacgaccacgauguguaucgcgacgaggcccugaacaaucgguuccagaucaagggcgucgagcucaaaucuggauacaaggacuggauucuguggaucuccuuugcuauuagcugcuuccuucuguguguggcccuccugggcuuuaucaugugggcgugccaaaaagggaacaucagauguaauauuugcaucuga

SEQ ID NO: 193886 - RNA, 1701 nt, Artificial Sequence
  derived and/or modified sequence opt5 from hemagglutinin__InfluenzaA__AHC61667
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaauuuuaaguauccugcccuuaacgucaccaugcccaacaaugagcaguucgacaagcuguacauuuggggcgugcaccauccugggacggauaaagaccagaucuuucucuaugcgcaaucuuccggacgcauuacaguuagcaccaagagaucccagcaggccgugaucccgaacauuggcucucggccccgcaucagaaauaucccuagccggauuuccaucuacuggacaauugucaaacccggggauauccugcugauuaacagcaccggaaaucucaucgcuccucgcggcuacuucaagaucagaucugggaaauccagcauuaugcggucugacgcccccaucggaaaguguaacagcgaaugcauuaccccgaauggcuccaucccuaacgacaagcccuuucagaaugugaaccgcauuacauauggcgcuuguccuagauacgugaaacaaucuacgcugaaacuugccaccgggaugcggaauguccccgagaagcagacacgcggaaucuucggcgcgaucgccggguuuauugaaaacggaugggagggcaugguugaugggugguauggauucagacaccagaauagcgagggccggggccaagcugccgaccugaaguccacccaggcugccaucgaucagauuaacgggaaacucaauagacugaucggaaagacaaacgaaaaauuccaccagauugagaaggaauuuagcgagguggaaggccgcauccaagaccuugagaaguacguggaggauaccaaaauugaccuguggucuuauaacgccgaacuccuggucgcucuggagaaucagcauacgaucgaucucacagacuccgaaaugaacaagcuguucgagaaaaccaagaaacagcuucgggaaaaugcggaggauauggggaacggaugcuuuaagaucuaccacaagugugacaaugccugcauuggcagcaucagaaacgggaccuauaaucaugauguguaccgcgacgaggcucugaacaaucgguuccagauuaaaggcguugaacucaagucuggauacaaagacuggauccuguggauuuccuuugccaucagcugcuuccuucuguguguggcccuccugggcuuuaucaugugggcuugccaaaaggggaacauuagauguaauaucugcauuuga

SEQ ID NO: 193887 - RNA, 1701 nt, Artificial Sequence; identical to SEQ ID NO: 193642
  derived and/or modified sequence opt5 from hemagglutinin__InfluenzaA__AHC61679

SEQ ID NO: 193888 - RNA, 1701 nt, Artificial Sequence; identical to SEQ ID NO: 192098
  derived and/or modified sequence opt5 from hemagglutinin__InfluenzaA__AHC61691

SEQ ID NO: 193889 - RNA, 1701 nt, Artificial Sequence; identical to SEQ ID NO: 189879
  derived and/or modified sequence opt5 from hemagglutinin__InfluenzaA__AHC61703

SEQ ID NO: 193890 - RNA, 1701 nt, Artificial Sequence; identical to SEQ ID NO: 193675
  derived and/or modified sequence opt5 from hemagglutinin__InfluenzaA__AHC61715

SEQ ID NO: 193891 - RNA, 1701 nt, Artificial Sequence; identical to SEQ ID NO: 190806
  derived and/or modified sequence opt5 from hemagglutinin__InfluenzaA__AHC61727

SEQ ID NO: 193892 - RNA, 1701 nt, Artificial Sequence; identical to SEQ ID NO: 189879
  derived and/or modified sequence opt5 from hemagglutinin__InfluenzaA__AHC61739

SEQ ID NO: 193893 - RNA, 1701 nt, Artificial Sequence
  derived and/or modified sequence opt5 from hemagglutinin__InfluenzaA__AHC61751
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagauccuugauggggaaaacuguacccugauugacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacgcuugaauuuaauaacgagagcuucaauuggaccggagugacacagaacggcaccucuuccgcuugcauccgcagaagcaauaacuccuuuuucucucggcugaauuggcucacacaucugaacuuuaaguauccugcccuuaacgucaccaugcccaauaacgagcaguucgacaagcuguacauuuggggcgugcaccauccugggacggauaaagaccagaucuuucucuaugcgcaagccagcggacgcauuacaguuucuaccaagagaucccagcaggcugugaucccgaaugucggcagccggccccgcgugagaaacauuccuucccggaucucuaucuacuggacaauugugaaacccggggauauccugcugauuaauagcaccggaaaccucaucgccccucgcggcuacuucaagauuagauccgggaaaagcucuaucaugcgguccgacgcucccaucggaaaguguaauagcgaaugcauuaccccgaacggcucuaucccuaaugacaagcccuuucagaacgucaaucgcauuacauauggcgccuguccuagauacguuaaacaaaacacgcugaaacuugcgaccgggaugcggaaugugcccgagaagcagacacgcggaaucuucggcgccauugcuggguuuaucgaaaacggaugggagggcaugguggaugggugguauggauucagacaccagaauagcgagggccggggccaagccgcugaccugaaguccacccaggccgccaucgaucagauuaacgggaaacucaacagacugaucggaaagacaaaugaaaaauuccaccagauugagaaggaauuuucugaggucgaaggccgcauccaagaccuugagaaguacguggaggauaccaaaauugaccuguggagcuauaacgcugaacuccugguugcgcuggagaaucagcauacgaucgaucucacagacuccgaaaugaacaagcuguucgagaaaaccaagaaacagcuucgggaaaaugccgaggauauggggaacggaugcuuuaagauuuaccacaagugugacaaugcuugcaucggcagcaucagaaacgggaccuaugaucaugacguguaccgcgacgaggcccugaauaaccgguuccagauuaaaggcgucgaacucaagucuggauacaaagauuggauccuguggauuuccuuugccaucagcugcuuccuucuguguguggcucuccugggcuuuauuaugugggccugccaaaaggggaauaucagauguaacaucugcauuuga

SEQ ID NO: 193894 - RNA, 1701 nt, Artificial Sequence
  derived and/or modified sequence opt5 from hemagglutinin__InfluenzaA__AHC61763
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccgcuggacgcauuacaguuucuaccaagagaucccagcagacagugaucccgaauauuggcagccggccccgcgucagaaacaucccuucccgggugucuaucuauuggaccauugugaaacccggggacauccugcugauuaauagcaccggaaaccucaucgccccucgcggcuacuucaagauuagauccgggaaaagcucuaucaugcgguccgaugcucccaucggaaaguguaauagcgccugcauuacaccgaacggcucuaucccuaaugacaagcccuuucagaacgucaaucgcauuacguacggcgcguguccuagauauguuaaacaaaacacccugaaacuugccacagggaugcggaaugugcccgaaaaacagacccgcggaaucuucggcgcuauugccggguuuaucgagaacggaugggaaggcaugguggacgggugguacggauucagacaccagaauagcgagggccggggccaagcugccgaucugaaguccacacaggccgcuaucgaccagauuaacgggaaacucaacagacugaucggaaagaccaaugagaaauuccaucagauugaaaaggaguuuucugaagucgagggccgcauccaagaucuugaaaaguauguggaggacacgaaaauugaucuguggagcuacaacgcggagcuccugguugcccuggaaaaucagcacacaaucgaccucaccgauuccgagaugaacaagcuguucgaaaagaccaagaaacagcuucgggagaaugcugaagacauggggaacggaugcuuuaagauuuaucauaagugugauaaugccugcaucggcagcaucagaaacgggacauacgaccacgauguguaucgcgacgaggcccugaauaaccgguuccagauuaaaggcgucgagcucaagucuggauacaaagacuggauccuguggauuuccuuugcuaucagcugcuuccuucuguguguggcccuccugggcuuuauuaugugggcgugccaaaaggggaauaucagauguaacaucugcauuuga

SEQ ID NO: 193895 - RNA, 1701 nt, Artificial Sequence; identical to SEQ ID NO: 190006
  derived and/or modified sequence opt5 from hemagglutinin__InfluenzaA__AHC61775

SEQ ID NO: 193896 - RNA, 1701 nt, Artificial Sequence; identical to SEQ ID NO: 190806
  derived and/or modified sequence opt5 from hemagglutinin__InfluenzaA__AHC61787

SEQ ID NO: 193897 - RNA, 1701 nt, Artificial Sequence; identical to SEQ ID NO: 193642
  derived and/or modified sequence opt5 from hemagglutinin__InfluenzaA__AHC61799

SEQ ID NO: 193898 - RNA, 1701 nt, Artificial Sequence
  derived and/or modified sequence opt5 from hemagglutinin__InfluenzaA__AHC61823
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacuccagcuuuuucucucggcugaauuggcucacacaucugaacuuuaaguauccugcccuuaaugucaccaugcccaacaacgagcaguucgacaagcuguacauuuggggcgugcaccauccugggacggauaaagaccagaucuuucucuaugcgcaauccagcggacgcauuacaguuuccaccaagagaucucagcaggccgugaucccgaauauuggcagccggccccgcaucagaaacaucccuucccggauuagcaucuacuggacaauugucaaacccggggauauccugcugauuaauucuaccggaaaccucaucgcuccucgcggcuacuucaagaucagauccgggaaaagcucuauuaugaaaagcgacgcccccaucgacaaguguaauuccgaaugcauuaccccgaacggaucuaucccuaaugauaagcccuuucagaacgugaaucggauuacauauggcgcuuguccucgcuacgugaagcaaagcacgcugaaacuugccaccggcaugagaaacguccccgagaagcagacacgggggaucuucggagcgaucgccggcuuuauugaaaaugggugggagggaaugguugacggcugguauggguuccgccaccagaacuccgagggaagaggccaagcugccgaucugaaaagcacccaggcugccaucgaccagauuaauggcaagcucaaccggcugaucgggaaaacaaaugaaaaguuccaccagauugagaaggaauuuucugagguggaaggaagaauccaagaucuugagaaauacguggaggacaccaagauugaucugugguccuauaacgccgaacuccuggucgcucuggagaaccagcauacgaucgaccucacagauagcgaaaugaauaaacuguucgagaagaccaaaaagcagcuucgcgaaaacgcggaggacaugggcaaugggugcuuuaagaucuaccacaaaugugauaacgccugcauuggaucuauccggaauggcaccuauaaccaugacguguacagagacgaggcucugaauaaccgcuuccagauuaaggggguugaacucaaauccggcuacaaggauuggauccuguggauuagcuuugccaucuccugcuuccuucuguguguggcccuccugggauuuaucaugugggcuugccaaaaaggcaauauucgguguaacaucugcauuuga

SEQ ID NO: 193899 - RNA, 1701 nt, Artificial Sequence; identical to SEQ ID NO: 190806
  derived and/or modified sequence opt5 from hemagglutinin__InfluenzaA__AHC61835

SEQ ID NO: 193900 - RNA, 1701 nt, Artificial Sequence; identical to SEQ ID NO: 190006
  derived and/or modified sequence opt5 from hemagglutinin__InfluenzaA__AHC61847

SEQ ID NO: 193901 - RNA, 1701 nt, Artificial Sequence; identical to SEQ ID NO: 189879
  derived and/or modified sequence opt5 from hemagglutinin__InfluenzaA__AHC61859

SEQ ID NO: 193902 - RNA, 1701 nt, Artificial Sequence; identical to SEQ ID NO: 190806
  derived and/or modified sequence opt5 from hemagglutinin__InfluenzaA__AHC61871

SEQ ID NO: 193903 - RNA, 1701 nt, Artificial Sequence
  derived and/or modified sequence opt5 from hemagglutinin__InfluenzaA__AHC61883
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacuccagcuuuuucucucggcugaauuggcucacacaucugaacuuuaaguauccugcccuuaaugucaccaugcccaacaacgagcaguucgacaagcuguacauuuggggcgugcaccauccugggacggauaaagaccagaucuuucucuaugcgcaauccagcggacgcauuacaguuuccaccaagagaucucagcaggccgugaucccgaauauuggcagccggccccgcaucagaaacaucccuucccggauuagcaucuacuggacaauugucaaacccggggauauccugcugauuaauucuaccggaaaccucaucgcuccucgcggcuacuucaagaucagauccgggaaaagcucuauuaugcggagcgacgcccccaucggaaaguguaauuccgaaugcauuaccccgaacggcucuaucccuaaugacaagcccuuucagaacgugaaucgcauuacauauggcgcuuguccuagauacgugaaacaaagcacgcugaagcuggccaccgggaugcggaacguccccgagaaacagacacgcggaaucuucggcgcgaucgccggguuuauugaaaauggaugggagggcaugguugaugggugguauggauucagacaccagaacuccgagggccggggccaagcugccgaccuuaagagcacccaggcugccaucgaucagauuaaugggaaacucaacagacugaucggaaagacaaaugaaaaauuccaccagauugagaaggaauuuucugagguggaaggccgcauccaagaccuugagaaguacguggaggauaccaaaauugaccugugguccuauaacgccgaacuccuggucgcucuggagaaccagcauacgaucgaucucgcggacagcgaaaugaauaagcuguucgagaaaacaaagaaacagcuucgggaaaacgccgaggauauggggaauggaugcuuuaagaucuaccacaagugugacaacgcuugcauuggcucuaucagaaaugggaccuauaaccaugauguguaccgcgacgaggcccugaauaaccgguuccagauuaaaggcguugaacucaaguccggauacaaagacuggauccuguggauuagcuuugccaucuccugcuuccuucuguguguggcucuccugggcuuuaucaugugggccugccaaaaggggaauauuagauguaacaucugcauuuga

SEQ ID NO: 193904 - RNA, 1701 nt, Artificial Sequence; identical to SEQ ID NO: 190006
  derived and/or modified sequence opt5 from hemagglutinin__InfluenzaA__AHC61895

SEQ ID NO: 193905 - RNA, 1701 nt, Artificial Sequence; identical to SEQ ID NO: 190006
  derived and/or modified sequence opt5 from hemagglutinin__InfluenzaA__AHC61907

SEQ ID NO: 193906 - RNA, 1701 nt, Artificial Sequence
  derived and/or modified sequence opt5 from hemagglutinin__InfluenzaA__AHC61931
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccgcuggacgcauuacaguuucuaccaagagaucccagcaggccgugaucccgaauauuggcagccggccccgcgucagaaacaucccuucccgggugucuaucuauuggacaauugugaaacccggggacauccugcugauuaauagcaccggaaaccucaucgcuccucgcggcuacuucaagauuagauccgggaaaagcucuaucaugcgguccgaugcccccaucggaaaguguaauagcgcgugcauuaccccgaacggcucuaucccuaaugacaagcccuuucagaacgucaaucgcauuacauacggcgccuguccuagauauguuaaacaaaacacgcugaaacuugcuaccgggaugcggaaugugcccgaaaaacagacacgcggaaucuucggcgccauugcuggguuuaucgagaacggaugggaaggcaugguggacgggugguacggauucagacaccagaauagcgagggccggggccaagccgccgaucugaaguccacccaggcugcgaucgaccagauuaacgggaaacucaacagacugaucggaaagacaaaugagaaauuccaucagauugaaaaggaguuuucugaagucgagggccgcauccaagaucuugaaaaguauguggaggacaccaaaauugaucuguggagcuacaacgccgagcuccugguugcucuggaaaaucagcacacgaucgaccucacagauuccgagaugaacaagcuguucgaaaagaccaagaaacagcuucgggagaaugccgaagacauggggaacggaugcuuuaagauuuaucauaagugugauaaugccugcaucggcagcaucagaaacgggaccuacgaccacgauguguaucgcgacgaggcucugaauaaccgguuccagauuaaaggcgucgagcucaagucuggauacaaaggcuggauccuguggauuuccuuugccaucagcugcuuccuucuguguguggcgcuccugggguuuauuaugugggcuugccaaaagggaaauaucagauguaacaucugcauuuga

SEQ ID NO: 193907 - RNA, 1701 nt, Artificial Sequence; identical to SEQ ID NO: 190806
  derived and/or modified sequence opt5 from hemagglutinin__InfluenzaA__AHC61943

SEQ ID NO: 193908 - RNA, 1701 nt, Artificial Sequence; identical to SEQ ID NO: 192098
  derived and/or modified sequence opt5 from hemagglutinin__InfluenzaA__AHC61955

SEQ ID NO: 193909 - RNA, 1701 nt, Artificial Sequence; identical to SEQ ID NO: 190806
  derived and/or modified sequence opt5 from hemagglutinin__InfluenzaA__AHC61967

SEQ ID NO: 193910 - RNA, 1701 nt, Artificial Sequence; identical to SEQ ID NO: 189879
  derived and/or modified sequence opt5 from hemagglutinin__InfluenzaA__AHC61979

SEQ ID NO: 193911 - RNA, 1701 nt, Artificial Sequence; identical to SEQ ID NO: 190006
  derived and/or modified sequence opt5 from hemagglutinin__InfluenzaA__AHC61991

SEQ ID NO: 193912 - RNA, 1701 nt, Artificial Sequence; identical to SEQ ID NO: 193717
  derived and/or modified sequence opt5 from hemagglutinin__InfluenzaA__AHC62003

SEQ ID NO: 193913 - RNA, 1701 nt, Artificial Sequence; identical to SEQ ID NO: 190806
  derived and/or modified sequence opt5 from hemagglutinin__InfluenzaA__AHC62015

SEQ ID NO: 193914 - RNA, 1701 nt, Artificial Sequence; identical to SEQ ID NO: 192098
  derived and/or modified sequence opt5 from hemagglutinin__InfluenzaA__AHC62027

SEQ ID NO: 193915 - RNA, 1701 nt, Artificial Sequence
  derived and/or modified sequence opt5 from hemagglutinin__InfluenzaA__AHC62039
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcggcucuaauaacuccuuuuucagcagacugaauuggcucacacaccugaacuuuaaguacccugcccuuaacgucaccaugcccaauaacgagcaguucgauaagcuguauauuuggggagugcaucacccugggacggacaaagaucagaucuuucucuacgcgcaagccucuggccggauuacaguuuccaccaagcgcagccagcaggcugugaucccgaauauuggguccagaccccggguccgcaacaucccuucuagagugagcaucuauuggacaauugugaaacccggagacauccugcugauuaauuccaccggcaaccucaucgccccucggggguacuucaagauucgcagcggaaaaucuuccaucaugaaguccgaugcucccaucggcaaguguaauucugccugcauuaccccgaacggcagcaucccuaaugacaaacccuuucagaacgucaauagaauuacauacggggcguguccucgguauguuaagcaaaacacgcugaaacuugccaccggaaugcgcaaugugcccgaaaagcagacaagaggcaucuucggggcuauugccggauuuaucgagaacggcugggaagggaugauggacggaugguacggcuuccggcaccagaauagcgagggccgcgggcaagcugccgaucugaaaucuacccaggccgcuaucgaccagauuaacggaaagcucaacagacugaucggcaaaacaaaugagaaguuccaucagauugaaaaggaguuuagcgaaguggaggggcggauccaagaucuugaaaaauaugucgaggacaccaagauugaucugugguccuacaacgcggagcuccugguggcccuggaaaaucagcacacgaucgaccucacagauagcgagaugaacaaacuguucgaaaagaccaaaaagcagcuuagagagaaugcugaagacaugggaaacggcugcuuuaagauuuaucauaaaugugauaaugccugcaucgggucuauccgcaacggcaccuacgaccacgauguuuaucgggacgaggcccugaauaacagauuccagauuaagggaguggagcucaaauccggcuacaaggacuggauccuguggauuagcuuugcuaucucuugcuuccuucugugugucgcccuccugggguuuauuaugugggcgugccaaaaaggaaauauccgcuguaacaucugcauuuga

SEQ ID NO: 193916 - RNA, 1701 nt, Artificial Sequence
  derived and/or modified sequence opt5 from hemagglutinin__InfluenzaA__AHC62050
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccaccaagagaagccagcaggcugugaucccgaauauuggcucccggccccgcgucagaaacgugccuucucgggugagcaucuauuggacaaucgucaaacccggggacauucugcugaucaauuccaccggaaaccucauugccccucgcggcuacuucaagaucagaagcgggaaaucuuccauuaugcggagcgaugcucccaucggaaaguguaauucugccugcaucaccccgaacggcagcauuccuaaugacaagcccuuucagaacguuaaucgcaucacauacggcgcguguccuagauaugugaaacaaaacacgcugaaacuugccaccgggaugcggaaugugcccgaaaaacagacacgcggaauuuucggcgcuaucgccggguuuauugagaacggaugggaaggcauggucgacgggugguacggauucagacaccaaaauuccgagggccggggccaggcugccgaucugaagucuacccaggccgcuaucgaccagaucaacgggaaacucaacagacugauuggaaagacaaaugagaaauuccaucagaucgaaaaggaguuuagcgaaguggagggccgcauucaagaucuugaaaaguauguugaggacaccaaaaucgaucugugguccuacaacgcggagcuccugguggcccuggaaaaucagcacacgauugaccucacagauagcgagaugaacaagcuguucgaaaagaccaagaaacagcuucgggagaaugcugaagacauggggaacggaugcuuuaagaucuaucauaagugugauaaugccugcauuggcucuaucagaaacgggaccuacgaccacgaugucuaucgcgacgaggcccugaauaaccgguuccagaucaaaggcguggagcucaaguccggauacaaagacuggauucuguggaucagcuuugcuauuucuugcuuccuucuguguguugcccuccugggcuuuaucaugugggcgugccaaaaggggaauauuagauguaacaucugcaucuga

SEQ ID NO: 193917 - RNA, 1701 nt, Artificial Sequence; identical to SEQ ID NO: 192098
  derived and/or modified sequence opt5 from hemagglutinin__InfluenzaA__AHC62062

SEQ ID NO: 193918 - RNA, 1701 nt, Artificial Sequence
  derived and/or modified sequence opt5 from hemagglutinin__InfluenzaA__AHC62074
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaauuuuaaguauccugcccuuaacgucaccaugcccaacaaugagcaguucgacaagcuguacauuuggggcgugcaccauccugggacggauaaagaccagaucuuucucuaugcgcaagccucuggacgcauuacaguuuccaccaagagaaaccagcaggcugugaucccgaauauuggcagccggccccgcgucagaaacaucccuucccggaucucuauuuacuggacaaucgugaaacccggggauauucugcugaucaauagcaccggaaaccucauugccccucgcggcuacuucaagaucagauccgggaaaagcucuaucaugcgguccgacgcucccauuggaaaguguaauagcgaaugcaucaccccgaacggcucuauuccuaaugacaagcccuuucagaacgugaaucgcaucacauauggcgccuguccuagauacgucaaacaaaacacgcugaaacuugcgaccgggaugcggaauguucccgagaagcagacacgcggaauuuucggcgccaucgcuggguuuaucgaaaacggaugggagggcaugguggaugggugguauggauucagacaccagaauagcgagggccggggccaagccgcugaccugaaguccacccaggccgccauugaucagaucaacgggaaacucaacagacugauuggaaagacaaaugaaaaauuccaccagaucgagaaggaauuuucugagguggaaggccgcauucaagaccuugagaaguacgucgaggauaccaaaaucgaccuguggagcuauaacgcugaacuccugguggcgcuggagaaucagcauacgauugaucucacagacuccgaaaugaacaagcuguucgagaaaaccaagaaacagcuucgggaaaaugccgaggauauggggaacggaugcuuuaagaucuaccacaagugugacaaugcuugcaucggcagcauuagaaacgggaccuauaaucaugauguuuaccgcgacgaggcccugaacaaucgguuccagaucaaaggcguggaacucaagucuggauacaaagacuggauucuguggaucuccuuugccauuagcugcuuccuucugugugucgcucuccugggcuuuaucaugugggccugccaaaaggggaacaucagauguaauauuugcaucuga

SEQ ID NO: 193919 - RNA, 1701 nt, Artificial Sequence; identical to SEQ ID NO: 189879
  derived and/or modified sequence opt5 from hemagglutinin__InfluenzaA__AHC62086

SEQ ID NO: 193920 - RNA, 1701 nt, Artificial Sequence; identical to SEQ ID NO: 190806
  derived and/or modified sequence opt5 from hemagglutinin__InfluenzaA__AHC62098

SEQ ID NO: 193921 - RNA, 1701 nt, Artificial Sequence; identical to SEQ ID NO: 189879
  derived and/or modified sequence opt5 from hemagglutinin__InfluenzaA__AHC62110

SEQ ID NO: 193922 - RNA, 1701 nt, Artificial Sequence
  derived and/or modified sequence opt5 from hemagglutinin__InfluenzaA__AHC62122
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaaauggugcagucuagcuccacaggcgagaucugcaauucuccgcaccagauccuggacggggaaaacuguacccuuauugaugcccugcucggagacccccagugcgauggcuuucaaaauaaaaagugggaccuguucgucgagagaagcaaagcccauuccaacuguuauccuuacgaugugcccgacuaugcuucucugcggagccucguugccuccagcgggacgcuggaauuuaauaacgagucuuucaauuggaccggagugacacagaacggcaccuccagcgcuugcauccgcggcucuaauaacuccuuuuucagcagacuuaauuggcugacacacucuaacuuuaaguacccugcccucaacgucaccaugcccaauaacgagcaguucgauaagcuguauauuuggggagugcaucacccugggacggacaaagaucagaucuuucuuuacgcgcaagccuccggccggauuacaguuagcaccaagcgcucccagcaggcugugaucccgaauauugggucuagaccccggguccgcaacaucccuagcagaguguccaucuauuggacaauugugaaacccggagacauccugcucauuaauagcaccggcaaccugaucgccccucggggguacuucaagauucgcucuggaaaauccagcaucaugagaucugaugcucccaucggcaaguguaauagcgccugcauuaccccgaacggcuccaucccuaaugacaagcccuuucagaacgucaaucggauuacauacggggcguguccucgcuauguuaaacaaaacacgcugaagcucgccaccggaaugagaaaugugcccgaaaaacagacacggggcaucuucggggcuauugccggauuuaucgagaacggcugggaagggaugguggacggaugguacggcuuccgccaccaaaauucugagggcagagggcaggcugccgaucugaaaagcacccaggccgcuaucgaccagauuaacggaaaacuuaaccggcugaucggcaagacaaaugagaaauuccaucagauugaaaaggaguuuuccgaagucgaggggagaauccaagaucucgaaaaguauguggaggacaccaaaauugaucuguggagcuacaacgcggagcuucugguugcccucgaaaaucagcacacgaucgaccugacagauucugagaugaacaagcuguucgaaaagaccaagaaacagcuccgcgagaaugcugaagacaugggaaacggcugcuuuaagauuuaucauaagugugauaaugccugcaucggguccauccggaacggcaccuacgaccacgauguguauagagacgaggcccugaauaaccgcuuccggauuaaaggagucgagcuuaagagcggcuacaaagacuggauccuguggauuucuuuugcuaucuccugcuuccuccuguguguggcccuucugggguuuauuaugugggcgugccagaagggaaauaucagauguaacaucugcauuuga

SEQ ID NO: 193923 - RNA, 1701 nt, Artificial Sequence; identical to SEQ ID NO: 189879
  derived and/or modified sequence opt5 from hemagglutinin__InfluenzaA__AHC62134

SEQ ID NO: 193924 - RNA, 1701 nt, Artificial Sequence
  derived and/or modified sequence opt5 from hemagglutinin__InfluenzaA__AHC62146
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagccuauuccaacuguuacccuuaugaugugcccgacuacgcuucucuccggagccugguugccuccagcgggacgcuugaauuuaauaacgagucuuucaauuggaccggagugacacagaacggcaccuccagcgcuugcauccgcagaucuaauuccagcuuuuucucucggcugaacuggcucacacaucugaauuuuaaguauccugcccuuaacgucaccaugcccaacaaugagcaguucgauaagcuguacauuuggggcgugcaccauccugggacggacaaagaucagaucuuucucuaugcgcaauccagcggacgcauuacaguuuccaccaagagaucucagcaggccgugaucccgaacauuggcagccggccccgcaucagaaauaucccuucccggauuagcaucuacuggacaauugucaaacccggggacauccugcugauuaacucuaccggaaaucucaucgcuccucgcggcuacuucaagaucagauccgggaaaagcucuauuaugcggagcgaugcccccaucggaaaguguaacuccgaaugcauuaccccgaauggcucuaucccuaacgacaagcccuuucagaaugugaaccgcauuacauauggcgcuuguccuagauacgugaaacaaagcacgcugaaacuugccaccgggaugcggaauguccccgagaagcagacacgcggaaucuucggcgcgaucgccggguuuauugaaaacggaugggagggcaugguugacgggugguauggauucagacaccagaauuacgagggccggggccaagcugccgaucugaaguccacccaggcugccaucgaccagauuaacgggaaacucaauagacugaucggaaagacaaacgaaaaauuccaccagauugagaaggaauuuagcgagguggaaggccgcauccaagaucuugagaaguauguggaggacaccaaaauugaucuguggucuuacaacgccgaacuccuggucgcucuggagaaucagcauacgaucgaccucacagauuccgaaaugaacaagcuguucgagaaaaccaagaaacagcuucgggaaaaugcggaggacauggggaacggaugcuuuaagaucuaucacaagugugauaaugccugcauuggcagcaucagaaacgggaccuacaaucaugacguguaccgcgaugaggcucugaacaaucgguuccagauuaaaggcguugaacucaagucuggauauaaagacuggauccuguggauuuccuuugccaucagcugcuuccuucuguguguggcccuccugggcuuuaucaugugggcuugccaaaaggggaacauuagauguaauaucugcauuuga

SEQ ID NO: 193925 - RNA, 1701 nt, Artificial Sequence; identical to SEQ ID NO: 190006
  derived and/or modified sequence opt5 from hemagglutinin__InfluenzaA__AHC62158

SEQ ID NO: 193926 - RNA, 1701 nt, Artificial Sequence
  derived and/or modified sequence opt5 from hemagglutinin__InfluenzaA__AHC62170
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcggcucuaauaacuccuuuuucagcagacugaauuggcucacacaccugaacuuuaaguacccugcccuuaacgucaccaugcccaauaacgagcaguucgauaagcuguauauuuggggagugcaucacccugggacggacaaagaucagaucuuucucuacgcgcaagccucuggccggauuacaguuuccaccaagcgcagccagcaggcugugaucccgaauauuggguccagaccccggguccgcaacaucccuucuagagugagcaucuauuggacaauugugaaacccggagacauccugcugauuaauuccaccggcaaccucaucgccccucggggguacuucaagauucgcagcggaaaaucuuccaucaugagaagcgaugcucccaucggcaaguguaauucugccugcauuaccccgaacggcagcaucccuaaugacaagcccuuucagaacgucaaucggauuacauacggggcguguccucgcuauguuaaacaaaacacgcugaaacuugccaccggaaugagaaaugugcccgaaaaacagacacggggcaucuucggggcuauugccggauuuaucgagaacggcugggaagggaugauggacggaugguacggcuuccgccaccaaaauuccgagggcagagggcaggcugccgaucugaagucuacccaggccgcuaucgaccagauuaacggaaaacucaaccggcugaucggcaagacaaaugagaaauuccaucagauugaaaaggaguuuagcgaaguggaggggagaauccaagaucuugaaaaguaugucgaggacaccaaaauugaucugugguccuacaacgcggagcuccugguggcccuggaaaaucagcacacgaucgaccucacagauagcgagaugaacaagcuguucgaaaagaccaagaaacagcuucgcgagaaugcugaagacaugggaaacggcugcuuuaagauuuaucauaagugugauaaugccugcaucgggucuauccggaacggcaccuacgaccacaauguuuauagagaugaggcccugaacaaucgcuuccagauuaaaggaguggagcucaaguccggcuacaaagacuggauccuguggauuagcuuugcuaucucuugcuuccuucugugugucgcccuccugggguuuauuaugugggcgugccaaaagggaaacauccgguguaauaucugcauuuga

SEQ ID NO: 193927 - RNA, 1701 nt, Artificial Sequence; identical to SEQ ID NO: 189879
  derived and/or modified sequence opt5 from hemagglutinin__InfluenzaA__AHC62182

SEQ ID NO: 193928 - RNA, 1701 nt, Artificial Sequence; identical to SEQ ID NO: 192098
  derived and/or modified sequence opt5 from hemagglutinin__InfluenzaA__AHC62194

SEQ ID NO: 193929 - RNA, 1701 nt, Artificial Sequence
  derived and/or modified sequence opt5 from hemagglutinin__InfluenzaA__AHC62206
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaucuggaccggagugacacagaacggcaccuccagcgcuugcauucgcagaucuaauuccagcuuuuucucucggcugaacuggcucacacaucugaauuuuaaguauccugcccuuaacgucaccaugcccaauaacgagcaguucgacaagcuguacaucuggggcgugcaccauccugggacggauaaagaccagauuuuucucuaugcgcaauccagcggacgcaucacaguuuccaccaagagaucucagcaggccgugauuccgaacaucggcagccggccccgcaucagaaauauuccuucccggaucagcauuuacuggacaaucgucaaacccggggauauucugcugaucaacucuaccggaaaucucaucgcuccucgcggcuacuucaagauuagauccgggaaaagcucuaucaugcggagcgacgcccccauuggaaaguguaacuccgaaugcaucaccccgaauggcucuauuccuaacgacaagcccuuucagaaugugaaccgcaucacauauggcgcuuguccuagauacgugaaacaaagcacgcugaagcuggccaccgggaugcggaauguccccgagaaacagacacgcggaaucuucggcgcgauugccggguuuaucgaaaacggaugggagggcaugguugaugggugguauggauucagacaccaaaauuccgagggccggggccaggcugccgaccuuaagagcacccaggcugccauugaucagaucaacgggaaacucaauagacugauuggaaagacaaacgaaaaauuccaccagaucgagaaggaauuuucugagguggaaggccgcauucaagaccuugagaaguacguggaggauaccaaaaucgaccugugguccuauaaugccgaacuccuggucgcucuggagaaccagcauacgaucgaucucacagacagcgaaaugaacaagcuguucgagaaaaccaagaaacagcuucgggaaaaugcggaggauauggggaacggaugcuuuaagauuuaccacaagugugacaaugccugcaucggcucuauuagaaacgggaccuauaaucaugauguguaccgcgacgaggcucugaacaaucgguuccagaucaaaggcguugaacucaaguccggauacaaagacuggauucuguggaucagcuuugccaucuccugcuuccuucuguguguggcccuccugggcuuuauuaugugggcuugccaaaaggggaacaucagauguaauauuugcaucuga

SEQ ID NO: 193930 - RNA, 1701 nt, Artificial Sequence; identical to SEQ ID NO: 190006
  derived and/or modified sequence opt5 from hemagglutinin__InfluenzaA__AHC62218

SEQ ID NO: 193931 - RNA, 1701 nt, Artificial Sequence
  derived and/or modified sequence opt5 from hemagglutinin__InfluenzaA__AHC62242
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugaucaaaucgaggugacaaacgcuaccgaacucgugcaaaauucuagcacaggcgagaucugcgacuccccgcaccagauucuggauggggaaaacuguacccuuaucgacgcccugcucggagauccccagugcgacggcuuucagaauaaaaagugggaucuguucgucgagagaucuaaagccuauagcaacuguuacccuuaugacgugcccgauuacgcuucccugcggucucucguugccagcuccgggacgcuggaauuuaauaacgagagcuucaauuggaccggagugacacagaacggcaccucuuccgcuugcauucgcagaagcaauaacucuuucuucucccggcuuaauuggcugacacaucucaacuuuaaguauccugcccugaacgucaccaugcccaauaacgagcaguucgacaaacuuuacaucuggggcgugcaccauccugggacggauaaggaccagauuuuucuguaugcgcaagccagcggacgcaucacaguuucuaccaagagaucccagcaggcugugauuccgaauaucggcagccggccccgcgucagaaacaucccuucccggauuucuaucuacuggacaauugugaaacccggggauauccuccugauuaauagcaccggaaaccugaucgccccucgcggcuacuucaagaucagauccgggaaaagcucuauuaugcgguccgacgcucccaucggaaaguguaauagcgaaugcauuaccccgaacggcucuaucccuaaugacaagcccuuucagaacgugaaucgcauuacauauggcgccuguccuagauacgucaaacaaaacacgcucaagcuggcgaccgggaugcggaauguucccgagaaacagacacgcggaaucuucggcgccaucgcuggguuuauugaaaacggaugggagggcaugguggaugggugguauggauucagacaccagaauagcgagggccggggccaagccgcugaccuuaaguccacccaggccgccaucgaucagauuaacgggaaacugaacagacucaucggaaagacaaaugaaaaauuccaccagauugagaaggaauuuucugagguggaaggccgcauccaagaccuggagaaguacgucgaggauaccaaaauugaccuuuggagcuauaacgcugaacugcucaucgcgcuggagaaucagcauacgaucgaucugacagacuccgaaaugaacaagcucuuugagaaaaccaagaaacagcugcgggaaaaugccgaggauauggggaacggaugcuuuaagauuuaccacaagugugacaaugcuugcaucggcagcauuagaaacgggaccuaugaucaugacguguaccgcgacgaggcccuuaauaaccgguuccagaucaaaggcguugaacugaagucuggauacaaagauuggauucucuggaucuccuuugccaucagcugcuuccugcuuuguguggcucugcucggcuuuauuaugugggccugccaaaaggggaauaucagauguaacauuugcaucuga

SEQ ID NO: 193932 - RNA, 1701 nt, Artificial Sequence; identical to SEQ ID NO: 193641
  derived and/or modified sequence opt5 from hemagglutinin__InfluenzaA__AHC62254

SEQ ID NO: 193933 - RNA, 1701 nt, Artificial Sequence; identical to SEQ ID NO: 190006
  derived and/or modified sequence opt5 from hemagglutinin__InfluenzaA__AHC62266

SEQ ID NO: 193934 - RNA, 1701 nt, Artificial Sequence; identical to SEQ ID NO: 193805
  derived and/or modified sequence opt5 from hemagglutinin__InfluenzaA__AHC62278

SEQ ID NO: 193935 - RNA, 1701 nt, Artificial Sequence
  derived and/or modified sequence opt5 from hemagglutinin__InfluenzaA__AHC62290
augaagaccaucauugcccugagcuacauccucugccugauuuucgcucagaaacuucccggcaacgacaauuccacagccacgcugugucucgggcaccaugcggugccuaacggaaccaucgucaagacaauuaccaaugaucaaaucgagguuacaaacgcuaccgaacuggugcagucuagcuccacaggcgagaucugcaauucuccgcaccagauucuugacggggaaaacuguacccugaucgaugcccuccugggagacccccagugcgauggcuuucaaaauaaaaagugggaccuguucguggagagaagcaaagcccauuccaacuguuauccuuacgauguccccgacuaugcuucucuccggagccugguggccuccagcgggacgcuugaauuuaauaacgagucuuucaauuggaccggaguuacacagaacggcaccuccagcgcuugcauucgcagaucuaauaacuccuuuuucagccggcugaauuggcucacacaccugaacuuuaaguacccugcccuuaacgugaccaugcccaauaacgagcaguucgauaagcuguauaucuggggcguccaucacccugggacggacaaagaucagauuuuucucuacgcgcaagccucuggacgcaucacaguguccaccaagagaagccagcaggcuguuauuccgaauaucggcucccggccccgcgugagaaacaucccuucucgggucagcauuuauuggacaaucgugaaacccggggacauucugcugaucaauuccaccggaaaccucauugccccucgcggcuacuucaagaucagaagcgggaaaucuuccaucaugcggagcgaugcucccauuggaaaguguaauucugccugcaucaccccgaacggcagcauuccuaaugacaagcccuuucagaacgugaaucgcaucacauacggcgcguguccuagauaugucaaacaaaacacgcugaaacuugccaccgggaugcggaauguucccgaaaaacagacacgcggaauuuucggcgcuaucgccggguuuaucgagaacggaugggaaggcaugguggacgggugguacggauucagacaccaaaauuccgagggccggggccaggcugccgaucugaagucuacccaggccgcuauugaccagaucaacgggaaacucaacagacugauuggaaagacaaaugagaaauuccaucagaucgaaaaggaguuuagcgaaguggagggccgcauucaagaucuugaaaaguaugucgaggacaccaaaaucgaucugugguccuacaacgcggagcuccugguggcccuggaaaaucagcacacgauugaccucacagauagcgagaugaacaagcuguucgaaaagaccaagaaacagcuucgggagaaugcugaagacauggggaacggaugcuuuaagaucuaucauaagugugauaaugccugcaucggcucuauuagaaacgggaccuacgaccacgauguuuaucgcgacgaggcccugaauaaccgguuccagaucaaaggcguggagcucaaguccggauacaaagacuggauucuguggaucagcuuugcuauuucuugcuuccuucugugugucgcccuccugggcuuuaucaugugggcgugccaaaaggggaauaucagauguaacauuugcaucuga

SEQ ID NO: 193936 - RNA, 1701 nt, Artificial Sequence
  derived and/or modified sequence opt5 from hemagglutinin__InfluenzaA__AHC62302
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccgcuggacgcauuacaguuucuaccaagagaucccagcaggccgugaucccgaauauuggcagccggccccgcgucagaaacaucccuucccgggugucuaucuauuggacaauugugaaacccggggacauccugcugauuaauagcaccggaaaccucaucgcuccucgcggcuacuucaagauuagaaaugggaaauccagcaucaugcggucugaugcccccaucggaaaguguaacuccgcgugcauuaccccgaauggcagcaucccuaacgacaagcccuuucagaaugucaaccgcauuacauacggcgccuguccuagauauguuaaacaaaauacgcugaaacuugcuaccgggaugcggaacgugcccgaaaaacagacacgcggaaucuucggcgccauugcuggguuuaucgagaauggaugggaaggcaugguggacgggugguacggauucagacaccagaacucugagggccggggccaagccgccgaucucaagagcacccaggcugcgaucgaccagauuaacgggaaacugaauagacugaucggaaagacaaacgagaaauuccaucagauugaaaaggaguuuuccgaagucgagggccgcauccaagaucuugaaaaguauguggaggacaccaaaauugaucuguggucuuacaaugccgagcuccugguugcucuggaaaaccagcacacgaucgaccucacagauagcgagaugaauaagcuguucgaaaagaccaagaaacagcuucgggagaacgccgaagacauggggaauggaugcuuuaagauuuaucauaagugugauaacgccugcaucggcuccaucagaaaugggaccuacgaccacgauguguaucgcgacgaggcucugaacaaucgguuccagauuaaaggcgucgagcucaagagcggauacaaagacuggauccuguggauuucuuuugccaucuccugcuuccuucuguguguggcgcuccugggcuuuauuaugugggcuugccaaaaggggaacaucagauguaauaucugcauuuga

SEQ ID NO: 193937 - RNA, 1701 nt, Artificial Sequence
  derived and/or modified sequence opt5 from hemagglutinin__InfluenzaA__AHC62314
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagauccuugauggggaaaacuguacccugauugacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacgcuugaauuuaauaacgagagcuucaauuggaccggagugacacagaacggcaccucuuccgcuugcauccgcagaagcaauaacuccuuuuucucucggcugaauuggcucacacaucugaacuuuaaguauccugcccuuaacgucaccaugcccaauaacgagcaguucgacaagcuguacauuuggggcgugcaccauccugggacggauaaagaccagaucuuucucuaugcgcaagccagcggacgcauuacaguuucuaccaagagaucccagcaggcugugaucccgaauauuggcagccggccccgcgucagaaacaucccuucccggaucucuauuuacuggacaaucgugaaacccggggauauucugcugaucaauagcaccggaaaccucauugccccucgcggcuacuucaagaucagauccgggaaaagcucuaucaugcgguccgacgcucccauuggaaaguguaauagcgaaugcaucaccccgaacggcucuauuccuaaugacaagcccuuucagaacgugaaucgcaucacauauggcgccuguccuagauacgucaaacaaaacacgcugaaacuugcgaccgggaugcggaauguucccgagaagcagacacgcggaauuuucggcgccaucgcuggguuuaucgaaaacggaugggagggcaugguggaugggugguauggauucagacaccagaauagcgagggccggggccaagccgcugaccugaaguccacccaggccgccauugaucagaucaacgggaaacucaacagacugauuggaaagacaaaugaaaaauuccaccagaucgagaaggaauuuucugagguggaaggccgcauucaagaccuugagaaguacgucgaggauaccaaaaucgaccuguggagcuauaacgcugaacuccugguggcgcuggagaaucagcauacgauugaucucacagacuccgaaaugaacaagcuguucgagaaaaccaagaaacagcuucgggaaaaugccgaggauauggggaacggaugcuuuaagaucuaccacaagugugacaaugcuugcaucggcagcauuagaaacgggaccuaugaucaugacguuuaccgcgacgaggcccugaauaaccgguuccagaucagaggcguggaacucaaaucuggauacaaggauuggauucuguggaucuccuuugccauuagcugcuuccuucugugugucgcucuccugggcuuuaucaugugggccugccaaaaagggaauauccgcuguaacauuugcaucuga

SEQ ID NO: 193938 - RNA, 1701 nt, Artificial Sequence; identical to SEQ ID NO: 193802
  derived and/or modified sequence opt5 from hemagglutinin__InfluenzaA__AHC62326

SEQ ID NO: 193939 - RNA, 1701 nt, Artificial Sequence; identical to SEQ ID NO: 190806
  derived and/or modified sequence opt5 from hemagglutinin__InfluenzaA__AHC62338

SEQ ID NO: 193940 - RNA, 1701 nt, Artificial Sequence; identical to SEQ ID NO: 189879
  derived and/or modified sequence opt5 from hemagglutinin__InfluenzaA__AHC62350

SEQ ID NO: 193941 - RNA, 1701 nt, Artificial Sequence; identical to SEQ ID NO: 190806
  derived and/or modified sequence opt5 from hemagglutinin__InfluenzaA__AHC62362

SEQ ID NO: 193942 - RNA, 1701 nt, Artificial Sequence; identical to SEQ ID NO: 190806
  derived and/or modified sequence opt5 from hemagglutinin__InfluenzaA__AHC62374

SEQ ID NO: 193943 - RNA, 1701 nt, Artificial Sequence; identical to SEQ ID NO: 193805
  derived and/or modified sequence opt5 from hemagglutinin__InfluenzaA__AHC62386

SEQ ID NO: 193944 - RNA, 1701 nt, Artificial Sequence; identical to SEQ ID NO: 189879
  derived and/or modified sequence opt5 from hemagglutinin__InfluenzaA__AHC62398

SEQ ID NO: 193945 - RNA, 1701 nt, Artificial Sequence
  derived and/or modified sequence opt5 from hemagglutinin__InfluenzaA__AHC62410
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccaccaagagaagccagcaggcugugaucccgaauauuggcucccggccccgcgucagaaacaucccuucucgggugagcaucuauuggacaauugugaaacccggggacauccugcugauuaauuccaccggaaaccucaucgccccucgcggcuacuucaagauuagaagcgggaaaucuuccaucauccggagcgaugcucccauuggaaaguguaauucugccugcaucaccccgaacggcagcauuccuaaugacaagcccuuucagaacgucaaucgcaucacauacggcgcguguccuagauauguuaaacaaaacacgcugaaacuugccaccgggaugcggaaugugcccgaaaaacagacacgcggaauuuucggcgcuaucgccggguuuaucgagaacggaugggaaggcaugguggacgggugguacggauucagacaccaaaauuccgagggccggggccaggcugccgaucugaagucuacccaggccgcuauugaccagaucaacgggaaacucaacagacugauuggaaagacaaaugagaaauuccaucagaucgaaaaggaguuuagcgaagucgagggccgcauucaagaucuugaaaaguauguggaggacaccaaaaucgaucugugguccuacaacgcggagcuccugguugcccuggaaaaucagcacacgauugaccucacagauagcgagaugaacaagcuguucgaaaagaccaagaaacagcuucgggagaaugcugaagacauggggaacggaugcuuuaagaucuaucauaagugugauaaugccugcaucggcucuauuagaaacgggaccuacgaccacgauguguaucgcgacgaggcccugaauaaccgguuccagaucaaaggcgucgagcucaaguccggauacaaagacuggauucuguggaucagcuuugcuauuucuugcuuccuucuguguguggcccuccugggcuuuaucaugugggcgugccaaaaggggaauaucagauguaacauuugcaucuga

SEQ ID NO: 193946 - RNA, 1701 nt, Artificial Sequence; identical to SEQ ID NO: 193748
  derived and/or modified sequence opt5 from hemagglutinin__InfluenzaA__AHC62422

SEQ ID NO: 193947 - RNA, 1701 nt, Artificial Sequence
  derived and/or modified sequence opt5 from hemagglutinin__InfluenzaA__AHC62434
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccgcuggacgcauuacaguuucuaccaagagaucccagcaggccgugaucccgaauauuggcagccggccccgcgucagaaacaucccuucccgggugucuaucuauuggacaauugugaaacccggggacauccugcugauuaauagcaccggaaaccucaucgcuccucgcggcuacuucaagauucaguccgggaaaagcucuaucaugagauccgaugcccccaucggaaaguguaauagcgcgugcauuaccccgaacggcucuaucccuaaugacaagcccuuucaaaacgucaaucggauuacauacggcgccuguccucgcuauguuaaacagaacacgcugaaacuugcuaccgggaugagaaaugugcccgaaaaacagacacggggaaucuucggcgccauugcuggguuuaucgagaacggaugggaaggcaugguggacgggugguacggauuccgccaccaaaauagcgagggcagaggccaggccgccgaucugaaguccacccaggcugcgaucgaccagauuaacgggaaacucaaccggcugaucggaaagacaaaugagaaauuccaucaaauugaaaaggaguuuucugaagucgagggcagaauccaggaucuugaaaaguauguggaggacaccaaaauugaucuguggagcuacaacgccgagcuccugguugcucuggaaaaucagcacacgaucgaccucacagauuccgagaugaacaagcuguucgaaaagaccaagaaacagcuucgcgagaaugccgaagacauggggaacggaugcuuuaagauuuaucauaagugugauaaugccugcaucggcagcauccggaacgggaccuacgaccacgauguguauagagacgaggcucugaauaaccgcuuccaaauuaaaggcgucgagcucaagucuggauacaaagacuggauccuguggauuuccuuugccaucagcugcuuccuucuguguguggcgcuccugggcuuuauuaugugggcuugccagaaggggaauauccgguguaacaucugcauuuga

SEQ ID NO: 193948 - RNA, 1701 nt, Artificial Sequence; identical to SEQ ID NO: 189879
  derived and/or modified sequence opt5 from hemagglutinin__InfluenzaA__AHC62446

SEQ ID NO: 193949 - RNA, 1701 nt, Artificial Sequence; identical to SEQ ID NO: 190006
  derived and/or modified sequence opt5 from hemagglutinin__InfluenzaA__AHC62458

SEQ ID NO: 193950 - RNA, 1701 nt, Artificial Sequence
  derived and/or modified sequence opt5 from hemagglutinin__InfluenzaA__AHC62470
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagauccuugauggggaaaacuguacccugauugacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacgcuugaauuuaauaacgagagcuucaauuggaccggagugacacagaacggcaccucuuccgcuugcauccgcagaagcaauaacuccuuuuucucucggcugaauuggcucacacaucugaacuuuaaguauccugcccuuaacgucaccaugcccaauaacgagcaguucgacaagcuguacauuuggggcgugcaccauccugggacggauaaagaccagaucuuucucuaugcgcaagccagcggacgcauuacaguuucuaccaagagaucccagcaggcugugaucccgaauauuggcagccggccccgcgucagaaacaucccuucccggaucucuauuuacuggacaaucgugaaacccggggauauucugcugaucaauagcaccggaaaccucauugccccucgcggcuacuucaagaucagauccgggaaaagcucuaucaugcgguccgacgcucccauuggaaaguguaauagcgaaugcaucaccccgaacggcucuauuccuaauggcaagcccuuucagaacgugaaucgcaucacauauggggccuguccuagauacgucaaacaaaacacgcugaaacuugcgaccggaaugcggaauguucccgagaagcagacacgcggcauuuucggggccaucgcuggauuuaucgaaaacggcugggaggggaugguggacggaugguauggcuucagacaccagaauagcgagggccgggggcaagccgcugaucugaaguccacccaggccgccauugaccagaucaacggaaaacucaacagacugauuggcaagacaaaugaaaaauuccaccagaucgagaaggaauuuucugagguggaagggcgcauucaagaucuugagaaguacgucgaggacaccaaaaucgaucuguggagcuauaacgcugaacuccugguggcgcuggagaaucagcauacgauugaccucacagauuccgaaaugaacaagcuguucgagaaaaccaagaaacagcuucgggaaaaugccgaggacaugggaaacggcugcuuuaagaucuaccacaagugugauaaugcuugcaucgggagcauuagaaacggcaccuaugaccaugauguuuaccgcgacgaggcccugaauaaccgguuccagaucaaaggaguggaacucaagucuggcuacaaagacuggauucuguggaucuccuuugccauuagcugcuuccuucugugugucgcucuccugggguuuaucaugugggccugccaaaagggaaauaucagauguaacauuugcaucuga

SEQ ID NO: 193951 - RNA, 1701 nt, Artificial Sequence; identical to SEQ ID NO: 193703
  derived and/or modified sequence opt5 from hemagglutinin__InfluenzaA__AHC62482

SEQ ID NO: 193952 - RNA, 1701 nt, Artificial Sequence; identical to SEQ ID NO: 189879
  derived and/or modified sequence opt5 from hemagglutinin__InfluenzaA__AHC62506

SEQ ID NO: 193953 - RNA, 1701 nt, Artificial Sequence; identical to SEQ ID NO: 190006
  derived and/or modified sequence opt5 from hemagglutinin__InfluenzaA__AHC62518

SEQ ID NO: 193954 - RNA, 1701 nt, Artificial Sequence
  derived and/or modified sequence opt5 from hemagglutinin__InfluenzaA__AHC62530
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugaucaaaucgaggugacaaacgcuaccgaacucgugcagucuagcuccacaggcgagaucugcaauucuccgcaccagauucuggacggggaaaacuguacccuuaucgaugcccugcucggagacccccagugcgauggcuuucaaaauaaaaagugggaccuguucgucgagagaagcaaagcccauuccaacuguuauccuuacgaugugcccgacuaugcuucucugcggagccucguugccuccagcgggacgcuggaauuuaauaacgagucuuucaauuggaccggagugacacagaacggcaccuccagcgcuugcauucgcagaucuaauaacuccuuuuucagccggcuuaauuggcugacacaccucaacuuuaaguacccugcccugaacgucaccaugcccaauaacgagcaguucgauaaacuuuauaucuggggcgugcaucacccugggacggacaaagaucagauuuuucuguacgcgcaagccucuggacgcaucacaguuuccaccaagagaagccagcaggcugugauuccgaauaucggcucccggccccgcgucagaaacaucccuucucgggugagcauuuauuggacaaucgugaaacccggggacauucuccugaucaauuccaccggaaaccugauugccccucgcggcuacuucaagaucagaagcgggaaaucuuccaucaugcggagcgaugcucccauuggaaaguguaauucugccugcaucaccccgaacggcagcauuccuaaugacaagcccuuucagaacgucaaucgcaucacauacggcgcguguccuagauauguuaaacaaaacacgcucaagcuggccaccgggaugcggaaugugcccgaaaaacagacacgcggaauuuucggcgcuaucgccggguuuaucgagaacggaugggaaggcaugguggacgggugguacggauucagacaccaaaauuccgagggccggggccaggcugccgaucuuaagucuacccaggccgcuauugaccagaucaacgggaaacugaacagacucauuggaaagacaaaugagaaauuccaucagaucgaaaaggaguuuagcgaagucgagggccgcauucaagaucuggaaaaguauguggaggacaccaaaaucgaucuuugguccuacaacgcggagcugcucguugcccuggaaaaucagcacacgauugaccugacagauagcgagaugaacaaacucuucgaaaagaccaagaagcagcugcgggagaaugcugaagacauggggaacggaugcuuuaagaucuaucauaagugugauaaugccugcaucggcucuauuagaaacgggaccuacgaccacgauguguaucgcgacgaggcccuuaauaaccgguuccagaucaaaggcgucgagcugaaguccggauacaaagacuggauucucuggaucagcuuugcuauuucuugcuuccugcuuuguguggcccugcucggcuuuaucaugugggcgugccaaaaggggaauaucagauguaacauuugcaucuga

SEQ ID NO: 193955 - RNA, 1701 nt, Artificial Sequence; identical to SEQ ID NO: 193675
  derived and/or modified sequence opt5 from hemagglutinin__InfluenzaA__AHC62542

SEQ ID NO: 193956 - RNA, 1701 nt, Artificial Sequence; identical to SEQ ID NO: 189879
  derived and/or modified sequence opt5 from hemagglutinin__InfluenzaA__AHC62554

SEQ ID NO: 193957 - RNA, 1701 nt, Artificial Sequence
  derived and/or modified sequence opt5 from hemagglutinin__InfluenzaA__AHC62566
augaagaccaucauugcccugagcuacauccucugccugguguucgcucagaaacuucccggcaacgacaauuccacagccacgcugugucucgggcaccaugcggucccuaacggaaccaugguuaagacaauuaccaaugaucaaaucgaggugacaaacgcuaccgaacuggugcaaaauucuagcacaggcgagauuugcgacuccccgcaccagauccuugauggggaaaacuguacccugaucgacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacgcuugaauuuaauaacgagagcuucaauuggaccggagugacacagaacggcaccucuuccgcuugcauucgcagaagcaauaacuccuuuuucucucggcugaauuggcucacacaucugaacuuuaaguauccugcccuuaacgucaccaugcccaauaacgagcaguucgacaagcuguacaucuggggcgugcaccauccugggacggauaaagaccagauuuuucucuaugcgcaagccagcggacgcaucacaguuucuaccaagagaucccagcaggcugugauuccgaauaucggcagccggccccgcgucagaaacauuccuucccggaucucuaucuacuggacaauugugaaacccggggauauccugcugauuaauagcaccggaaaccucaucgccccucgcggcuacuucaagauuagauccgggaaaagcucuaucaugcgguccgacgcucccaucggaaaguguaauagcgaaugcauuaccccgaacggcucuaucccuaaugacaagcccuuucagaacgugaaucgcauuacauauggcgccuguccuagauacgucaaacaaaacacgcugaaacuugcgaccgggaugcggaauguucccgagaagcagacacgcggaaucuucggcgccauugcuggguuuaucgaaaacggaugggagggcaugguggaugggugguauggauucagacaccagaauagcgagggccggggccaagccgcugaccugaaguccacccaggccgccaucgaucagauuaacgggaaacucaacagacugaucggaaagacaaaugaaaaauuccaccagauugagaaggaauuuucugagguggaaggccgcauccaagaccuugagaaguacgucgaggauaccaaaauugaccuguggagcuauaacgcugaacuccugguggcgcuggagaaucagcauacgaucgaucucacagacuccgaaaugaacaagcuguucgagaaaaccaagaaacagcuucgggaaaaugccgaggauauggggaacggaugcuuuaagauuuaccacaagugugacaaugcuugcaucggcagcaucagaaacgggaccuaugaucaugacguuuaccgcgacgaggcccugaauaaccgguuccagauuaaaggcguggaacucaagucuggauacaaagauuggauccuguggauuuccuuugccaucagcugcuuccuucugugugucgcucuccugggcuuuauuaugugggccugccaaaaggggaauaucagauguaacaucugcauuuga

SEQ ID NO: 193958 - RNA, 1701 nt, Artificial Sequence; identical to SEQ ID NO: 189879
  derived and/or modified sequence opt5 from hemagglutinin__InfluenzaA__AHC62578

SEQ ID NO: 193959 - RNA, 1701 nt, Artificial Sequence; identical to SEQ ID NO: 189879
  derived and/or modified sequence opt5 from hemagglutinin__InfluenzaA__AHC62590

SEQ ID NO: 193960 - RNA, 1701 nt, Artificial Sequence; identical to SEQ ID NO: 190006
  derived and/or modified sequence opt5 from hemagglutinin__InfluenzaA__AHC62602

SEQ ID NO: 193961 - RNA, 1701 nt, Artificial Sequence
  derived and/or modified sequence opt5 from hemagglutinin__InfluenzaA__AHC62614
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagaucauugacggggaaaacuguacccuuaucgaugcccugcucggagacccccagugcgauggcuuucaaaauaaaaagugggaccuguucgucgagagaagcaaagcccauuccaacuguuauccuuacgaugugcccgacuaugcuucucugcggagccucguugccuccagcgggacgcuggaauuuaauaacgagucuuucaauuggaccggagugacacagaacggcaccuccagcgcuugcauucgcggcucuaauaacuccuuuuucagcagacuuaauuggcugacacaccucaacuuuaaguacccugcccugaacgucaccaugcccaauaacgagcaguucgauaaacuuuauaucuggggagugcaucacccugggacggacaaagaucagauuuuucuguacgcgcaagccucuggccggaucacaguuuccaccaagcgcagccagcaggcugugauuccgaauaucggguccagaccccggguccgcaacaucccuucuagagugagcauuuauuggacaaucgugaaacccggagacauucuccugaucaauuccaccggcaaccugauugccccucggggguacuucaagauccgcagcggaaaaucuuccaucaugagaagcgaugcucccauuggcaaguguaauucugccugcaucaccccgaacggcagcauuccuaaugacaagcccuuucagaacgucaaucggaucacauacggggcguguccucgcuauguuaaacaaaacacgcucaagcuggccaccggaaugagaaaugugcccgaaaaacagacacggggcauuuucggggcuaucgccggauuuaucgagaacggcugggaagggaugguggacggaugguacggcuuccgccaccaaaauuccgagggcagagggcaggcugccgaucuuaagucuacccaggccgcuauugaccagaucaacggaaaacugaaccggcucauuggcaagacaaaugagaaauuccaucagaucgaaaaggaguuuagcgaagucgaggggcgcauucaagaucuggaaaaguauguggaggacaccaaaaucgaucuuugguccuacaacgcggagcugcucguugcccuggaaaaucagcacacgauugaccugacagauagcgagaugaacaaacucuucgaaaagaccaagaagcagcugagagagaaugcugaagacaugggaaacggcugcuuuaagaucuaucauaagugugauaaugccugcaucgggucuauucggaacggcaccuacgaccacgauguguauagagacgaggcccuuaauaaccgcuuccagaucaaaggagucgagcugaaguccggcuacaaagacuggauucucuggaucagcuuugcuauuucuugcuuccugcuuuguguggcccugcucggguuuaucaugugggcgugccaaaagggaaauauccgguguaacauuugcaucuga

SEQ ID NO: 193962 - RNA, 1701 nt, Artificial Sequence; identical to SEQ ID NO: 193642
  derived and/or modified sequence opt5 from hemagglutinin__InfluenzaA__AHC62626

SEQ ID NO: 193963 - RNA, 1701 nt, Artificial Sequence; identical to SEQ ID NO: 190006
  derived and/or modified sequence opt5 from hemagglutinin__InfluenzaA__AHC62638

SEQ ID NO: 193964 - RNA, 1701 nt, Artificial Sequence; identical to SEQ ID NO: 193806
  derived and/or modified sequence opt5 from hemagglutinin__InfluenzaA__AHC62650

SEQ ID NO: 193965 - RNA, 1701 nt, Artificial Sequence
  derived and/or modified sequence opt5 from hemagglutinin__InfluenzaA__AHC62662
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccucuuguuauccuuacgaugugcccgacuaugcuagccuccggucccugguugccagcucugggacgcuugaauuuaacaaugaguccuucaacuggaccggagugacacagaauggcaccagcucugcuugcauccgcggcuccaacaauagcuuuuucucuagacugaacuggcucacacaccugaauuuuaaguacccugcccuuaacgucaccaugcccaacaaugagcaguucgauaagcuguauauuuggggagugcaucacccugggacggacaaagaucagaucuuucucuacgcgcaagccuccggccggauuacaguuagcaccaagcgcucccagcaggcugugaucccgaacauugggucuagaccccggguccgcaauaucccuagcagaguguccaucuauuggacaauugugaaacccggagacauccugcugauuaacagcaccggcaaucucaucgccccucggggguacuucaagauucgcucuggaaaauccagcaucaugagaucugaugcucccaucggcaaguguaacagcgccugcauuaccccgaauggcuccaucccuaacgacaagcccuuucagaaugucaaccggauuacauacggggcguguccucgcuauguuaaacaaaauacgcugaaacuugccaccggaaugagaaacgugcccgaaaaacagacacggggcaucuucggggcuauugccggauuuaucgagaauggcugggaagggaugguggacggaugguacggcuuccgccaccagaacucugagggcagagggcaagcugccgaucucaagagcacccaggccgcuaucgaccagauuaauggaaaacugaaccggcugaucggcaagacaaacgagaaauuccaucagauugaaaaggaguuuuccgaagucgaggggagaauccaagaucuugaaaaguauguggaggacaccaaaauugaucuguggagcuacaaugcggagcuccugguugcccuggaaaaccagcacacgaucgaccucacagauucugagaugaauaagcuguucgaaaagaccaagaaacagcuucgcgagaacgcugaagacaugggaaauggcugcuuuaagauuuaucauaagugugauaacgccugcaucggguccauccggaauggcaccuacgaccacgauguguauagagacgaggcccugaacaaucgcuuccagauuaaaggagucgagcucaagagcggcuacaaagacuggauccuguggauuucuuuugcuaucuccugcuuccuucuguguguggcccuccugggguuuauuaugugggcgugccaaaagggaaacauccgguguaauaucugcauuuga

SEQ ID NO: 193966 - RNA, 1701 nt, Artificial Sequence
  derived and/or modified sequence opt5 from hemagglutinin__InfluenzaA__AHC62674
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugaucgccuccagcgggacgcuugaauuuaauaacgagucuuucaauuggaccggaguuacacagaacggcaccuccagcgcuugcauucgcggcucuaauaacuccuuuuucagcagacugaauuggcucacacaccugaacuuuaaguacccugcccuuaacgugaccaugcccaauaacgagcaguucgauaagcuguauaucuggggaguccaucacccugggacggacaaagaucagauuuuucucuacgcgcaagccucuggccggaucacaguguccaccaagcgcagccagcaggcuguuauuccgaauaucggguccagaccccgggugcgcaacaucccuucuagagucagcauuuauuggacaaucgugaaacccggagacauucugcugaucaauuccaccggcaaccucauugccccucggggguacuucaagauccgcagcggaaaaucuuccaucaugagaagcgaugcucccauuggcaaguguaauucugccugcaucaccccgaacggcagcauuccuaaugacaagcccuuucagaacgugaaucggaucacauacggggcguguccucgcuaugucaaacaaaacacgcugaaacuugccaccggaaugagaaauguucccgaaaaacagacacggggcauuuucggggcuaucgccggauuuaucgagaacggcugggaagggaugguggacggaugguacggcuuccgccaccaaaauuccgagggcagagggcaggcugccgaucugaagucuacccaggccgcuauugaccagaucaacggaaaacucaaccggcugauuggcaagacaaaugagaaauuccaucagaucgaaaaggaguuuagcgaaguggaggggcgcauucaagaucuugaaaaguaugucgaggacaccaaaaucgaucugugguccuacaacgcggagcuccugguggcccuggaaaaucagcacacgauugaccucacagauagcgagaugaacaagcuguucgaaaagaccaagaaacagcuuagagagaaugcugaagacaugggaaacggcugcuuuaagaucuaucauaagugugauaauaccugcaucgagucuauucggaacgggacauacgaccacgauguuuauagagacgaggcccugaauaaccgcuuccagaucaaaggcguggaacucaaguccggauacaaagacuggauucuguggaucagcuuugccauuucuugcuuccuucugugugucgcucuccugggcuuuaucaugugggccugccaaaaggggaauauccgguguaacauuugcaucuga

SEQ ID NO: 193967 - RNA, 1701 nt, Artificial Sequence; identical to SEQ ID NO: 193084
  derived and/or modified sequence opt5 from hemagglutinin__InfluenzaA__AHE37972

SEQ ID NO: 193968 - RNA, 1701 nt, Artificial Sequence
  derived and/or modified sequence opt5 from hemagglutinin__InfluenzaA__AHE37973
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcaccaagagcuuuuauaaaaaccugaucuggcucguuaaaaagggcaauucuuacccuaaacuguccaagagcuauauuaacgauaaggggaaagaagugcuuguccuguggggaauccaccaccccuccacaaccgcggaccaacagucucucuaccagaaugccgaugcuuacguguucgugggcacgagcagauauuccaagaaauuuaagccugagauugccauccggccgaaaguccgcgaccaggaggggagaauuaacuacuauuggacacugaucgaacccggagauaagauuaccuucgaggcuacaggcaaccugguugugccucgguacgccuuugcgauggaacgcaaugccgggagcggaaucaucauuucugacacccccgugcaugauugcaacaccacaugucaaacgccugagggcgcuaucaauaccucccuccccuuccagaacauucacccgaucacaauuggcaaaugcccuaaguaugucaagagcaccaaacugagacuugccacagggcugcggaaugugcccucuauccagagccgcggacucuuuggcgcuaucgccggguucauugaaggaggcuggaccgggaugguugacggaugguacggcuaucaucaccagaacgagcaaggcuccggguacgccgcugaccugaagucuacgcagaaugcgaucgauaaaauuacaaacaaggugaauagcgucaucgagaaaaugaacacccaguuuaccgccgugggaaaggaguucaaucaccuugagaagagaauugaaaaccugaauaaaaagguugacgauggcuuccucgacaucuggacauacaacgcugagcugcuggugcuccuggaaaaugagcggacccuugauuaucaugacuccaacgucaaaaaccuguacgagaaggugcgcaaucagcucaaaaacaaugccaaggaaaucgggaacggauguuuugaguucuaucacaagugcgauaauacauguauggaaagcgucaaaaacggcacguacgacuauccuaaguacucugaggaagccaaacugaauagagagaagauugauggggugaaacuugaguccacccggaucuaucaaauucuggcuaucuacagcacaguugccucuucccucgugcuggucgugagccugggcgcgauuuccuuuuggaugugcucuaacggaagccuccagugccgcaucuguauuuga

SEQ ID NO: 193969 - RNA, 1701 nt, Artificial Sequence
  derived and/or modified sequence opt5 from hemagglutinin__InfluenzaA__AHE37974
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagauguuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauaucaacgauaaggggaaagaagugcuuguccuguggggcauucaccaccccuccaccacagccgaccaacagucucucuaccagaaugcugaugccuacguguucgugggaaccagcaaguauuccaaaaaguuuaaaccugagaucgcuauuagaccgaagguccgggaccaggaggggcgcaugaacuacuauuggacgcugaucgaacccggagauaaaauuacauucgaggccaccggcaaccugguugugccuagauacgcguuugccauggaacggaaugcugggagcggaaucauuaucucugacacacccgugcaugauugcaacaccaccugucaaacaccugagggcgccaucaauacgucccuccccuuccagaacauucacccgaucaccauuggcaagugcccuaaguaugucaaaagcacaaagcugcgccuugcuaccgggcugagaaaugugcccucuauccagagccggggacucuuuggcgccauugccggguucaucgaaggaggcuggacagggaugguugacggaugguacggcuaucaucaccagaacgagcaaggcuccggguacgcugcggaccugaaaucuacccagaaugccaucgauaagauuacgaacaaagugaauagcgucaucgagaagaugaacacacaguuuaccgcugugggaaaggaguucaaucaccuugagaaacgcauugaaaaccugaauaagaaaguugacgauggcuuccucgacaucuggaccuacaacgccgagcugcuggugcuccuggaaaaugagagaacacuugauuaucaugacuccaacgucaagaaccuguacgagaaagugcggaaucagcucaagaacaaugccaaggaaauugggaacggauguuuugaguucuaucacaaaugcgauaauaccuguauggaaagcgucaagaacggcacauacgacuauccuaaauacucugaggaagcuaagcugaaucgcgagaaaaucgauggggugaaacuugaguccacgagaaucuaucaaauucuggccaucuacagcaccguugcgucuucccucgugcuggucgugagccugggcgcuauuuccuuuuggaugugcucuaacggaagccuccagugccggaucuguauuuga

SEQ ID NO: 193970 - RNA, 1701 nt, Artificial Sequence; identical to SEQ ID NO: 193064
  derived and/or modified sequence opt5 from hemagglutinin__InfluenzaA__AHE37975

SEQ ID NO: 193971 - RNA, 1701 nt, Artificial Sequence
  derived and/or modified sequence opt5 from hemagglutinin__InfluenzaA__AHE37976
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcgccgccuccucuuggagcuacaucguggagacauccucuagcaacaauggaaccugcuauccgggggacuuuauuaacuacgaagaacugcgggagcagcuuuccagcgucucuuccuucgaacgcuuugagaucuuccccaagacgagcucuuggccuaaucacgauuccaacaagggagugaccgcugccuguccccaugcgggcgccaagagcuuuuauaagaaucugaucuggcucguuaaaaagggcaacucuuacccuaaacuguccaagagcuauauuaaugacaaggggaaagaaauccuugugcuguggggcauucaccaccccuccacaaccacagaucaacagucucucuaccagaacgcugacgccuacgucuucgugggcaccagcagauauuccaagaaauuuaagccugagaucgcuauucggccgaaagugcgcgaucaggaggggagaaugaacuacuauuggacgcugaucgaacccggagacaagauuacauucgaggccaccggcaaucuggucguuccucgguacgcguuugccauggaacgcaacgcugggagcggaaucaucauuucugauacacccgugcaugacugcaauaccaccugucaaacaccugagggcgccaucaacacgucccuccccuuccagaauauucacccgaucaccauuggcaaaugcccuaaguaugugaaaagcacaaaacugagacuugcuaccgggcugcggaacguccccucuauccagagccgcggacucuuuggcgccaucgccggguucauugaaggaggcuggacagggaugguggauggaugguacggcuaucaucaccagaaugagcaaggcuccggguacgcugcggaccugaagucuacccagaacgccaucgacaaaauuacgaauaagguuaacagcgugaucgagaaaaugaauacacaguuuaccgcugucggaaaggaguucaaccaccuugagaagagaauugaaaaucugaacaaaaagguggaugacggcuuccucgauaucuggaccuacaaugccgagcugcugguucuccuggaaaacgagcggacacuugacuaucaugauuccaacgugaaaaaucuguacgagaagguccgcaaccagcucaaaaauaacgccaaggaaaucgggaauggauguuuugaguucuaucacaagugcgacaacaccuguauggaaagcgugaaaaauggcacauacgauuauccuaaguacucugaggaagcuaaacugaacagagggaagauugacggcgucaaacuugaguccacgcggaucuaucaaauucuggccaucuacagcaccguggcgucuucccucguucugguggucagccugggagcuauuuccuuuuggaugugcucuaauggcagccuccagugccgcaucuguauuuga

SEQ ID NO: 193972 - RNA, 1701 nt, Artificial Sequence; identical to SEQ ID NO: 193064
  derived and/or modified sequence opt5 from hemagglutinin__InfluenzaA__AHE37977

SEQ ID NO: 193973 - RNA, 1701 nt, Artificial Sequence; identical to SEQ ID NO: 193084
  derived and/or modified sequence opt5 from hemagglutinin__InfluenzaA__AHE37978

SEQ ID NO: 193974 - RNA, 1701 nt, Artificial Sequence; identical to SEQ ID NO: 193064
  derived and/or modified sequence opt5 from hemagglutinin__InfluenzaA__AHE37979

SEQ ID NO: 193975 - RNA, 1701 nt, Artificial Sequence
  derived and/or modified sequence opt5 from hemagglutinin__InfluenzaA__AHE37980
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguuacaccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauuaauuacgaagaacugcgggagcagcuuuccagcgucucuuccuucgaacgcuuugagaucuuccccaagacaagcucuuggccuaaccacgacuccaauaagggagugaccgcugccuguccccaugcuggcgccaagagcuuuuauaaaaaccugaucuggcucguuaaaaagggcaauucuuacccuaaacuguccaagagcuauauuaacgauaaggggaaagaagugcuuguccuguggggaauccaccaccccuccacaaccgcggaccaacagucucucuaccagaaugccgaugcuuacguguucgugggcacgagcagauauuccaagaaauuuaagccugagauugccauccggccgaaaguccgcgaccaggaggggagaaugaacuacuauuggacacugauugaacccggagauaagaucaccuucgaggcuacaggcaaccugguugugccucgguacgccuuugcgauggaacgcaaugccgggagcggaauuaucaucucugacacccccgugcaugauugcaacaccacaugucaaacgccugagggcgcuauuaauaccucccuccccuuccagaacauccacccgauuacaaucggcaaaugcccuaaguaugucaagagcaccaaacugagacuugccacagggcugcggaaugugcccucuauucagagccgcggacucuuuggcgcuaucgccggguucaucgaaggaggcuggaccgggaugguugacggaugguacggcuaucaucaccagaacgagcaaggcuccggguacgccgcugaccugaagucuacgcagaaugcgauugauaaaaucacaaacaaggugaauagcgucauugagaaaaugaacacccaguuuaccgccgugggaaaggaguucaaucaccuugagaagagaaucgaaaaccugaauaaaaagguugacgauggcuuccucgacauuuggacauacaacgcugagcugcuggugcuccuggaaaaugagcggacccuugauuaucaugacuccaacgucaaaaaccuguacgagaaggugcgcaaucagcucaaaaacaaugccaaggaaaucgggaacggauguuuugaguucuaucacaagugcgauaauacauguauggaaagcgucaaaaacggcacguacgacuauccuaaguacucugaggaagccaaacugaauagagagaagaucgauggggugaaacuugaguccacccggauuuaucaaauccuggcuauuuacagcacaguugccucuucccucgugcuggucgugagccugggcgcgaucuccuuuuggaugugcucuaacggaagccuccagugccgcauuuguaucuga

SEQ ID NO: 193976 - RNA, 1701 nt, Artificial Sequence
  derived and/or modified sequence opt5 from hemagglutinin__InfluenzaA__AHE37981
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagauguuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauaucaacgauaaggggaaagaagugcuuguccuguggggcauucaccaccccuccaccacagccgaccaacagucucucuaccagaaugcugaugccuacguguucgugggaaccagcaaguauuccaaaaaguuuaaaccugagaucgcuauuagaccgaagguccgggaccaggaggggcgcaugaacuacuauuggacgcugaucgaacccggagauaaaauuacauucgaggccaccggcaaccugguugugccuagauacgcguuugccauggaacggaaugcugggagcggaaucauuaucucugacacacccgugcaugauugcaacaccaccugucaaacaccugagggcgccaucaauacgucccuccccuuccagaacauucacccgaucaccauuggcaagugcccuaaguaugucaaaagcacaaagcugcgccuugcuaccgggcugagaaaugugcccucuauccagagccggggacucuuuggcgccauugccggguucaucgaaggaggcuggacagggaugguugacggaugguacggcuaucaucaccagaacgagcaaggcuccggguacgcugcggaccugaaaucuacccagaaugccaucgauaagauuacgaacaaagugaauagcgucaucgagaagaugaacauucaguuuacagcugugggaaaggaguucaaucaccuugagaaacgcaucgaaaaccugaauaagaaaguugacgauggcuuccucgacauuuggaccuacaacgccgagcugcuggugcuccuggaaaaugagagaacccuugauuaucaugacuccaacgucaagaaccuguacgagaaagugcggaaucagcucaagaacaaugccaaggaaaucgggaacggauguuuugaguucuaucacaaaugcgauaauacauguauggaaagcgucaagaacggcaccuacgacuauccuaaauacucugaggaagcuaagcugaaucgcgagaaaaucgauggggugaaacuugaguccacaagaauuuaucaaauccuggccauuuacagcacgguugcgucuucccucgugcuggucgugagccugggcgcuaucuccuuuuggaugugcucuaacggaagccuccagugccggauuuguaucuga

SEQ ID NO: 193977 - RNA, 1701 nt, Artificial Sequence; identical to SEQ ID NO: 193064
  derived and/or modified sequence opt5 from hemagglutinin__InfluenzaA__AHE37982

SEQ ID NO: 193978 - RNA, 1701 nt, Artificial Sequence
  derived and/or modified sequence opt5 from hemagglutinin__InfluenzaA__AHE37983
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccgaaagcuauauuaacgauaaggggaaggaggugcuuguccuguggggaauccaccaccccuccaccacagccgaccaacagucucucuaccagaaugcugaugccuacguguucgugggcaccagcagauauuccaaaaaguuuaaaccugagauugcuauccggccgaagguccgcgaccaggaagggagaaugaacuacuauuggacgcugauugagcccggagauaaaaucacauucgaagccaccggcaaccugguugugccucgguacgcguuugccauggagcgcaaugcugggagcggaauuaucaucucugacacacccgugcaugauugcaacaccaccugucaaacaccugaaggcgccauuaauacgucccuccccuuccagaacauccacccgauuaccaucggcaagugcccuaaauaugucaagagcacaaagcugagacuugcuaccgggcugcggaaugugcccucuauucagagccgcggacucuuuggcgccaucgccggguucaucgagggaggcuggacagggaugguugacggaugguacggcuaucaucaccagaacgagcaaggcuccggguacgcugcggaccugaaaucuacccagaaugccauugauaagaucacgaacaaagugaauagcgucauugaaaagaugaacacacaguuuaccgcugugggaaaagaguucaaucaccuugaaaagagaaucgagaaccugaauaagaaaguugacgauggcuuccucgacauuuggaccuacaacgccgaacugcuggugcuccuggagaaugagcggacacuugauuaucaugacuccaacgucaagaaccuguacgaaaaagugcgcaaucagcucaagaacaaugccaaagagaucgggaacggauguuuugaguucuaucacaagugcgauaauaccuguauggagagcgucaagaacggcacauacgacuauccuaaauacucugaagaggcuaagcugaauagagagaaaaucgauggggugaaacuugaauccacgcggauuuaucaaauccuggccauuuacagcaccguugcgucuucccucgugcuggucgugagccugggcgcuaucuccuuuuggaugugcucuaacggaagccuccagugccgcauuuguaucuga

SEQ ID NO: 193979 - RNA, 1701 nt, Artificial Sequence
  derived and/or modified sequence opt5 from hemagglutinin__InfluenzaA__AHE37984
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaagcacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauuaauuacgaggagcugcgggaacagcuuuccagcgucucuuccuucgagcgcuuugaaaucuuccccaaaaccagcucuuggccuaaccacgacuccaauaagggagugacagccgcuuguccccaugccggcgccaagagcuuuuauaaaaaccugaucuggcucguuaagaaaggcaauucuuacccuaagcuguccaaaagcuauauuaacgauaaggggaaggaggugcuuguccuguggggaauccaccaccccuccaccacagccgaccaacagucucucuaccagaaugcugaugccuacguguucgugggcaccagcagauauuccaaaaaguuuaaaccugagauugcuauccggccgaagguccgcgaccaggaagggagaaugaacuacuauuggacgcugauugagcccggagauaaaaucacauucgaagccaccggcaaccugguugugccucgguacgcguuugccauggagcgcaaugcugggagcggaauuaucaucucugacacacccgugcaugauugcaacaccaccugucaaacaccugaaggcgccauuaauacgucccuccccuuccagaacauccacccgauuaccaucggcaagugcccuaaauaugucaagagcacaaagcugagacuugcuaccgggcugcggaaugugcccucuauucagagccgcggacucuuuggcgccaucgccggguucaucgagggaggcuggacagggaugguugacggaugguacggcuaucaucaccagaacgagcaaggcuccggguacgcugcggaccugaaaucuacccagaaugccauugauaagaucacgaacaaagugaauagcgucauugaaaagaugaacacacaguuuaccgcugugggaaaagaguucaaucaccuugaaaagagaaucgagaaccugaauaagaaaguugacgauggcuuccucgacauuuggaccuacaacgccgaacugcuggugcuccuggagaaugagcggacacuugauuaucaugacuccaacgucaagaaccuguacgaaaaagugcgcaaucagcucaagaacaaugccaaagagaucgggaacggauguuuugaguucuaucacaagugcgauaauaccuguauggaaagcgucaagaacggcacauacgacuauccuaaauacucugaagaggcuaagcugaauagagagaaaaucgauggggugaaacuugaauccacgcggauuuaucaaauccuggccauuuacagcaccguugcgucuucccucgugcuggucgugagccugggcgcuaucuccuuuuggaugugcucuaacggaagccuccagugccgcauuuguaucuga

SEQ ID NO: 193980 - RNA, 1701 nt, Artificial Sequence
  derived and/or modified sequence opt5 from hemagglutinin__InfluenzaA__AHE37985
augaagaccaucauugcccugagcuacauccucugccugguguucgcucaggagcuucccggcaacgacgauuccacagccacgcugugucucgggcaccaugcggucccuaauggaaccauuguuaaaacaaucaccaacgaccaaauugaagugacaaaugcuaccgagcuggugcagucuagcuccacaggcgaaaucugcaacucuccgcaccagauccuugauggggagaauuguacccugauugacgcccuccugggagauccccagugcgacggcuuucaaaacaagaaaugggaucuguucgucgaaagaagcaaggcccauuccaauuguuauccuuacgacgugcccgauuaugcuucucuccggagccugguugccuccagcgggacgcuugaguuuaacaaugagucuuucaacuggaccggagugacacagaauggcaccuccagcgcuugcauccgcagaucuaacaauuccuuuuucagccggcugaacuggcucacacaccugaauuuuaaauacccugcccuuaacgucaccaugcccaacaaugaacaguucgacaagcuguauauuuggggcgugcaucacccugggacggauaaggaccagaucuuucucuacgcgcaagccucuggacgcauuacaguuuccaccaaaagaagccagcaggcugugaucccgaacauuggcucccggccccgcgucagaaauaucccuucucgggugagcaucuauuggacaauugugaagcccggggauauccugcugauuaacuccaccggaaaucucaucgccccucgcggcuacuucaaaauuagaagcgggaagucuuccaucaugaaaagcgacgcucccaucggaaaguguaacucugccugcauuaccccgaauggcagcaucccuaacgacaagcccuuucagaaugucaaccggauuacauacggcgcguguccucgcuauguuaaacaaaauacgcugaaacuugccaccgggaugagaaacgugcccgagaagcagacacggggaaucuucggcgcuauugccggguuuaucgaaaauggaugggagggcaugguggaugggugguacggauuccgccaccagaacuccgagggcagaggccaagcugccgaccugaagucuacccaggccgcuaucgaucagauuaaugggaaacucaaccggcugaucggaaagacaaacgaaaaauuccaucagauugagaaggaauuuagcgaggucgaaggcagaauccaagaccuugagaaguauguggaggauaccaaaauugaccugugguccuacaaugcggaacuccugguugcccuggagaaccagcacacgaucgaucucacagacagcgaaaugaauaagcuguucgagaaaaccaagaaacagcuucgcgaaaacgcugaggauauggggaauggaugcuuuaagauuuaucauaagugugacaacgccugcaucggcucuauccggaaugggaccuacgaucacgacguguauagagacgaggcccugaacaaucgcuuccagauuaaaggcgucgaacucaaguccggauacaaagauuggauccuguggauuagcuuugcuaucucuugcuuccuucuguguguggcccuccugggcuuuauuaugugggcgugccaaaaggggaacauccgguguaauaucugcauuuga

SEQ ID NO: 193981 - RNA, 1701 nt, Artificial Sequence; identical to SEQ ID NO: 192946
  derived and/or modified sequence opt5 from hemagglutinin__InfluenzaA__AHE37986

SEQ ID NO: 193982 - RNA, 1701 nt, Artificial Sequence; identical to SEQ ID NO: 192882
  derived and/or modified sequence opt5 from hemagglutinin__InfluenzaA__AHE37987

SEQ ID NO: 193983 - RNA, 1701 nt, Artificial Sequence
  derived and/or modified sequence opt5 from hemagglutinin__InfluenzaA__AHE37988
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagucuacacugaaacuugccacggggaugcgcaacguccccgagaagcaaaccagaggaaucuucggcgcgauugccggguuuaucgaaaauggaugggagggcaugauggaugggugguauggauuccggcaccagaacagcgagggcagaggccaggcugccgaccugaaauccacacaagcugccauugaucagaucaaugggaagcucaaccgccugauuggaaaaaccaaugaaaaguuccaccagaucgagaaggaauuuagcgagguugaaggccggauucagaaccuugagaaauacguggaggacacaaagaucgaucuguggucuuauaacgccgaacuccugguggcucuggagaaucaacauaccaucgaccucacggauuccgaaaugaacaaacuguucgagaagaccaaaaagcagcuuagagaaaaugcggaggacauggggaacggaugcuuuaagauuuaccacaaaugugauaaugccugcaucggcagcauucgcaacgggacauaugaccauaaugucuaccgggaugaggcucugaacaauagauuccagaucaagggcguggaacucaaaucuggauacaaggacuggauucuguggaucuccuuugccaucagcugcuuccuucuguguguugcccuccugggcuuuauuaugugggcuugccagaaagggaacauccgcuguaauauuugcaucuga

SEQ ID NO: 193984 - RNA, 1701 nt, Artificial Sequence; identical to SEQ ID NO: 193018
  derived and/or modified sequence opt5 from hemagglutinin__InfluenzaA__AHE37989

SEQ ID NO: 193985 - RNA, 1701 nt, Artificial Sequence; identical to SEQ ID NO: 192882
  derived and/or modified sequence opt5 from hemagglutinin__InfluenzaA__AHE37990

SEQ ID NO: 193986 - RNA, 1701 nt, Artificial Sequence; identical to SEQ ID NO: 192882
  derived and/or modified sequence opt5 from hemagglutinin__InfluenzaA__AHE37991

SEQ ID NO: 193987 - RNA, 1701 nt, Artificial Sequence
  derived and/or modified sequence opt5 from hemagglutinin__InfluenzaA__AHE37992
augaagaccaucauugcccugagcuacauccucugccugguguucgcucaggagcuucccggcaacgacgauuccacagccacgcugugucucgggcaccaugcggucccuaauggaaccauuguuaaaacaaucaccaacgaccaaauugaagugacaaaugcuaccgagcuggugcagucuagcuccacaggcgaaaucugcaacucuccgcaccagauccuugauggggagaauuguacccugauugacgcccuccugggagauccccagugcgacggcuuucaaaacaagaaaugggaucuguucgucgaaagaagcaaggcccauuccaauuguuauccuuacgacgugcccgauuaugcuucucuccggagccugguugccuccagcgggacgcuugaguuugacaacgagucuuucaauuggaccggagugacacagaacggcaccuccagcgcuugcauccgcagaucuaauaacuccuuuuucagccggcugaauuggcucacacaccugaacuuuaaauacccugcccuuaaugucaccaugcccaacaacgaacaguucgauaagcuguauauuuggggcgugcaucacccugggacggacaaggaucagaucuuucucuacgcgcaagccucuggacgcauuacaguuuccaccaaaagaagccagcaggcugugaucccgaauauuggcucccggccccgcgucagaaacaucccuucucgggugagcaucuauuggacaauugugaagcccggggacauccugcugauuaauuccaccggaaaccucaucgccccucgcggcuacuucaaaauuagaagcgggaagucuuccaucaugcggagcgacgcucccaucggaaaauguaauucugccugcauuaccccgaacggcagcaucccuaaugauaagcccuuucagaacgucaaucgcauuacauacggcgcguguccuagauauguuaagcaaaacacgcugaaacuugccaccgggaugcggaaugugcccgagaagcagacacgcggaaucuucggcgcuauugccggguuuaucgaaaacggaugggagggcaugguggacgggugguacggauucagacaccaaaauuccgagggccggggccaggcugccgaucugaaaucuacccaggccgcuaucgaccagauuaacgggaagcucaauagacugaucggaaaaacaaacgaaaaguuccaucagauugagaaagaauuuagcgaggucgaaggccgcauccaagaucuugagaaguauguggaggacaccaagauugaucugugguccuacaacgcggaacuccugguugcccuggagaaucagcacacgaucgaccucacagauagcgaaaugaacaaacuguucgagaagaccaaaaagcagcuucgggaaaaugcugaggacauggggaacggaugcuuuaaaauuuaucauaagugugauaaugccugcaucggcucuaucagaaacgggaccuacgaccacgacguguaucgcgaugaggcccugaauaaccgguuccagauuaagggcgucgaacucaaauccggauacaaggacuggauccuguggauuagcuuugcuaucucuugcuuccuucuguguguggcccuccugggcuuuauuaugugggcgugccaaaaagggaauaucagauguaacaucugcauuuga

SEQ ID NO: 193988 - RNA, 1701 nt, Artificial Sequence; identical to SEQ ID NO: 193064
  derived and/or modified sequence opt5 from hemagglutinin__InfluenzaA__AHE38023

SEQ ID NO: 193989 - RNA, 1701 nt, Artificial Sequence
  derived and/or modified sequence opt5 from hemagglutinin__InfluenzaA__AHE38024
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuacgcggccgaagguccgcgaccaagaggggagaaugaacuacuauuggacacugguugaacccggagauaaaaucaccuucgaggccacaggcaaccugguggugccucgguacgcguuuaccauggaacgcaaugccgggagcggaauuaucauuucugacacccccguccaugauugcaacacaacgugucagaccccugagggcgcuaucaauacaucccuccccuuccagaacauccacccgauuaccaucggcaagugcccuaaauauguuaagagcacaaagcugagacuugccaccgggcugcggaaugugcccucuauucagagccgcggacucuuuggcgcuaucgccggguucauugaaggaggcuggacggggaugguggacggaugguacggcuaucaucaccaaaacgagcagggcuccggguacgccgcugaccugaaaucuacacagaaugcgaucgauaagaucaccaacaaagucaauagcgugauugagaagaugaacacccaguuuacagccguuggaaaagaguucaaucaccuugagaagagaaucgaaaaccugaauaagaaaguggacgauggcuuccucgacauuuggaccuacaacgcugagcugcugguccuccuggaaaaugagcggacacuugauuaucaugacuccaacgugaagaaccuguacgagaaaguccgcaaucaacucaagaacaaugccaaagaaaucgggaacggauguuuugaguucuaucacaagugcgauaauacguguauggaaagcgugaagaacggcaccuacgacuauccuaaauacucugaggaagccaagcugaauagagagaaaauugaugggguuaaacuugaguccacacggaucuaucagauccuggcuauuuacagcaccguggccucuucccucguccuggugguuagccugggcgcgaucuccuuuuggaugugcucuaacggaagccuccagugccgcauuuguaucuga

SEQ ID NO: 193990 - RNA, 1701 nt, Artificial Sequence
  derived and/or modified sequence opt5 from hemagglutinin__InfluenzaA__AHE38026
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgaaaaggggaaggaggugcuuguccuguggggaauccaccaccccuccaccacagccgaucagcagucucucuaccagaaugcugacgccuacguguucgugggcaccagcagauauuccaaaaaguuuaaaccugagauugcuauccggccgaagguccgcgaucaagaagggagaaugaacuacuauuggacgcugguugagcccggagacaaaauuacauucgaagccaccggcaaccugguggugccucgguacgcguuuacaauggagcgcaaugccgggagcggaaucauuaucucugauacccccguccaugacugcaacaccacaugucagacgccugaaggcgcuaucaauaccucccuccccuuccagaacauucacccgaucacaauuggcaagugcccuaaauauguuaagagcaccaagcugagacuugccacagggcugcggaaugugcccucuauccagagccgcggacucuuuggcgcuauugccggguucaucgagggaggcuggaccgggaugguggauggaugguacggcuaucaucaccaaaacgagcagggcuccggguacgccgcugaccugaaaucuacgcagaaugcgaucgacaagauuacaaacaaagucaauagcgugaucgaaaagaugaacacccaguuuaccgccguuggaaaagaguucaaucaccuugaaaagagaauugagaaccugaauaagaaaguggaugacggcuuccucgauaucuggacauacaacgcugaacugcugguccuccuggagaaugagcggacccuugacuaucaugauuccaacgugaagaaccuguacgaaaaaguccgcaaucaacucaagaacaaugccaaagagauugggaacggauguuuugaguucuaucacaagugcgacaauacauguauggagagcgugaagaacggcacguacgauuauccuaaauacucugaagaggccaagcugaauagagagaaaaucgacgggguuaaacuugaauccacccggaucuaucagauucuggcuaucuacagcacaguggccucuucccucguccuggugguuagccugggcgcgauuuccuuuuggaugugcucuaacggaagccuccagugccgcaucuguauuuga

SEQ ID NO: 193991 - RNA, 1701 nt, Artificial Sequence; identical to SEQ ID NO: 192907
  derived and/or modified sequence opt5 from hemagglutinin__InfluenzaA__AHE38027

SEQ ID NO: 193992 - RNA, 1683 nt, Artificial Sequence
  derived and/or modified sequence opt5 from hemagglutinin__InfluenzaA__AHF20558
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccaauauuccucgcaucuguuccaagggcaaaagaacaguugaucuggggcaaugcggacuccugggcaccaucacggggccgccccagugugaccaguuucuugaguucucugccgaucugauuaucgaacggcgcgagggaagcgacgugugcuacccuggcaaguuugucaacgaggaagcccucagacagauucugcgggaguccggcgggaucgauaaagaagcuaugggauucaccuauucuggcauucgcacaaauggggccaccagcgcuuguagacgguccggaucuagcuuuuacgccgagaugaaguggcugcucuccaacacagacaaugcggccuucccccaaaugaccaagagcuauaaaaacacgcgcaagucuccugcucugaucguguggggcauucaccauuccguuagcacagccgagcagaccaaacuuuacgggucuggaaauaagcuggugacagucggcuccagcaacuaucagcagucuuuugugcccuccccuggcgcuagaccgcaagugaaugggcucagcggacggaucgauuuccacuggcugaugcuuaaccccaaugacaccgucaccuuuuccuucaacggcgccuuuaucgcgccugaucgcgccucuuuccugagagggaaaagcaugggcauucaguccggaguucagguggacgcuaacugcgaaggggauuguuaccauagcggaggcacaaucauuucuaaucuccccuuucagaacaucgacucccgggccgugggcaagugcccucgcuaugucaagcaaagaagccugcugcucgcuacggggaugaaaaaugugcccgagauuccgaagggacggggccuguucggggccaucgccggauucaucgaaaacggcugggaggggcuuauugauggcugguacggauuuagacaccagaaugcucagggcgaagggaccgcggccgacuacaaaucuacacaaagcgcuaucgaccagauuaccggaaagcugaaccgccucaucgagaaaacaaaucagcaguucgagcugauugauaacgaauuuaaugagguugaaaagcaaaucggcaacgugaucaauuggacccgggacuccauuacggaggucuggucuuauaacgccgaacuucugguggccauggagaaucagcacacaaucgaucucgcugacagcgagauggauaaacuguacgaaagaguuaagcgccagcugcgggagaacgccgaagaggacgggaccggauguuucgaaauuuuucauaagugcgaugacgauuguauggcguccaucagaaauaacaccuaugaccacagcaaauaccgcgaggaggcuaugcagaaccggauucaaaucgauccugugaagcucucuuccggcuauaaagacgucauucugugguucagcuuuggggccucuugcuucauccuucuggccaucgugaugggccucgucuuuauuugcgugcagaauggaaacaugagauguacaaucggcauuuga

SEQ ID NO: 193993 - RNA, 1683 nt, Artificial Sequence
  derived and/or modified sequence opt5 from hemagglutinin__InfluenzaA__AHF20568
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccaauauuccucgcaucuguuccaagggcaaaagaacaguugaucuggggcaaugcggacuccugggcaccaucacggggccgccccagugugaccaguuucuugaguucucugccgaucugauuaucgaacggcgcgagggaagcgacgugugcuacccuggcaaguuugucaacgaggaagcccucagacagauucugcgggaguccggcgggaucgauaaagaagcuaugggauucaccuauucuggcauucgcacaaauggggccaccagcgcuuguagacgguccggaucuagcuuuuacgccgagaugaaguggcugcucuccaacacagacaaugcggccuucccccaaaugaccaagagcuauaaaaacacgcgcaagucuccugcucugaucguguggggcauucaccauuccguuagcacagccgagcagaccaaacuuuacgggucuggaaauaagcuggugacagucggcuccagcaacuaucagcagucuuuugugcccuccccuggcgcuagaccgcaagugaaugggcucagcggacggaucgauuuccacuggcugaugcuuaaccccaaugacaccgucaccuuuuccuucaacggcgccuuuaucgcgccugaucgcgccucuuuccugagagggaaaagcaugggcauucaguccggaguucagguggacgcuaacugcgaaggggauuguuaccauagcggaggcacaaucaugucuaaucuccccuuucagaacauugacucccgggccgugggcaagugcccucgcuaugucaagcaaagaagccugcugcucgcuacggggaugaaaaaugugcccgagaucccgaagggacggggccuguucggggccauugccggauucaucgaaaacggcugggaggggcuuaucgauggcugguacggauuuagacaccagaaugcucagggcgaagggaccgcggccgacuacaaaucuacacaaagcgcuauugaccagaucaccggaaagcugaaccgccucauugagaaaacaaaucagcaguucgagcugaucgauaacgaauuuaaugagguugaaaagcaaauuggcaacgugaucaauuggacccgggacuccaucacggaggucuggucuuauaacgccgaacuucugguggccauggagaaucagcacacaauugaucucgcugacagcgagauggauaaacuguacgaaagaguuaagcgccagcugcgggagaacgccgaagaggacgggaccggauguuucgaaaucuuucauaagugcgaugacgauuguauggcguccauuagaaauaacaccuaugaccacagcaaauaccgcgaggaggcuaugcagaaccggauccaaauugauccugugaagcucucuuccggcuauaaagacgucauccugugguucagcuuuggggccucuugcuucauucuucuggccaucgugaugggccucgucuuuaucugcgugaagaauggaaacaugagauguacaauuugcaucuga

SEQ ID NO: 193994 - RNA, 1698 nt, Artificial Sequence; identical to SEQ ID NO: 190817
  derived and/or modified sequence opt5 from hemagglutinin__InfluenzaA__AHG96108

SEQ ID NO: 193995 - RNA, 1698 nt, Artificial Sequence; identical to SEQ ID NO: 190817
  derived and/or modified sequence opt5 from hemagglutinin__InfluenzaA__AHG96120

SEQ ID NO: 193996 - RNA, 1698 nt, Artificial Sequence; identical to SEQ ID NO: 190817
  derived and/or modified sequence opt5 from hemagglutinin__InfluenzaA__AHG96132

SEQ ID NO: 193997 - RNA, 1698 nt, Artificial Sequence
  derived and/or modified sequence opt5 from hemagglutinin__InfluenzaA__AHG96144
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgugcagaaagcccuguaccauaccgagaaugcuuacgucagcguuguguccucucacuauagcagaaaguucacacccgaaauugccaagcggccuaaagugcgcgaccaggaggggagaaucaacuacuauuggacccuucuggagcccggagauacgauuaucuuugaagcgaauggcaaccucauugccccucgguacgcuuucgcccugucccgcggguuuggaagcggcaucauuaauucuaacgcucccauggacaagugugaugccaaaugccagacaccgcaaggcgcgaucaauuccagccuuccuuuccagaacguccaucccgugaccaucggggaguguccuaaguauguuagaucugccaaacugcggauggugacaggacuccgcaauauucccagcauccaguccagaggccuguuuggggcuauugccggauucaucgaaggcggguggaccggaauggucgacggcugguacggcuaucaccaccagaacgagcaagggucuggauacgcugccgaucaaaagagcacccagaaugccauuaacggcaucacaaauaaagugaacuccguuaucgaaaagaugaauacgcaguuuaccgcuguggggaaggaguucaacaaacuggagcggcgcauggaaaaccucaauaagaaagucgacgauggauucauugacaucuggacauacaacgcggagcugcuugugcugcucgaaaaugagagaacccuggauuuucaugacagcaacgucaagaaucuuuaugaaaaagugaagucucagcugaagaacaaugccaaagagauuggcaacgggugcuucgaguuuuaccacaaguguaaugacgaaugcauggaguccguuaaaaacggcacauaugauuaccccaaguauagcgaagagucuaaacucaaucgggagaagaucgacggagugaagcuggaauccaugggcgucuaccagauucuggcuaucuauagcaccguggccuccucucucguucugcuugugagccugggggccaucuccuucuggaugugcucuaacggaagccuccagugucgcauuugcaucuga

SEQ ID NO: 193998 - RNA, 1698 nt, Artificial Sequence; identical to SEQ ID NO: 190817
  derived and/or modified sequence opt5 from hemagglutinin__InfluenzaA__AHG96156

SEQ ID NO: 193999 - RNA, 1698 nt, Artificial Sequence; identical to SEQ ID NO: 190817
  derived and/or modified sequence opt5 from hemagglutinin__InfluenzaA__AHG96168

SEQ ID NO: 194000 - RNA, 1698 nt, Artificial Sequence; identical to SEQ ID NO: 190817
  derived and/or modified sequence opt5 from hemagglutinin__InfluenzaA__AHG96180

SEQ ID NO: 194001 - RNA, 1698 nt, Artificial Sequence; identical to SEQ ID NO: 190817
  derived and/or modified sequence opt5 from hemagglutinin__InfluenzaA__AHG96192

SEQ ID NO: 194002 - RNA, 1698 nt, Artificial Sequence; identical to SEQ ID NO: 190817
  derived and/or modified sequence opt5 from hemagglutinin__InfluenzaA__AHG96204

SEQ ID NO: 194003 - RNA, 1698 nt, Artificial Sequence; identical to SEQ ID NO: 190817
  derived and/or modified sequence opt5 from hemagglutinin__InfluenzaA__AHG96216

SEQ ID NO: 194004 - RNA, 1698 nt, Artificial Sequence; identical to SEQ ID NO: 190817
  derived and/or modified sequence opt5 from hemagglutinin__InfluenzaA__AHG96228

SEQ ID NO: 194005 - RNA, 1698 nt, Artificial Sequence; identical to SEQ ID NO: 193997
  derived and/or modified sequence opt5 from hemagglutinin__InfluenzaA__AHG96240

SEQ ID NO: 194006 - RNA, 1698 nt, Artificial Sequence; identical to SEQ ID NO: 190817
  derived and/or modified sequence opt5 from hemagglutinin__InfluenzaA__AHG96252

SEQ ID NO: 194007 - RNA, 1698 nt, Artificial Sequence; identical to SEQ ID NO: 190817
  derived and/or modified sequence opt5 from hemagglutinin__InfluenzaA__AHG96264

SEQ ID NO: 194008 - RNA, 1698 nt, Artificial Sequence; identical to SEQ ID NO: 190817
  derived and/or modified sequence opt5 from hemagglutinin__InfluenzaA__AHG96276

SEQ ID NO: 194009 - RNA, 1698 nt, Artificial Sequence; identical to SEQ ID NO: 190817
  derived and/or modified sequence opt5 from hemagglutinin__InfluenzaA__AHG96288

SEQ ID NO: 194010 - RNA, 1698 nt, Artificial Sequence; identical to SEQ ID NO: 190817
  derived and/or modified sequence opt5 from hemagglutinin__InfluenzaA__AHG96300

SEQ ID NO: 194011 - RNA, 1701 nt, Artificial Sequence
  derived and/or modified sequence opt5 from hemagglutinin__InfluenzaA__AHG96312
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugugccccuccaucugggcaaaugcaacaucgccggguggauucugggaaauccugagugugaaucucucagcacagccuccucuuggagcuacaucgucgagaccuccucuagcgacaacggcacgugcuauccgggggauuuuauuaauuacgaagaacugcgggagcagcuuuccagcgugucuuccuucgaacgcuuugagaucuuccccaagaccagcucuuggccuaaccacgacuccaauaagggaguuacagcugccuguccccaugcuggcgccaagagcuuuuauaagaaccugaucuggcucgugaaaaagggcaauucuuacccuaaacugucccaaagcuauauuaacgauaaggggaaggaaguccuugugcuguggggaauccaccaccccuccaccacagcggaccagcagucucucuaccagaaugccgaugcuuacguguucgucggcaccagcagauauuccaaaaaguuuaaaccugagauugccauccggccgaagguucgcgaccaagaggggagaaugaacuacuauuggacgcugguggaacccggagauaaaauuacauucgaggcuaccggcaaccugguggucccucgguacgccuuuacaauggaacgcaaugcggggagcggaaucauuaucucugacacccccgugcaugauugcaacaccacaugucagacgccugagggcgccaucaauaccucccuccccuuccagaacauucacccgaucacaauuggcaagugcccuaaauauguuaagagcaccaagcugagacuugcuacagggcugcggaaugugcccucuauccagagccgcggacucuuuggcgccauugcuggguucaucgaaggaggcuggaccgggauggucgacggaugguacggcuaucaucaccaaaacgagcagggcuccggguacgccgccgaccugaaaucuacgcagaaugcuaucgauaagauuacaaacaaagugaauagcguuaucgagaagaugaacacccaguuuaccgcggugggaaaagaguucaaucaccuugagaagagaauugaaaaccugaauaagaaagucgacgauggcuuccucgacaucuggacauacaacgccgagcugcuggugcuccuggaaaaugagcggacccuugauuaucaugacuccaacgucaagaaccuguacgagaaagugcgcaaucaacucaagaacaaugcuaaagaaauugggaacggauguuuugaguucuaucacaagugcgauaauacauguauggaaagcguuaagaacggcacguacgacuauccuaaauacucugaggaagccaagcugaauagagagaaaaucgauggggugaaacuugaguccacccggaucuaucagauucuggccaucuacagcacagucgcuucuucccucgugcugguugugagccugggcgccauuuccuuuuggaugugcucuaacggaagccuccagugccgcaucuguauuuga

SEQ ID NO: 194012 - RNA, 1701 nt, Artificial Sequence; identical to SEQ ID NO: 193064
  derived and/or modified sequence opt5 from hemagglutinin__InfluenzaA__AHG96313

SEQ ID NO: 194013 - RNA, 1701 nt, Artificial Sequence
  derived and/or modified sequence opt5 from hemagglutinin__InfluenzaA__AHG96314
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaggaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauauguuaagagcaccaagcugagacuugccacagggcugcggaaugugcccucuauccagagccgcggacucuuuggcgcuauugccggguucaucgaaggaggcuggaccgggaugguggacggaugguacggcuaucaucaccaaaacgagcagggcuccggguacgccgcugaccugaaaucuacgcagaaugcgaucgauaagauuacaaacaaagucaauagcgugaucgagaagaugaacacccaguacaccgccguuggaaaagaauuuaaucaccuugagaagagaauugaaaaccugaauaagaaaguggacgauggcuuccucgacaucuggacauauaacgcugagcugcugguccuccuggaaaaugagcggacccuugauuaccaugacuccaacgugaagaaccuguaugagaaaguccgcaaucaacucaagaacaaugccaaagaaauugggaacggauguuucgaguuuuaccacaagugcgauaauacauguauggaaagcgugaagaacggcacguaugacuacccuaaauauucugaggaagccaagcugaauagagagaaaaucgaugggguuaaacuugaguccacccggaucuaccagauucuggcuaucuacagcacaguggccucuucccucguccuggugguuagccugggcgcgauuuccuucuggaugugcucuaacggaagccuccagugccgcaucuguauuuga

SEQ ID NO: 194014 - RNA, 1701 nt, Artificial Sequence; identical to SEQ ID NO: 193064
  derived and/or modified sequence opt5 from hemagglutinin__InfluenzaA__AHG96315

SEQ ID NO: 194015 - RNA, 1701 nt, Artificial Sequence; identical to SEQ ID NO: 193064
  derived and/or modified sequence opt5 from hemagglutinin__InfluenzaA__AHG96316

SEQ ID NO: 194016 - RNA, 1701 nt, Artificial Sequence; identical to SEQ ID NO: 193064
  derived and/or modified sequence opt5 from hemagglutinin__InfluenzaA__AHG96317

SEQ ID NO: 194017 - RNA, 1701 nt, Artificial Sequence; identical to SEQ ID NO: 193064
  derived and/or modified sequence opt5 from hemagglutinin__InfluenzaA__AHG96320

SEQ ID NO: 194018 - RNA, 1701 nt, Artificial Sequence; identical to SEQ ID NO: 193064
  derived and/or modified sequence opt5 from hemagglutinin__InfluenzaA__AHG96321

SEQ ID NO: 194019 - RNA, 1701 nt, Artificial Sequence; identical to SEQ ID NO: 193064
  derived and/or modified sequence opt5 from hemagglutinin__InfluenzaA__AHG96322

SEQ ID NO: 194020 - RNA, 1701 nt, Artificial Sequence; identical to SEQ ID NO: 193064
  derived and/or modified sequence opt5 from hemagglutinin__InfluenzaA__AHG96324

SEQ ID NO: 194021 - RNA, 1701 nt, Artificial Sequence; identical to SEQ ID NO: 193064
  derived and/or modified sequence opt5 from hemagglutinin__InfluenzaA__AHG96325

SEQ ID NO: 194022 - RNA, 1701 nt, Artificial Sequence
  derived and/or modified sequence opt5 from hemagglutinin__InfluenzaA__AHG96326
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccaacucugacaauggcacgugcuauccgggggauuuuauuaacuacgaagaacugcgggagcagcuuagcuccgucagcucuuucgaacgcuuugagaucuuccccaagaccuccagcuggccuaaucacgacucuaacaagggagugacagccgcuuguccccaugccggcgcgaaauccuuuuauaagaaucugaucuggcucguuaaaaagggcaacagcuacccuaaacugucucaauccuauauuaaugauaaggggaaggaagugcuuguccuguggggaauccaccaccccagcaccacagccgaccagcagucccucuaccagaacgcugaugccuacguguucgugggcaccucuagauauagcaaaaaguuuaaaccugagauugcuauccggccgaagguccgcgaccaagaggggagaaugaacuacuauuggacgcugguugaacccggagauaaaauuacauucgaggccaccggcaaucugguggugccucgguacgcguuuacaauggaacgcaacgccggguccggaaucauuaucagcgacacccccguccaugauugcaauaccacaugucagacgccugagggcgcuaucaacaccucucuccccuuccagaauauucacccgaucacaauuggcaagugcccuaaauaugugaaguccaccaagcugagacuugccacagggcugcggaacguucccagcauccagucucgcggacucuuuggcgcuauugccggguucaucgaaggaggcuggaccgggaugguggacggaugguacggcuaucaucaccaaaaugagcagggcagcggguacgccgcugaccugaaauccacgcagaacgcgaucgauaagauuacaaauaaagucaacucugugaucgagaagaugaauacccaguuuaccgccguuggaaaagaguucaaccaccuugagaagagaauugaaaaucugaacaagaaaguggacgauggcuuccucgacaucuggacauacaaugcugagcugcugguccuccuggaaaacgagcggacccuugauuaucaugacagcaacgugaagaaucuguacgagaaaguccgcaaccaacucaagaauaacgccaaagaaauugggaauggauguuuugaguucuaucacaagugcgauaacacauguauggaauccgugaagaauggcacguacgacuauccuaaauacagcgaggaagccaagcugaacagagagaaaaucgaugggguuaaacuugagucuacccggaucuaucagauucuggcuaucuacuccacaguggccagcucucucguccuggugguuucccugggcgcgauuagcuuuuggaugugcuccaauggaucucuccagugccgcaucuguauuuga

SEQ ID NO: 194023 - RNA, 1701 nt, Artificial Sequence; identical to SEQ ID NO: 193064
  derived and/or modified sequence opt5 from hemagglutinin__InfluenzaA__AHG96327

SEQ ID NO: 194024 - RNA, 1701 nt, Artificial Sequence
  derived and/or modified sequence opt5 from hemagglutinin__InfluenzaA__AHG96329
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauuaauuacgaagaacugcgggagcagcuuuccagcgucucuuccuucgaacgcuuugagaucuuccccaagacaagcucuuggccuaaccacgacuccaauaagggagugaccgcugccuguccccaugcuggcgccaagagcuuuuauaagaaccugaucuggcucguuaaaaagggcaauucuuacccuaaacugucccaaagcuauauuaacgauaaggggaaggaagugcuuguccuguggggaauccaccaccccuccacaaccgcggaccagcagucucucuaccagaaugccgaugcuuacguguucgugggcacgagcagauauuccaaaaaguuuaaaccugagauugccauccggccgaagguccgcgaccaagaggggagaaugaacuacuauuggacacugguugaacccggagauaaaauuaccuucgaggcuacaggcaaccugguggugccucgguacgccuuuaccauggaacgcaaugcggggagcggaaucauuaucucugacacccccguccaugauugcaacacaacgugucagaccccugagggcgccaucaauacaucccuccccuuccagaacauucacccgaucaccauuggcaagugcccuaaauauguuaagagcacaaagcugagacuugcuaccgggcugcggaaugugcccucuauccagagccgcggacucuuuggcgccauugcuggguucaucgaaggaggcuggacggggaugguggacggaugguacggcuaucaucaccaaaacgagcagggcuccggguacgccgccgaccugaaaucuacacagaaugcuaucgauaagauuaccaacaaagucaauagcgugaucgagaagaugaacacccaguuuacagcgguuggaaaagaguucaaucaccuugagaagagaauugaaaaccugaauaagaaaguggacgauggcuuccucgacaucuggaccuacaacgccgagcugcugguccuccuggaaaaugagcggacacuugauuaucaugacuccaacgugaagaaccuguacgagaaaauucgcaaucaacucaagaacaaugcuaaagaaaucgggaacggauguuuugaguucuaucacaagugcgauaauacguguauggaaagcgucaagaacggcaccuacgaguauccuaaauacucugaagaggccaagcugaauagagagaaaaucgacggggugaaacuugaauccacaaaaauuuaucagauccuggccauuuacagcaccguugcuucuucccucgugcuggucgugagccugggcgccaucuccuuuuggaugugcucuaacggaagccuccagugccggauuuguaucuga

SEQ ID NO: 194025 - RNA, 1701 nt, Artificial Sequence
  derived and/or modified sequence opt5 from hemagglutinin__InfluenzaA__AHG96330
augaaggccauccuggugguccuccuguacaccuucgcuacagccacggcggacacccuuugcauuggcuaucacgcuaacaauagcacagauaccguugacacagugcuggagaagaacgugaccgucacacauuccgugaaucuccuggaagauaagcacaacgggaaacuuuguaagcugagaggaguugcuccccuccaucugggcaaaugcaauaucgccggguggauucugggaaacccugagugugaaucucucagcaccgccuccucuuggagcuacaucguggagacguccucuagcgacaaugggaccugcuauccgggcgauuuuauuaacuacgaagaacugcgggagcagcuuuccagcgucucuuccuucgaacgcuuugagaucuuccccaagacaagcucuuggccuaaucacgacuccaacaagggagugaccgccgcuuguccccaugccggcgcgaaaucuuuuuauaagaaucugaucuggcucguuaaaaagggcaacagcuacccuaaacugucccaaagcuauauuaaugauaaggggaaggaagugcuuguccuguggggaauccaccaccccuccacaaccgccgaccagcagucucucuaccagaacgcugaugccuacguguucgugggcacgagcagauauuccaaaaaguuuaaaccugagauugcuauccggccgaagguccgcgaccaagaggggagaaugaauuacuauuggacacugguugaacccggagauaaaauuaccuucgaggccacaggcaaccugguggugccucgguacgcguuuaccauggaacgcaacgccgggagcggaaucauuaucucugacacccccguccaugauugcaauacaacgugucagaccccugagggcgcuaucaacacaucccuccccuuccagaauauucacccgaucaccauuggcaagugcccuaaauauguuaagagcacaaagcugucucuugccaccgggcugagaaacgugcccagcauccagucccggggacucuuuggcgcuauugccggguucaucgaaggaggcuggacggggaugguggacggaugguacggcuaucaucaccaaaaugagcagggcucuggguacgccgcugaccugaaaagcacacagaacgcgaucgauaagauuaccaauaaagucaacuccgugaucgagaagaugaauacccaguuuacagccguuggaaaagaguucaaccaccuugagaagcgcauugaaaaucugaacaagaaaguggacgauggcuuccucgacaucuggaccuacaaugcugagcugcugguccuccuggaaaacgagagaacacuugauuaucaugacagcaaugugaagaaccuguacgagaaaauucggaaccaacucaagaauaacgccaaagaaaucgggaauggauguuuugaguucuaucacaagugcgauaacacguguauggaaucugucaagaauggcaccuacgacuauccuaaauacuccgaggaagccaagcugaaccgcgagaaaaucgauggggugaaacuugagagcacaagaauuuaucagauccuggcuauuuacucuaccguugccuccagccucgugcuggucgugucccugggcgcgaucucuuuuuggaugugcagcaauggaucccuccagugccggauuuguaucuga

SEQ ID NO: 194026 - RNA, 1701 nt, Artificial Sequence; identical to SEQ ID NO: 193064
  derived and/or modified sequence opt5 from hemagglutinin__InfluenzaA__AHG96332

SEQ ID NO: 194027 - RNA, 1701 nt, Artificial Sequence
  derived and/or modified sequence opt5 from hemagglutinin__InfluenzaA__AHG96334
augaaggccauccuggugguccuccuguacacccuugcuacagccaacgcggacacgcugugcauuggcuaucacgcuaauaacagcaccgauacaguugacaccgugcucgagaaaaaugugacagucacccauuccgugaaccugcuugaagauaagcacaaugggaaacuguguaagcucagaggaguugcuccccugcaucugggcaaaugcaacaucgccggguggauucucggaaauccugagugugaaucucugagcacagccuccucuuggagcuacaucguggagaccuccucuagcgacaacggcacgugcuauccgggggauuucauuaauuacgaggaacuucgggagcagcuguccagcgucucuuccuuugaacgcuucgagaucuuucccaagaccagcucuuggccuaaccacgacuccaauaagggagugacagccgcuuguccccaugccggcgcgaaaucuuucuauaagaaccucaucuggcugguuaaaaagggcaauagcuacccuaaacuuucccaaagcuauauuaacgauaaggggaaggaagugcugguccucuggggaauccaccaccccuccaccacagccgaccagcagucucuguaccagaaugcugaugccuacguguuugugggcaccagcagauauuccaaaaaguucaaaccugagauugcuauccggccgaagguccgcgaccaagaggggagaaugaacuacuauuggacgcugguugaacccggagauaaaauuacauuugaggccaccggcaaccucguggugccucgguacgcguucacaauggaacgcaaugccgggagcggaaucauuaucucugacacccccguccaugauugcaacaccacaugucagacgccugagggcgcuaucaauaccucccugcccuuucagaacauucacccgaucacaauuggcaagugcccuaaauauguuaagagcaccaaacuuagacuggccacagggcuccggaaugugcccucuauccagagccgcggacuguucggcgcuauugccggguuuaucgaaggaggcuggaccgggaugguggacggaugguacggcuaucaucaccaaaacgagcagggcuccggguacgccgcugaccuuaagucuacgcagaaugcgaucgauaagauuacaaacaaagucaauagcgugaucgagaagaugaacacccaguucaccgccguuggaaaagaauuuaaucaccuggagaagagaauugaaaaccucaauaagaaaguggacgauggcuuccuggacaucuggacauacaacgcugagcugcucguccugcuugaaaaugagcggacccuggauuaucaugacuccaacgugaagaaccucuacgagaaaguccgcaaucaacugaagaacaaugccaaagaaauugggaacggauguuucgaguuuuaucacaagugcgauaauacauguauggaaagcgugaagaacggcacguacgacuauccuaaauacucugaggaagccaaacuuaauagagagaagaucgaugggguuaagcuggaguccacccggaucuaucagauucucgcuaucuacagcacaguggccucuucccugguccuggugguuagccucggcgcgauuuccuucuggaugugcucuaacggaagccugcagugccgcaucuguauuuga

SEQ ID NO: 194028 - RNA, 1701 nt, Artificial Sequence
  derived and/or modified sequence opt5 from hemagglutinin__InfluenzaA__AHG96335
augaaggccauccuggugguccuccuguacaccuucgagacagcuaacgccgacacgcuuugcauuggcuaucacgcgaauaacagcaccgauacaguugacaccgugcuggagaaaaaugugacagucacccauuccgugaaccuccuggaagauaagcacaaugggaaacuuuguaagcugaaaggaguugcuccccuccaucugggcaagugcaacaucgccggguggauucugggaaauccugaaugugagucucucagcacagccuccucuuggagcuacaucguggaaaccuccucuagcgacaacggcacgugcuauccgggggauuuuauuaauuacgaggagcugagagaacagcuuuccagcgucucuuccuucgagcgguuugaaaucuuccccaagaccagcucuuggccuaaccacgacuccaauaaaggagugacagcugccuguccccaugcuggcgccaagagcuuuuauaaaaaccugaucuggcucguuaagaaaggcaauucuuacccuaagcugucccaaagcuauauuaacgauaaggggaaagaggugcuuguccuguggggaauccaccaccccuccaccacagcggaccagcagucucucuaccagaaugccgaugcuuacguguucgugggcaccagccgcuauuccaagaaauuuaagccugagauugccaucagaccgaaaguccgggaccaagaagggcgcaugaacuacuauuggacgcugguugagcccggagauaagauuacauucgaagcuaccggcaaccugguggugccuagauacgccuuuacaauggagcggaaugcggggagcggaaucauuaucucugacacccccguccaugauugcaacaccacaugucagacgccugaaggcgccaucaauaccucccuccccuuccagaacauucacccgaucacaauuggcaaaugcccuaaguaugugaaaagcaccaaacugcgccuugcuacagggcugagaaauguucccucuauccagagccggggacucuuuggcgccauugcuggguucaucgagggaggcuggaccgggaugguggacggaugguacggcuaucaucaccaaaacgagcagggcuccggguacgccgccgaccugaagucuacgcagaaugcuaucgauaaaauuacaaacaaggucaauagcgugaucgaaaagaugaacacccaguuuaccgcgguuggaaaggaguucaaucaccuugaaaagcgcauugagaaccugaauaaaaagguggacgauggcuuccucgacaucuggacauacaacgccgaacugcugguccuccuggagaaugagagaacccuugauuaucaugacuccaacgugaaaaaccuguacgaaaagguccggaaucaacucaaaaacaaugcuaaggagauugggaacggauguuuugaguucuaucacaagugcgauaauacauguauggaaagcgugaaaaacggcacguacgacuauccuaaguacucugaagaggccaaacugaaucgcgagaagaucgaugggguuaaacuugaauccaccagaaucuaucagauucuggccaucuacagcacaguggcuucuucccucguccuggugguuagccugggcgccauuuccuuuuggaugugcucuaacggaagccuccagugccggaucuguauuuga

SEQ ID NO: 194029 - RNA, 1701 nt, Artificial Sequence
  derived and/or modified sequence opt5 from hemagglutinin__InfluenzaA__AHG96336
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccgucagagauugcaacaccacaugucagacgccugagggcgcuaucaauaccucccuccccuuccagaacauucauccgaucacaauuggcaagugcccuaaauauguuaagagcaccaagcugcggcuugccacagggcugcgcaaugugcccucuauccagagcagaggacucuuuggcgcuauugccggguucaucgaaggaggcuggaccgggaugguggacggaugguacggcuaucaccaucaaaacgagcagggcuccggguacgccgcugaccugaaaucuacgcagaaugcgaucgauaagauuacaaacaaagucaauagcgugaucgagaagaugaacacccaguuuaccgccguuggaaaagaguucaaucaccuugagaagcggauugaaaaccugaauaagaaaguggacgauggcuuccucgacaucuggacauacaacgcugagcugcugguccuccuggaaaaugagcgcacccuugauuaucacgacuccaacgugaagaaccuguacgagaaagucagaaaucaacucaagaacaaugccaaagaaauugggaacggauguuuugaguucuaucauaagugcgauaauacauguauggaaagcgugaagaacggcacguacgacuauccuaaauacucugaggaagccaagcugaaucgggagaaaaucgaugggguuaaacuugaguccacccgcaucuaucagauucuggcuaucuacagcacaguggccucuucccucguccuggugguuagccugggcgcgauuuccuuuuggaugugcucuaacggaagccuccagugcagaaucuguauuuga

SEQ ID NO: 194030 - RNA, 1701 nt, Artificial Sequence
  derived and/or modified sequence opt5 from hemagglutinin__InfluenzaA__AHG96338
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguagccaugccggcgcgaaaucuuuuuauaagaaccugaucuggcucguuaaaaagggcaauuccuaccccaaacugagccaauccuauauuaacgauaaggggaaggaagugcuuguccuguggggaauccaccacccuucuaccacagccgaccagcagagccucuaccagaaugcugaugccuacguguucgugggcaccuccagauauagcaaaaaguuuaaacccgagauugcuauccggccuaagguccgcgaccaagaggggagaaugaacuacuauuggacgcugguugaaccgggagauaaaauuacauucgaggccaccggcaaccugguggugccccgguacgcguuuacaauggaacgcaaugccgggucuggaaucauuaucuccgacaccccuguccaugauugcaacaccacaugucagacgcccgagggcgcuaucaauaccagccucccuuuccagaacauucaccccaucacaauuggcaagugcccgaaauaugugaagucuaccaagcugagacuugccacagggcugcggaauguuccuagcauccagucccgcggacucuuuggcgcuauugccggguucaucgaaggaggcuggaccgggaugguggacggaugguacggcuaucaucaccaaaacgagcagggcucuggguacgccgcugaccugaaaagcacgcagaaugcgaucgauaagauuacaaacaaagucaauuccgugaucgagaagaugaacacccaguuuaccgccguuggaaaagaguucaaucaccuugagaagagaauugaaaaccugaauaagaaaguggacgauggcuuccucgacaucuggacauacaacgcugagcugcugguccuccuggaaaaugagcggacccuugauuaucaugacagcaacgugaagaaccuguacgagaaaguccgcaaucaacucaagaacaaugccaaagaaauugggaacggauguuuugaguucuaucacaagugcgauaauacauguauggaaucugugaagaacggcacguacgacuaucccaaauacuccgaggaagccaagcugaauagagagaaaaucgaugggguuaaacuugagagcacccggaucuaucagauucuggcuaucuacucuacaguggccuccagccucguccuggugguuucccugggcgcgauuucuuuuuggaugugcagcaacggaucccuccagugccgcaucuguauuuga

SEQ ID NO: 194031 - RNA, 1701 nt, Artificial Sequence
  derived and/or modified sequence opt5 from hemagglutinin__InfluenzaA__AHG96339
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaaauccuugugcuguggggcauucaccaccccuccaccacagccgaccagcagucucucuaccagaaugcugaugccuacgucuucgugggaaccagcagauauuccaaaaaguuuaaaccugagaucgcuauucggccgaaggugcgcgaccaagaggggagaaugaacuacuauuggacgcuggucgaacccggagauaaaaucacauucgaggccaccggcaaccugguugugccucgguacgcguuuacaauggaacgcaaugccgggagcggaauuaucaucucugacacccccgugcaugauugcaacaccacaugucagacgccugagggcgcuauuaauaccucccuccccuuccagaacauccacccgauuacaaucggcaagugcccuaaauaugucaagagcaccaagcugagacuugccacagggcugcggaaugugcccucuauucagagccgcggacucuuuggcgcuaucgccggguucaucgaaggaggcuggaccgggaugguugacggaugguacggcuaucaucaccaaaacgagcagggcuccggguacgccgcugaccugaaaucuacgcagaaugcgauugauaagaucacaaacaaagugaauagcgucauugagaagaugaacacccaguuuaccgccgugggaaaagaguucaaucaccuugagaagagaaucgaaaaccugaauaagaaaguugacgauggcuuccucgacauuuggacauacaacgcugagcugcuggugcuccuggaaaaugagcggacccuugauuaucaugacuccaacgucaagaaccuguacgagaaagugcgcaaucaacucaagaacaaugccaaagaaaucgggaacggauguuuugaguucuaucacaagugcgauaauacauguauggaaagcgucaagaacggcacguacgacuauccuaaauacucugaggaagccaagcugaauagagagaaaaucgauggggugaaacuugaguccacccggauuuaucagauccuggcuauuuacagcacaguugccucuucccucgugcuggucgugagccugggcgcgaucuccuuuuggaugugcucuaacggaagccuccagugccgcauuuguaucuga

SEQ ID NO: 194032 - RNA, 1701 nt, Artificial Sequence; identical to SEQ ID NO: 193064
  derived and/or modified sequence opt5 from hemagglutinin__InfluenzaA__AHG96340

SEQ ID NO: 194033 - RNA, 1701 nt, Artificial Sequence
  derived and/or modified sequence opt5 from hemagglutinin__InfluenzaA__AHG96341
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcaaauauuccaagaaauuuaagccugagauugcuaucagaccgaaaguccgggaccaagaggggcgcaugaacuacuauuggacgcugguugaacccggagauaagauuacauucgaggccaccggcaaccugguggugccuagauacgcguuuacaauggaacggaaugccgggagcggaaucauuaucucugacacccccguccaugauugcaacaccacaugucagacgccugagggcgcuaucaauaccucccuccccuuccagaacauucacccgaucacaauuggcaaaugcccuaaguauguuaagagcaccaaacugcgccuugccacagggcugagaaauauccccucuauucagagccggggacucuuuggcgcuaucgccggguucaucgaaggaggcuggaccgggaugguggacggaugguacggcuaucaucaccaaaacgagcagggcuccggguacgccgcugaccugaagucuacgcagaaugcgauugauaaaaucacaaacaaggugaauagcgucauugagaaaaugaacacccaguuuaccgccgugggaaaggaguucaaucaccuugagaagcgcaucgaaaaccugaauaaaaagguugacgauggcuuccucgacauuuggacauacaacgcugagcugcuggugcuccuggaaaaugagagaacccuugauuaucaugacuccaacgucaaaaaccuguacgagaaggugcggaaucaacucaaaaacaaugccaaggaaaucgggaacggauguuuugaguucuaucacaagugcgauaauacauguauggaaagcgucaaaaacggcacguacgacuauccuaaguacucugaggaagccaaacugaaucgcgagaagaucgauggggugaaacuugaguccaccagaauuuaucagauccuggcuauuuacagcacaguugccucuucccucgugcuggucgugagccugggcgcgaucuccuuuuggaugugcucuaacggaagccuccagugccggauuuguaucuga

SEQ ID NO: 194034 - RNA, 1701 nt, Artificial Sequence
  derived and/or modified sequence opt5 from hemagglutinin__InfluenzaA__AHG96342
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauauguuaagagcaccaagcugagacuugccacagggcugcggaauauccccucuauucagagccgcggacucuuuggcgcuaucgccggguucaucgaaggaggcuggaccgggaugguggacggaugguacggcuaucaucaccaaaacgagcagggcuccggguacgccgcugaccugaaaucuacgcagaaugcgauugauaagaucacaaacaaagugaauagcgucauugagaagaugaacacccaguuuaccgccgugggaaaagaguucaaucaccuugagaagagaaucgaaaaccugaauaagaaaguugacgauggcuuccucgacauuuggacauacaacgcugagcugcuggugcuccuggaaaaugagcggacccuugauuaucaugacuccaacgucaagaaccuguacgagaaagugcgcaaucaacucaagaacaaugccaaagaaaucgggaacggauguuuugaguucuaucacaagugcgauaauauguguauggaaagcgucaagaacggcacauacgacuauccuaaauacucugaggaagccaagcugaauagagagaaaaucgauggggugaaacuugaguccacgcggauuuaucagauccuggcuauuuacagcaccguugccucuucccucgugcuggucgugagccugggcgcgaucuccuuuuggaugugcucuaacggaagccuccagugccgcauuuguaucuga

SEQ ID NO: 194035 - RNA, 1701 nt, Artificial Sequence
  derived and/or modified sequence opt5 from hemagglutinin__InfluenzaA__AHG96343
augaaggccauccuggugguccuccuguacaccuucgcuacagccacggcggacacccuuugcauuggcuaucacgcuaacaauagcacagauaccguugacacagugcuggagaagaacgugaccgucacacauuccgugaaucuccuggaagauaagcacaacgggaaacuuuguaagcugagaggaguugcuccccuccaucugggcaaaugcaauaucgccggguggauucugggaaacccugagugugaaucucucagcaccgccuccucuuggagcuacaucguggagacguccaauucugacaacgggaccugcuauccgggcgauuuuauuaauuacgaagaacugcgggagcagcuuagcuccgucagcucuuucgaacgcuuugagaucuuccccaagacauccagcuggccuaaccacgacucuaauaagggagugaccgccgcuuguccccaugccggcgcgaaauccuuuuauaagaaccugaucuggcucguuaaaaagggcaauagcuacccuaaacugucucaauccuauauuaacgauaaggggaaggaagugcuuguccuguggggaauccaccaccccagcacaaccgccgaccagcagucccucuaccagaaugcugaugccuacguguucgugggcacgucuagauauagcaaaaaguuuaaaccugagauugcuauccggccgaagguccgcgaccaagaggggagaaugaacuacuauuggacacugguugaacccggagauaaaauuaccuucgaggccacaggcaaccugguggugccucgguacgcguuuaccauggaacgcaaugccggguccggaaucauuaucagcgacacccccguccaugauugcaacacaacgugucagaccccugagggcgcuaucaauacaucucuccccuuccagaacauucacccgaucaccauuggcaagugcccuaaauaugugaaguccacaaagcugagacuugccaccgggcugcggaauguucccagcauccagucucgcggacucuuuggcgcuauugccggguucaucgaaggaggcuggacggggaugguggacggaugguacggcuaucaucaccaaaacgagcagggcagcggguacgccgcugaccugaaauccacacagaaugcgaucgauaagauuaccaacaaagucaauucugugaucgagaagaugaacacccaguuuacagccguuggaaaagaguucaaucaccuugagaagagaauugaaaaccugaauaagaaaguggacgauggcuuccucgacaucuggaccuacaacgcugagcugcugguccuccuggaaaaugagcggacacuugauuaucaugacagcaacgugaagaaccuguacgagaaaguccgcaaucaacucaagaacaaugccaaagaaauugggaacggauguuuugaguucuaucacaagugcgauaauacguguauggaauccgugaagaacggcaccuacgacuauccuaaauacagcgaggaagccaagcugaauagagagaaaaucgaugggguuaaacuugagucuacacggaucuaucagauucuggcuaucuacuccaccguggccagcucucucguccuggugguuucccugggcgcgauuagcuuuuggaugugcuccaacggaucucuccagugccgcaucuguauuuga

SEQ ID NO: 194036 - RNA, 1701 nt, Artificial Sequence; identical to SEQ ID NO: 193064
  derived and/or modified sequence opt5 from hemagglutinin__InfluenzaA__AHG96344

SEQ ID NO: 194037 - RNA, 1701 nt, Artificial Sequence; identical to SEQ ID NO: 194027
  derived and/or modified sequence opt5 from hemagglutinin__InfluenzaA__AHG96345

SEQ ID NO: 194038 - RNA, 1701 nt, Artificial Sequence; identical to SEQ ID NO: 193064
  derived and/or modified sequence opt5 from hemagglutinin__InfluenzaA__AHG96346

SEQ ID NO: 194039 - RNA, 1701 nt, Artificial Sequence; identical to SEQ ID NO: 193064
  derived and/or modified sequence opt5 from hemagglutinin__InfluenzaA__AHG96347

SEQ ID NO: 194040 - RNA, 1701 nt, Artificial Sequence; identical to SEQ ID NO: 193064
  derived and/or modified sequence opt5 from hemagglutinin__InfluenzaA__AHG96348

SEQ ID NO: 194041 - RNA, 1701 nt, Artificial Sequence; identical to SEQ ID NO: 193064
  derived and/or modified sequence opt5 from hemagglutinin__InfluenzaA__AHG96349

SEQ ID NO: 194042 - RNA, 1701 nt, Artificial Sequence; identical to SEQ ID NO: 193064
  derived and/or modified sequence opt5 from hemagglutinin__InfluenzaA__AHG96350

SEQ ID NO: 194043 - RNA, 1701 nt, Artificial Sequence; identical to SEQ ID NO: 193064
  derived and/or modified sequence opt5 from hemagglutinin__InfluenzaA__AHG96351

SEQ ID NO: 194044 - RNA, 1701 nt, Artificial Sequence; identical to SEQ ID NO: 193064
  derived and/or modified sequence opt5 from hemagglutinin__InfluenzaA__AHG96352

SEQ ID NO: 194045 - RNA, 1701 nt, Artificial Sequence
  derived and/or modified sequence opt5 from hemagglutinin__InfluenzaA__AHG96353
augaaggccauccuggugguccuccuguacaccuucgcuacaacgaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauuaauuacgaagaacugcgggagcagcuuuccagcgucucuuccuucgaacgcuuugagaucuuccccaagacaagcucuuggccuaaccacgacuccaauaagggagugaccgcugccuguccccaugcuggcgccaagagcuuuuauaagaaccugaucuggcucguuaaaaagggcaauucuuacccuaaacugucccaaagcuauauuaacgauaaggggaaggaagugcuuguccuguggggaauccaccaccccuccacaaccgcggaccagcagucucucuaccagaaugccgaugcuuacguguucgugggcacgagcagauauuccaaaaaguuuaaaccugagauugccauccggccgaagguccgcgaccaagaggggagaaugaacuacuauuggacacugguugaacccggagauaaaauuaccuucgaggcuacaggcaaccugguggugccucgguacgccuuuaccauggaacgcaaugcggggagcggaaucauuaucucugacacccccguccaugauugcaacacaacgugucagaccccugagggcgccaucaauacaucccuccccuuccagaacauucacccgaucaccauuggcaagugcccuaaauauguuaagagcacaaagcugagacuugcuaccgggcugcggaaugugcccucuauccagagccgcggacucuuuggcgccauugcuggguucaucgaaggaggcuggacggggaugguggacggaugguacggcuaucaucaccaaaacgagcagggcuccggguacgccgccgaccugaaaucuacacagaaugcuaucgauaagauuaccaacaaagucaauagcgugaucgagaagaugaacacccaguuuacagcgguuggaaaagaguucaaucaccuugagaagagaauugaaaaccugaauaagaaaguggacgauggcuuccucgacaucuggaccuacaacgccgagcugcugguccuccuggaaaaugagcggacacuugauuaucaugacuccaacgugaagaaccuguacgagaaaguccgcaaucaacucaagaacaaugcuaaagaaauugggaacggauguuuugaguucuaucacaagugcgauaauacguguauggaaagcgugaagaacggcaccuacgacuauccuaaauacucugaggaagccaagcugaauagagagaaaaucgaugggguuaaacuugaguccacacggaucuaucagauucuggccaucuacagcaccguggcuucuucccucguccuggugguuagccugggcgccauuuccuuuuggaugugcucuaacggaagccuccagugccgcaucuguauuuga

SEQ ID NO: 194046 - RNA, 1701 nt, Artificial Sequence; identical to SEQ ID NO: 193064
  derived and/or modified sequence opt5 from hemagglutinin__InfluenzaA__AHG96354

SEQ ID NO: 194047 - RNA, 1701 nt, Artificial Sequence
  derived and/or modified sequence opt5 from hemagglutinin__InfluenzaA__AHG96355
augaaggccauccuggugguccuccuguacacccuugcuacagccaacgcggacacgcugugcauuggcuaucacgcuaauaacagcaccgauacaguugacaccgugcucgagaaaaaugugacagucacccauuccgugaaccugcuugaagauaagcacaaugggaaacuguguaagcucagaggaguugcuccccugcaucugggcaaaugcaacaucgccggguggauucucggaaauccugagugugaaucucugagcacagccuccucuuggagcuacaucguggagaccuccucuagcgacaacggcacgugcuauccgggggauuucauuaauuacgaggaacuucgggagcagcuguccagcgucucuuccuuugaacgcuucgagaucuuucccaagaccagcucuuggccuaaccacgacuccaauaagggagugacagccgcuuguccccaugccggcgcgaaaucuuucuauaagaaccucaucuggcugguuaaaaagggcaauagcuacccuaaacuuucccaaagcuauauuaacgauaaggggaaggaagugcugguccucuggggaauccaccaccccuccaccacagccgaccagcagucucuguaccagaaugcugaugccuacguguuugugggcaccagcagauauuccaaaaaguucaaaccugagauugcuauccggccgaagguccgcgaccaagaggggagaaugaacuacuauuggacgcugguugaacccggagauaaaauuacauuugaggccaccggcaaccucguggugccucgguacgcguucacaauggaacgcaaugccgggagcggaaucauuaucucugacacccccguccaugauugcaacaccacaugucagacgccugagggcgcuaucaauaccucccugcccuuucagaacauucacccgaucacaauuggcaagugcccuaaauauguuaagagcaccaaacuuagacuggccacagggcuccggaaugugcccucuauccagagccgcggacuguucggcgcuauugccggguuuaucgaaggaggcuggaccgggaugguggacggaugguacggcuaucaucaccaaaacgagcagggcuccggguacgccgcugaccuuaagucuacgcagaaugcgaucgauaagauuacaaacaaagucaauagcgugaucgagaagaugaacacccaguucaccgccguuggaaaagaauuuaaucaacuggagaagagaauugaaaaccucaauaagaaaguggacgauggcuuccuggacaucuggacauacaacgcugagcugcucguccugcuugaaaaugagcggacccuggauuaucacgacuccaacgugaagaaccucuacgagaaaguccgcaaucagcugaagaacaaugccaaagaaauugggaacggauguuucgaguuuuaucauaagugcgauaauacauguauggaaagcgugaagaacggcacguacgacuauccuaaauacucugaggaagccaaacuuaauagagagaagaucgaugggguuaagcuggaguccacccggaucuaucagauucucgcuaucuacagcacaguggccucuucccugguccuggugguuagccucggcgcgauuuccuucuggaugugcucuaacggaagccugcaaugccgcaucuguauuuga

SEQ ID NO: 194048 - RNA, 1701 nt, Artificial Sequence; identical to SEQ ID NO: 192882
  derived and/or modified sequence opt5 from hemagglutinin__InfluenzaA__AHG96356

SEQ ID NO: 194049 - RNA, 1701 nt, Artificial Sequence
  derived and/or modified sequence opt5 from hemagglutinin__InfluenzaA__AHG96359
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacgacgaaucuuucaauuggaccggcgugacacagaacggcaccuccagcucuugcaagcgcagauccaauaacagcuuuuucucucggcugaauuggcucacacaucugaaguuuaaauauccugcucuuaacgucaccaugcccaauaacgagaaguucgauaaacuguacaucuggggagugcaccauccuguuacggacaacgaucagauuuuucucuaugcccaggcguccgggcgcaucacagugagcaccaagagaucccaacagacagucauuccgaauaucggcucucggccccgcauuagaaacaucccuagccggaucuccauuuacuggaccaucgugaaacccggggacauucugcugaucaauagcaccggaaaccucauugccccucgcggcuacuucaagaucagaucugggaaguccagcaucaugcggucugacgcucccauuggaaaauguaauagcgagugcaucacaccgaacggcuccauuccuaaugauaagcccuuucagaacgugaaucgcaucacguauggcgccuguccuagauacgucaaacagaacacccugaagcuggcuacagggaugcggaauguucccgaaaaacaaacccgcggaauuuucggcgccaucgcgggguuuaucgagaacggaugggaaggcaugguggacgggugguauggauucagacaccaaaauucugagggcauuggccaggccgcugaucuuaagagcacacaggccgcuaucaaccagauuaaugggaaacucaaccggcugaucggaaagaccaacgagaaguuccaccagauugaaaaagaguuuuccgaaguggagggcagaauccaggaccuugaaaaguacgucgaggauacgaaaauugaccuguggagcuauaaugccgagcuccugguggcccuggaaaaccaacauacaaucgaucucaccgacucugagaugaauaagcuguucgaacgcaccaaaaagcagcuucgggagaacgcugaagauauggggaauggaugcuuuaagaucuaccacaaaugugacaacgcgugcauuggcuccaucagaaaugggacauaugaucaugacguuuaccgcgacgaggcccugaacaaucgguuccagauuaagggcguggagcucaaaagcggauacaaggauuggauccuguggauuucuuuugcuaucuccugcuuccuucugugugucgcccuccugggcuuuaucaugugggccugccagaaagggaacauuagauguaauaucugcauuuga

SEQ ID NO: 194050 - RNA, 1701 nt, Artificial Sequence; identical to SEQ ID NO: 194049
  derived and/or modified sequence opt5 from hemagglutinin__InfluenzaA__AHG96371

SEQ ID NO: 194051 - RNA, 1701 nt, Artificial Sequence; identical to SEQ ID NO: 194049
  derived and/or modified sequence opt5 from hemagglutinin__InfluenzaA__AHG96383

SEQ ID NO: 194052 - RNA, 1698 nt, Artificial Sequence; identical to SEQ ID NO: 190817
  derived and/or modified sequence opt5 from hemagglutinin__InfluenzaA__AHG96395

SEQ ID NO: 194053 - RNA, 1701 nt, Artificial Sequence; identical to SEQ ID NO: 194049
  derived and/or modified sequence opt5 from hemagglutinin__InfluenzaA__AHG96407

SEQ ID NO: 194054 - RNA, 1701 nt, Artificial Sequence; identical to SEQ ID NO: 194049
  derived and/or modified sequence opt5 from hemagglutinin__InfluenzaA__AHG96419

SEQ ID NO: 194055 - RNA, 1701 nt, Artificial Sequence; identical to SEQ ID NO: 194049
  derived and/or modified sequence opt5 from hemagglutinin__InfluenzaA__AHG96431

SEQ ID NO: 194056 - RNA, 1701 nt, Artificial Sequence; identical to SEQ ID NO: 194049
  derived and/or modified sequence opt5 from hemagglutinin__InfluenzaA__AHG96443

SEQ ID NO: 194057 - RNA, 1701 nt, Artificial Sequence; identical to SEQ ID NO: 194049
  derived and/or modified sequence opt5 from hemagglutinin__InfluenzaA__AHG96455

SEQ ID NO: 194058 - RNA, 1701 nt, Artificial Sequence; identical to SEQ ID NO: 194049
  derived and/or modified sequence opt5 from hemagglutinin__InfluenzaA__AHG96467

SEQ ID NO: 194059 - RNA, 1701 nt, Artificial Sequence; identical to SEQ ID NO: 194049
  derived and/or modified sequence opt5 from hemagglutinin__InfluenzaA__AHG96479

SEQ ID NO: 194060 - RNA, 1701 nt, Artificial Sequence; identical to SEQ ID NO: 194049
  derived and/or modified sequence opt5 from hemagglutinin__InfluenzaA__AHG96491

SEQ ID NO: 194061 - RNA, 1701 nt, Artificial Sequence; identical to SEQ ID NO: 185380
  derived and/or modified sequence opt5 from hemagglutinin__InfluenzaA__AHG96503

SEQ ID NO: 194062 - RNA, 1698 nt, Artificial Sequence; identical to SEQ ID NO: 190817
  derived and/or modified sequence opt5 from hemagglutinin__InfluenzaA__AHG96515

SEQ ID NO: 194063 - RNA, 1698 nt, Artificial Sequence; identical to SEQ ID NO: 190817
  derived and/or modified sequence opt5 from hemagglutinin__InfluenzaA__AHG96527

SEQ ID NO: 194064 - RNA, 1698 nt, Artificial Sequence; identical to SEQ ID NO: 190817
  derived and/or modified sequence opt5 from hemagglutinin__InfluenzaA__AHG96539

SEQ ID NO: 194065 - RNA, 1698 nt, Artificial Sequence; identical to SEQ ID NO: 190817
  derived and/or modified sequence opt5 from hemagglutinin__InfluenzaA__AHG96551

SEQ ID NO: 194066 - RNA, 1698 nt, Artificial Sequence; identical to SEQ ID NO: 193997
  derived and/or modified sequence opt5 from hemagglutinin__InfluenzaA__AHG96563

SEQ ID NO: 194067 - RNA, 1698 nt, Artificial Sequence; identical to SEQ ID NO: 190817
  derived and/or modified sequence opt5 from hemagglutinin__InfluenzaA__AHG96575

SEQ ID NO: 194068 - RNA, 1698 nt, Artificial Sequence; identical to SEQ ID NO: 190817
  derived and/or modified sequence opt5 from hemagglutinin__InfluenzaA__AHG96587

SEQ ID NO: 194069 - RNA, 1698 nt, Artificial Sequence; identical to SEQ ID NO: 190817
  derived and/or modified sequence opt5 from hemagglutinin__InfluenzaA__AHG96599

SEQ ID NO: 194070 - RNA, 1698 nt, Artificial Sequence; identical to SEQ ID NO: 190817
  derived and/or modified sequence opt5 from hemagglutinin__InfluenzaA__AHG96611

SEQ ID NO: 194071 - RNA, 1698 nt, Artificial Sequence; identical to SEQ ID NO: 190817
  derived and/or modified sequence opt5 from hemagglutinin__InfluenzaA__AHG96623

SEQ ID NO: 194072 - RNA, 1698 nt, Artificial Sequence; identical to SEQ ID NO: 190817
  derived and/or modified sequence opt5 from hemagglutinin__InfluenzaA__AHG96635

SEQ ID NO: 194073 - RNA, 1698 nt, Artificial Sequence; identical to SEQ ID NO: 190817
  derived and/or modified sequence opt5 from hemagglutinin__InfluenzaA__AHG96647

SEQ ID NO: 194074 - RNA, 1698 nt, Artificial Sequence; identical to SEQ ID NO: 190817
  derived and/or modified sequence opt5 from hemagglutinin__InfluenzaA__AHG96659

SEQ ID NO: 194075 - RNA, 1698 nt, Artificial Sequence; identical to SEQ ID NO: 190817
  derived and/or modified sequence opt5 from hemagglutinin__InfluenzaA__AHG96671

SEQ ID NO: 194076 - RNA, 1698 nt, Artificial Sequence; identical to SEQ ID NO: 190817
  derived and/or modified sequence opt5 from hemagglutinin__InfluenzaA__AHG96683

SEQ ID NO: 194077 - RNA, 1701 nt, Artificial Sequence; identical to SEQ ID NO: 194049
  derived and/or modified sequence opt5 from hemagglutinin__InfluenzaA__AHG96695

SEQ ID NO: 194078 - RNA, 1701 nt, Artificial Sequence; identical to SEQ ID NO: 194049
  derived and/or modified sequence opt5 from hemagglutinin__InfluenzaA__AHG96707

SEQ ID NO: 194079 - RNA, 1701 nt, Artificial Sequence; identical to SEQ ID NO: 194049
  derived and/or modified sequence opt5 from hemagglutinin__InfluenzaA__AHG96719

SEQ ID NO: 194080 - RNA, 1701 nt, Artificial Sequence; identical to SEQ ID NO: 194049
  derived and/or modified sequence opt5 from hemagglutinin__InfluenzaA__AHG96731

SEQ ID NO: 194081 - RNA, 1701 nt, Artificial Sequence; identical to SEQ ID NO: 194049
  derived and/or modified sequence opt5 from hemagglutinin__InfluenzaA__AHG96743

SEQ ID NO: 194082 - RNA, 1701 nt, Artificial Sequence; identical to SEQ ID NO: 194049
  derived and/or modified sequence opt5 from hemagglutinin__InfluenzaA__AHG96755

SEQ ID NO: 194083 - RNA, 1701 nt, Artificial Sequence; identical to SEQ ID NO: 194049
  derived and/or modified sequence opt5 from hemagglutinin__InfluenzaA__AHG96767

SEQ ID NO: 194084 - RNA, 1701 nt, Artificial Sequence; identical to SEQ ID NO: 194049
  derived and/or modified sequence opt5 from hemagglutinin__InfluenzaA__AHG96779

SEQ ID NO: 194085 - RNA, 1701 nt, Artificial Sequence
  derived and/or modified sequence opt5 from hemagglutinin__InfluenzaA__AHG96791
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacgacgaaucuuucaauuggaccggcgugacacagaacggcaccuccagcucuugcaagcgcagauccaauaacagcuuuuucucucggcugaauuggcucacacagcugaaguuuaaauauccugcucuuaacgucaccaugcccaauaacgagaaguucgauaaacuguacaucuggggagugcaucacccuguuacggacaacgaucagauuuuucucuaugcccaagcguccgggcgcaucacagugagcaccaagagaucccagcagacagucauuccgaauaucggcucucggccccgcauuagaaacaucccuagccggaucuccauuuacuggaccaucgugaaacccggggacauucugcugaucaauagcaccggaaaccucauugccccucgcggcuacuucaagaucagaucugggaaguccagcaucaugcggucugacgcucccauuggaaaauguaauagcgagugcaucacaccgaacggcuccauuccuaaugauaagcccuuucagaacgugaaucgcaucacguauggcgccuguccuagauacgucaaacaaaacacccugaagcuggcuacagggaugcggaauguucccgaaaaacagacccgcggaauuuucggcgccaucgcgggguuuaucgagaacggaugggaaggcaugguggacgggugguauggauucagacaucaaaauucugagggcauuggccaggccgcugaucuuaagagcacacaggccgcuaucaaccagauuaaugggaaacucaaccggcugaucggaaagaccaacgagaaguuccaccagauugaaaaagaguuuuccgaaguggagagacgcauccaagaccuugaaaaguacgucgaggauacgaaaauugaccuguggagcuauaaugccgagcuccugguggcccuggaaaaccagcacacaaucgaucucaccgacucugagaugaauaagcuguucgaacggaccaaaaagcagcuuagagagaacgcugaagauaugggcaaugggugcuuuaagaucuaccauaaaugugacaacgcgugcauuggauccauccgcaauggcacauaugaucacgacguuuaccgggacgaggcccugaacaauagauuccagauuaaggggguggagcucaaaagcggcuacaaggauuggauccuguggauuucuuuugcuaucuccugcuuccuucugugugucgcccuccugggauuuaucaugugggccugccaaaaaggcaacauucgcuguaauaucugcauuuga

SEQ ID NO: 194086 - RNA, 1701 nt, Artificial Sequence; identical to SEQ ID NO: 194049
  derived and/or modified sequence opt5 from hemagglutinin__InfluenzaA__AHG96803

SEQ ID NO: 194087 - RNA, 1701 nt, Artificial Sequence; identical to SEQ ID NO: 194049
  derived and/or modified sequence opt5 from hemagglutinin__InfluenzaA__AHG96815

SEQ ID NO: 194088 - RNA, 1701 nt, Artificial Sequence; identical to SEQ ID NO: 194049
  derived and/or modified sequence opt5 from hemagglutinin__InfluenzaA__AHG96827

SEQ ID NO: 194089 - RNA, 1701 nt, Artificial Sequence; identical to SEQ ID NO: 194049
  derived and/or modified sequence opt5 from hemagglutinin__InfluenzaA__AHG96839

SEQ ID NO: 194090 - RNA, 1701 nt, Artificial Sequence; identical to SEQ ID NO: 194049
  derived and/or modified sequence opt5 from hemagglutinin__InfluenzaA__AHG96851

SEQ ID NO: 194091 - RNA, 1701 nt, Artificial Sequence; identical to SEQ ID NO: 194049
  derived and/or modified sequence opt5 from hemagglutinin__InfluenzaA__AHG96863

SEQ ID NO: 194092 - RNA, 1701 nt, Artificial Sequence; identical to SEQ ID NO: 194049
  derived and/or modified sequence opt5 from hemagglutinin__InfluenzaA__AHG96875

SEQ ID NO: 194093 - RNA, 1701 nt, Artificial Sequence; identical to SEQ ID NO: 194049
  derived and/or modified sequence opt5 from hemagglutinin__InfluenzaA__AHG96887

SEQ ID NO: 194094 - RNA, 1701 nt, Artificial Sequence; identical to SEQ ID NO: 194049
  derived and/or modified sequence opt5 from hemagglutinin__InfluenzaA__AHG96899

SEQ ID NO: 194095 - RNA, 1701 nt, Artificial Sequence; identical to SEQ ID NO: 194049
  derived and/or modified sequence opt5 from hemagglutinin__InfluenzaA__AHG96911

SEQ ID NO: 194096 - RNA, 1701 nt, Artificial Sequence; identical to SEQ ID NO: 194049
  derived and/or modified sequence opt5 from hemagglutinin__InfluenzaA__AHG96923

SEQ ID NO: 194097 - RNA, 1701 nt, Artificial Sequence; identical to SEQ ID NO: 194049
  derived and/or modified sequence opt5 from hemagglutinin__InfluenzaA__AHG96935

SEQ ID NO: 194098 - RNA, 1701 nt, Artificial Sequence; identical to SEQ ID NO: 194049
  derived and/or modified sequence opt5 from hemagglutinin__InfluenzaA__AHG96947

SEQ ID NO: 194099 - RNA, 1701 nt, Artificial Sequence; identical to SEQ ID NO: 194049
  derived and/or modified sequence opt5 from hemagglutinin__InfluenzaA__AHG96959

SEQ ID NO: 194100 - RNA, 1701 nt, Artificial Sequence; identical to SEQ ID NO: 194049
  derived and/or modified sequence opt5 from hemagglutinin__InfluenzaA__AHG96971

SEQ ID NO: 194101 - RNA, 1701 nt, Artificial Sequence; identical to SEQ ID NO: 194049
  derived and/or modified sequence opt5 from hemagglutinin__InfluenzaA__AHG96983

SEQ ID NO: 194102 - RNA, 1701 nt, Artificial Sequence; identical to SEQ ID NO: 194049
  derived and/or modified sequence opt5 from hemagglutinin__InfluenzaA__AHG96995

SEQ ID NO: 194103 - RNA, 1701 nt, Artificial Sequence; identical to SEQ ID NO: 194049
  derived and/or modified sequence opt5 from hemagglutinin__InfluenzaA__AHG97007

SEQ ID NO: 194104 - RNA, 1701 nt, Artificial Sequence; identical to SEQ ID NO: 194049
  derived and/or modified sequence opt5 from hemagglutinin__InfluenzaA__AHG97019

SEQ ID NO: 194105 - RNA, 1701 nt, Artificial Sequence; identical to SEQ ID NO: 194049
  derived and/or modified sequence opt5 from hemagglutinin__InfluenzaA__AHG97031

SEQ ID NO: 194106 - RNA, 1701 nt, Artificial Sequence; identical to SEQ ID NO: 194049
  derived and/or modified sequence opt5 from hemagglutinin__InfluenzaA__AHG97043

SEQ ID NO: 194107 - RNA, 1701 nt, Artificial Sequence
  derived and/or modified sequence opt5 from hemagglutinin__InfluenzaA__AHH00866
augaagaccaucauugcccugagcuacauccucugccuggcuuucgcccagaaacuucccggcaacgacaauuccacagcgacgcugugucucgggcaccaugcugugccuaacggaacccuggucaagacaauuaccaaugaucaaaucgagguuacaaacgccaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucguggagcggagcaaggcuuauuccaauuguuacccuuaugacguccccgauuacgccucucugcgcagccuuguggcuuccagcgggacgcuggaauuuaacaaugagucuuucaacuggaccggaguugcccaaaauggcacauccagcgcgugcaaaagacggucuauuaaguccuuuuucagccgccucaacuggcugcaccagcuugagaauagauauccugcccugaacgugaccaugcccaauaacgacaaguuugauaaacucuacaucuggggcguccaucacccuucuacagacuccgaucagauuagcguguaugcucaggccuccgggcggguuaccgugucuacgaagcgcagccaacagacagucaucccgaacauuggauccagacccugggugcggggcaucagcucucgcauuuccaucuacuggaccaucgugaauccuggggacauucugcugaucaacagcacaggaaaucucauugcucccagaggcuacuucaaaauccggucuggaaagagcuccauuaugcgcucugacgccccuaucgggaaauguaacagcgaaugcaucacccccaauggcuccauuccgaacgauaagccuuuucagaaugucaacagaaucaccuauggcgcguguccccgguacguuaagcagaauacacugaaacuugccacggggaugcgcaacgugccugagaagcaaaccagaggaauuuucggcgcuaucgccggguuuauugaaaauggaugggagggcaugauggacgggugguauggauuccggcaccagaacagcgagggcacaggccaggcugccgaucugaaaucuacccaagccgcuaucaaucagaucaacgggaagcucaauaaacugauugaaaagacaaacgagaaauuucaucagaucgaaaaggaguucuccgaaguggagggacgcauucaggaccuugagaaguacgucgaagauaccaaaaucgaccuguggagcuauaacgcggagcuccugguggcccuggaaaaucaacacacgauugaucucacagacucugagaugaacaagcuguucgaaagaacccggaaacagcuuagagagaaugcugaggauaugggcaacgggugcuuuaagaucuaccauaaaugugacaaugccugcauuggauccauccgcaacggcaccuaugaucacgacguuuaccgggacgaagcccugaauaacagauuccagaucaaggggguggagcucaagagcggcuacaaagauuggauucuguggaucuccuuugcuauuucuugcuuccuucugugugucgugcuccugggauuuaucaugugggccugccagaagggcaauauucgcuguaacaucugcaucuga

SEQ ID NO: 194108 - RNA, 1701 nt, Artificial Sequence
  derived and/or modified sequence opt5 from hemagglutinin__InfluenzaA__AHH00870
augaagaccaucauugcccugagcuacauccucugccuggcuuucgcccagaaacuucccggcaacgacaauuccacagcgacgcugugucucgggcaccaugcugugccuaacggaacccuggucaagacaauuaccaaugaucaaaucgagguuacaaacgccaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucguggagcggagcaaggcuuauuccaauuguuacccuuaugacguccccgauuacgccucucugcgcagccuuguggcuuccagcgggacgcuggaauuuaacaaugagucuuucaacuggaccggaguugcccaaaauggcacauccagcgcgugcaaaagacggucuauuaaguccuuuuucagccgccucaacuggcugcaccagcuugagaauagauauccugcccugaacgugaccaugcccaauaacgacaaguuugauaaacucuacaucuggggcguccaucacccuucuacagacuccgaucagauuagcguguaugcucaggccuccgggcggguuaccgugucuacgaagcgcagccaacagacagucaucccgaacauuggauccagacccugggugcggggcaucagcucucgcauuuccaucuacuggaccaucgugaaaccuggggacauucugcugaucaauagcacaggaaaccucauugcucccagaggcuacuucaagauccggucugggaaaagcuccauuaugcgcucugacgccccuaucggaaaguguaauagcgaaugcaucacccccaacggcuccauuccgaaugauaagccuuuucagaacgucaauagaaucaccuauggcgcguguccccgguacguuaaacagaacacacugaaacuugccacggggaugcgcaaugugccugagaaacaaaccagaggaauuuucggcgcuaucgccggguuuauugaaaacggaugggagggcaugauggacgggugguauggauuccggcaccagaauagcgagggcacaggccaggcugccgaucugaagucuacccaagccgcuaucaaccagaucaaugggaaacucaacaagcugauugaaaagacaaaugagaaguuucaucagaucgaaaaggaguucuccgaaguggagggacgcauucaggaccuugagaaauacgucgaagauaccaagaucgaccuguggagcuauaacgcggagcuccugguggcccuggaaaaccaacacacgauugaucucacagacucugagaugaauaaacuguucgaaagaacccggaagcagcuuagagagaacgcugaggauaugggcaaugggugcuuuaaaaucuaccauaagugugacaacgccugcauuggauccauccgcaauggcaccuaugaucacgacguuuaccgggacgaagcccugaacaauagauuccagaucaaggggguggagcucaaaagcggcuacaaggauuggauucuguggaucuccuuugcuauuucuugcuuccuucugugugucgugcuccugggauuuaucaugugggccugccagaaaggcaacauucgcuguaauaucugcaucuga

SEQ ID NO: 194109 - RNA, 1701 nt, Artificial Sequence
  derived and/or modified sequence opt5 from hemagglutinin__InfluenzaA__AHJ57430
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguagacugcggggaguugcuccccuccaucugggcaagugcaacaucgccggguggauucugggaaauccugagugugaaucucucagcacagccuccucuuggagcuacaucguggagaccuccucuagcgacaacggcacgugcuauccgggggauuuuauuaauuacgaggaacugcgcgagcagcuuuccagcgucucuuccuucgaaagauuugagaucagccccaaaaccucuuccuggccuaaccacgacagcaauaagggagugcgggccgcuuguccccaugccggcgcgaagucuuucuauaaaaaccugaucuggcucguuaagaaaggcaauuccuacccuaagcugagcaaauccuauauuaacgauaaggggaaggaagugcuuguccuguggggaauccaccaccccucuacaagcgccgaccaacagucccucuaccagaaugcugaugccuacguguuugugggcaccagccgcuauucuaaaaaguucaaaccugagauugcuaucagaccgaagguccgggggcaggagggacgcaugaacuacuauuggacacugguugaacccggcgacaaaauuaccuuugaggccacggggaaccugguggugccuagauacgcguucgccauggaacggaaugcugccuccggaaucauuaucagcgauacacccguccaugacugcaacaccacaugucaaaccccuaagggcgcugugaauaccucucuccccuuucagaacauccacccgauuacaaucggcaaaugcccuaaguauguuaagagcacgaaacugcgccuugccaccgggcugagaaauauucccuccauccagucucggggacucuucggcgccauugcuggguuuaucgagggaggcuggacagggaugguggauggaugguacggcuaucaucaccagaacgaacaaggcagcggguacgcggccgaccugaaguccacccagaaugcuaucgacgagauuacaaacaaagucaauagcgugaucgagaagaugaacacccaguucacggccguuggaaaagaauuuaaucaccuugagaagcgcauugaaaaccugaauaagaaaguggaugacggcuuccucgauaucuggacauacaacgccgagcugcugguccuccuggaaaaugagagaacccuugacuaucaugauucuaacgugaagaaccuguacgagaaaguccggucccagcucaagaauaacgcuaaagaaauugggaauggauguuucgaguuuuaucacaagugcaacaauaccuguauggaaagcgugaagaacggcacauacgacuauccuaaauacucugaggaagccaagcugaaucgcgagaaaaucgaugggguuaaacuugaguccaccagaaucuaucaaauucuggcgaucuacagcacaguggcuuccucucucguccuggugguuagccugggcgccauuuccuucuggaugugcucuaacggaagccuccagugccggaucuguauuuga

SEQ ID NO: 194110 - RNA, 1701 nt, Artificial Sequence
  derived and/or modified sequence opt5 from hemagglutinin__InfluenzaA__AHJ57431
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugagagccgcuuguccccaugccggcgcgaaaucuuuuuauaagaaucugaucuggcucguuaaaaagggcaacagcuacccuaaacugucccaaagcuauauuaaugacaaggggaaggaagugcuuguccuguggggaauccaccaccccuccacaucugccgaucagcagagccucuaccagaacgcugacgccuacguguucgugggcaccucccgguauagcaaaaaguuuaaaccugagauugcuauccgcccgaaggucagagaucaagaggggcggaugaauuacuauuggacacugguugaacccggagacaaaauuaccuucgaggccacgggcaaccugguggugccucgcuacgcguuugccauggaaagaaacgcugggucuggaaucauuaucuccgauacacccguccaugacugcaauaccacaugucagaccccuaagggcgccaucaacaccagccuccccuuccagaauauucacccgaucacaauuggcaaaugcccuaaguaugugaagucuacgaaacugcggcuugcuaccgggcugcgcaacauccccagcauucaguccagaggacucuuuggcgccaucgccggguucaucgagggaggcuggacagggaugguugacggaugguacggcuaucaucaccaaaaugaacagggcucuggguacgcugcggaucuuaagagcacccagaacgccauugacaaaaucacaaauaaggugaacuccgucauugagaaaaugaauacccaguuuacggcugugggaaaggaguucaaccaccuggaaaagcggaucgagaaucugaacaaaaagguugaugacggcuuccucgauauuuggacauacaaugccgaacugcuggugcuccuggagaacgaacgcacccuugacuaucaugauagcaaugucaaaaaccuguacgagaaggugagaaaccaacucaaaaauaacgccaaggagaucgggaauggauguuuugaguucuaucacaagugcgacaacaccuguauggagucugucaaaaauggcacauacgauuauccuaaguacuccgaagaggcuaaacugaaccgggaaaagaucgacggggugaaacuugagagcacccgcauuuaucagauccuggccauuuacucuacaguugcguccagccucgugcuggucgugucccugggcgcuaucucuuuuuggaugugcagcaauggaucccuccagugcagaauuuguaucuga

SEQ ID NO: 194111 - RNA, 1701 nt, Artificial Sequence
  derived and/or modified sequence opt5 from hemagglutinin__InfluenzaA__AHJ57432
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccacagccgaucaacagucucucuaccagaacgcugacgccuacguguucgugggcaccagcagauauuccaagaaauuuaagccucagauugcuauccggccgaaaguccgcgaucaagaggggagaaugaauuacuauuggacgcugguugagcccggagacaagauuacauucgaagccaccggcaaccugguggugccucgguacgcguuugcccucgagcgcaacgcugggagcggaaucauuaucucugauacacccguccaugacugcaauaccaccugucagacaccuaaaggcgccaucaacacgucccugcccuuccagaauauucacccgaucaccauuggcaagugcccuaaguaugugaaaagcacaaaacuuagacuggcuaccgggcuccggaacguucccucuauccagagccgcggacuguuuggcgccauugccggguucaucgaaggaggcuggacagggaugguggagggaugguacggcuaucaucaccaaaaugaacagggcuccggguacgcugcggaccuuaaaucuacccagaacgccaucgauaagauuacgaauaaagucaacagcgugaucgagaagaugaauacacaguuuaccgcuguuggaaaggaguucaaccaccuggaaaagagaauugagaaucucaacaagaaaguggacgauggcuuccuggacaucuggaccuacaaugccgaacugcucguccugcuugagaacgaacggacacuggauuaucaugacuccaaugugaagaaccucuacgagaaaguccgcaaccaacugaagaauaacgccaaggagauugggaauggauguuuugaguucuaucacaaaugcgauaacaccuguauggagagcgugaagaauggcacauacgacuauccuaaauacucugaagaggcuaaacuuaacagagaaaagaucgaugggguuaagcuggaguccacgcggaucuaucagauucucgccaucuacagcaccguggcgucuucccugguccuggugguuagccucggcgcuauuuccuuuuggaugugcucuaauggaagccugcagugccgcaucuguauuuga

SEQ ID NO: 194112 - RNA, 1701 nt, Artificial Sequence
  derived and/or modified sequence opt5 from hemagglutinin__InfluenzaA__AHJ57433
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaagaaggcaauagcuacccuaagcuguccaaaagcuauauuaacgauaaggggaaggaggugcuuguccuguggggaauccaccaccccuccaccacagccgaccaacagucucucuaccagaaugcugaugccuacguguucgugggcaccagcagauauuccaaaaaguuuaaaccugagauugcuauccggccgaagguccgcgaccaggaagggagaaugaacuacuauuggacgcugauugagcccggagauaaaaucacauucgaagccaccggcaaccugguugugccucgguacgcguuugccauggagcgcaaugcugggagcggaauuaucaucucugacacacccgugcaugauugcaacaccaccugucaaacaccugaaggcgccauuaauacgucccuccccuuccagaacauccacccgauuaccaucggcaagugcccuaaauaugucaagagcacaaagcugagacuugcuaccgggcugcggaaugugcccucuauucagagccgcggacucuuuggcgccaucgccggguucaucgagggaggcuggacagggaugguugacggaugguacggcuaucaucaccagaacgagcaaggcuccggguacgcugcggaccugaaaucuacccagaaugccauugauaagaucacgaacaaagugaauagcgucauugaaaagaugaacacacaguuuaccgcugugggaaaagaguucaaucaccuugaaaagagaaucgagaaccugaauaagaaaguugacgauggcuuccucgacauuuggaccuacaacgccgaacugcuggugcuccuggagaaugagcggacacuugauuaucaugacuccaacgucaagaaccuguacgaaaaagugcgcaaucagcucaagaacaaugccaaagagaucgggaacggauguuuugaguucuaucacaagugcgauaauaccuguauggagagcgucaagaacggcacauacgacuauccuaaauacucugaagaggcuaagcugaauagagagaaaaucgauggggugaaacuugaauccacgcggauuuaucaaauccuggccauuuacagcaccguugcgucuucccucgugcuggucgugagccugggcgcuaucuccuuuuggaugugcucuaacggaagccuccagugccgcauuuguaucuga

SEQ ID NO: 194113 - RNA, 1701 nt, Artificial Sequence
  derived and/or modified sequence opt5 from hemagglutinin__InfluenzaA__AHJ57434
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacccccucgaagauaagcacaaugggaaacuguguaaacuuagaggaguugccccucugcaucucggcaagugcaacaucgccggguggauucugggaaauccggagugugaaucucugagcacagcuuccucuuggagcuacaucguggagaccuccucuagcgacaacggcacgugcuaucccggggauuuuauugacuacgaagaacuccgggagcagcuguccagcgucucuuccuucgaacgcuuugagaucuucccuaagaccagcucuuggcccaaucacgauuccaacaagggagugacagccgcuuguccucaugccggcgcgaaaucuuuuuauaagaaucuuaucuggcugguuaaagaaggcaacagcuaccccaagcucuccaaaagcuauauuaaugacaaggggaaggaggugcugguccuuuggggaauccaccacccuuccaccacagccgaucaacagucucuguaccagaacgcugacgccuacguguucgugggcaccagcagauauuccaaaaaguuuaaaccggagauugcuauccggcccaagguccgcgaucaggaagggagaaugaauuacuauuggacgcucguugagccuggagacaaaauuacauucgaagccaccggcaaccugguggugccccgguacgcguuugccauggagcgcaacgcugggagcggaaucauuaucucugauacaccuguccaugacugcaauaccaccugucaaacacccgaaggcgccaucaacacgucccugccguuccagaauauucacccuaucaccauuggcaagugccccaaauauguuaagagcacaaagcucagacuggcuaccgggcuucggaacgugccuucuauccagagccgcggacuguuuggcgccauugccggguucaucgagggaggcuggacagggaugguggacggaugguacggcuaucaucaccagaaugagcaaggcuccggguacgcugcggaucucaaaucuacccagaacgccaucgacaagauuacgaauaaagucaacagcgugaucgaaaagaugaauacacaguuuaccgcuguuggaaaagaguucaaccaccuggaaaagagaauugagaaucuuaacaagaaaguggaugacggcuuccuggauaucuggaccuacaaugccgaacuccugguccugcucgagaacgagcggacacuggacuaucaugauuccaaugugaagaaccuuuacgaaaaaguccgcaaccagcugaagaauaacgccaaagagauugggaauggauguuuugaguucuaucacaagugcgacaacaccuguauggagagcgugaagaauggcacauacgauuaucccaaauacucugaagaggcuaagcucaacagagagaaaaucgacgggguuaagcuggaauccacgcggaucuaucaaauucuugccaucuacagcaccguggcgucuucccugguccucgugguuagccugggcgcuauuuccuuuuggaugugcucuaauggaagccugcagugccgcaucuguauuuga

SEQ ID NO: 194114 - RNA, 1701 nt, Artificial Sequence
  derived and/or modified sequence opt5 from hemagglutinin__InfluenzaA__AHJ57435
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauagaggagugacagccgcuuguccccaugccggcgccaagagcuuuuauaaaaaccugaucuggcucguuaagaaaggcaauucuuacccuaagcugucccaaagcuauauuaacgauaaagggaaggaagugcuuguccuguggggaauccaccaccccuccaccacagccgaccagcagucucucuaccagaaugcugaugccuacguguucgugggcaccagccgguauuccaagaaauuuaagccugagauugcuauccgcccgaaagucagagaccaagaggggcggaugaacuacuauuggacgcugguugaacccggagauaagauuacauucgaggccaccggcaaccugguggugccucgcuacgcguuugccauggaaagaaaugcugggagcggaaucauuaucucugacacacccguccaugauugcaacaccaccugucagacaccugagggcgccaucaauacgucccuccccuuccagaacauucacccgaucaccauuggcaaaugcccuaaguaugugaaaagcacaaagcugcggcuugcuaccgggcugcgcaauguucccucuauccagagcagaggacucuuuggcgccauugccggguucaucgaaggaggcuggacagggaugguggacggaugguacggcuaucaucaccaaaacgagcagggcuccggguacgcugcggaccugaagucuacccagaaugccaucgauaaaauuacgaacaaggucaauagcgugaucgagaaaaugaacacacaguuuaccgcuguuggaaaggaguucaaucaccuugagaaacggauugaaaaccugaauaagaagguggacgauggcuuccucgacaucuggaccuacaacgccgagcugcugguccuccuggaaaaugagcgcacacuugauuaucaugacuccaacgugaaaaaccuguacgagaaggucagaaaucaacucaaaaacaaugccaaggaaauugggaacggauguuuugaguucuaucacaaaugcgauaauaccuguauggaaagcgugaagaacggcacauacgacuauccuaaguacucugaggaagcuaaacugaaucgggagaagaucgaugggguuaaacuugaguccacgcgcaucuaucagauucuggccaucuacagcaccguggcgucuucccucguccuggugguuagccugggcgcuauuuccuuuuggaugugcucuaacggaagccuccagugcagaaucuguauuuga

SEQ ID NO: 194115 - RNA, 1701 nt, Artificial Sequence
  derived and/or modified sequence opt5 from hemagglutinin__InfluenzaA__AHJ57436
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacuccagcuuuuucucucggcugaauuggcucacacaucugaacuuuaaguauccugcccuuaaugucaccauucccaacaacgagcaguucgacaagcuguacaucuggggcgugcaccauccugggacggauaaagaccagauuuuucucuaugcgcaagccuccggacgcaucacaguuagcaccaagagaucccagcagacagugauuccgaauaucggcucucggccccgcgucagaaacaucccuagccggauuuccaucuacuggaccauugugaaacccggggauauccugcugauuaauagcaccggaaaccucaucgcuccucgcggcuacuucaagaucagaucugggaaauccagcauuaugcggucugacgcccccaucggaaaguguaauagcgaaugcauuacaccgaacggcuccaucccuaaugacaagcccuuucagaacgugaaucgcauuacguauggcgcuuguccuagauacgucaaacaaaacacccugaagcuggccacagggaugcggaauguucccgagaaacagacccgcggaaucuucggcgcgaucgccggguuuauugaaaacggaugggagggcaugguggaugggugguauggauucagacaccaaaauucugagggccggggccaggcugccgaccuuaagagcacacaggcugccaucgaucagauuaacgggaaacucaauagacugaucggaaagaccaacgaaaaauuccaccagauugagaaggaauuuuccgagguggaaggccgcauccaagaccuugagaaguacgucgaggauacgaaaauugaccuguggagcuauaacgccgaacuccugguggcucuggagaaucagcauacaaucgaucucaccgacucugaacugaacaagcuguucgagaaaaccaagaaacagcugcgggaaaaugcggaggauauggggaacggaugcuuuaagaucuaccacaagugugacaaugccugcauuggcuccaucagaaacgggacauaugaucaugacguuuaccgcgacgaggcucucaauaaccgguuccagauuaaaggcguggaacuuaagagcggauacaaagauuggauccuuuggauuucuuuugccaucuccugcuuccugcucugugucgcccugcugggcuuuaucaugugggcuugccaaaaggggaauauuagauguaacaucugcauuuga

SEQ ID NO: 194116 - RNA, 1701 nt, Artificial Sequence
  derived and/or modified sequence opt5 from hemagglutinin__InfluenzaA__AHJ57437
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagauccuugauggggaaaacuguacccugauugacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacgcuugaauuuaauaacgagagcuucaauuggaccggagugacacagaacggcaccucuuccgcuugcauccgcagaagcaauucuuccuuuuucagccggcugaacuggcucacacaucugaauuuuaaguauccugcccuuaacgucaccaugcccaacaaugagcaguucgacaagcuguacauuuggggcgugcaccauccugggacggauaaagaccagaucuuucucuaugcgcaaucuuccggacgcauuacaguuagcaccaagagaucccagcagacagugaucccgaacauuggcucucggccccgcgucagaaauaucccuagccggaucuccauuuacuggaccaucgugaaacccggggauauucugcugaucaacagcaccggaaaucucauugccccucgcggcuacuucaagaucagaucugggaaauccagcaucaugcggucugacgcucccauuggaaaguguaacagcgaaugcaucacaccgaauggcuccauuccuaacgacaagcccuuucagaaugugaaccgcaucacguauggcgccuguccuagauacgucaaacaaucuacccugaaacuugcuacagggaugcggaauguucccgagaagcagacccgcggaauuuucggcgccaucgcgggguuuaucgaaaacggaugggagggcaugguggaugggugguauggauucagacaccagaauagcgagggccggggccaagccgcugaccugaaguccacacaggccgcuauugaucagaucaacgggaaacucaauagacugauuggaaagaccaacgaaaaauuccaccagaucgagaaggaauuuagcgagguggaaggccgcauucaagaccuugagaaguacgucgaggauacgaaaaucgaccuguggucuuauaacgccgaacuccugguggcccuggagaaucagcauacaauugaucucaccgacuccgaaaugaacaagcuguucgagaaaaccaagaaacagcuuaaggaaaaugcugaggauauggggaacggaugcuuuaagaucuaccacaaaugugacaaugcgugcaucggcagcauucggaacgggacauaugaucaugacguuuacagagacgaggcccugaauaaccgcuuccagaucaagggcguggaacucaaaucuggauacaaggauuggauucuguggaucuccuuugcuauuagcugcuuccuucugugugucgcccuccugggcuuuaucaugugggccugccaaaaagggaauauccgguguaacauuugcaucuga

SEQ ID NO: 194117 - RNA, 1701 nt, Artificial Sequence
  derived and/or modified sequence opt5 from hemagglutinin__InfluenzaA__AHJ57438
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagauccuugauggggaaaacuguacccugauugacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacgcuugaauuuaauaacgagagcuucaauuggaccggagugacacagaacggcaccucuuccgcuugcauccgcagaagcaauucuuccuuuuucagccggcugaaguggcucacacaucugaacuuuaaguauccugcccuuaaugucaccaugcccaacaacgagcaguucgacaaacuguacauuuggggcgugcaccauccugggacggauaaggaccagaucuuucucuaugcgcaagccucuggacgcauuacaguuuccaccaaaagaagccagcaggcugugaucccgaauauuggcucccggccccgcaucagaaacaucccuucucggauuagcaucuacuggacaauugucaagcccggggauauccugcugauuaauuccaccggaaaccucaucgccccucgcggcuacuucaaaaucagaagcgggaagucuuccauuaugcggagcgacgcucccaucggaaaguguaauucugaaugcauuaccccgaacggcagcaucccuaaugacaaacccuuucagaacgugaaucgcauuacauauggcgauuguccuagauacgugaagcaauccacgcugaaacuugccaccgggaugcggaacguccccgagaagcagacacgcggaaucuucggcgcgaucgccggguuuauugaaaauggaugggagggcaugguugacgggugguauggauucagacaccagaacucugagggccggggccaagcugccgaucugaaaagcacccaggcugccaucgaccagauuaaugggaagcucaacagacugaucggaaaaacaaaugaaaaguuccaccagauugagaaggaauuuuccgagguggaaggccgcauccaagaucuugagaaauacguggaggacaccaagauugaucuguggagcuauaacgccgaacuccuggucgcucuggagaaccagcauacgaucgaccucacagauucugaaaugaauaaacuguucgagaagaccaaaaagcagcuucgggaaaacgcggaggacauggggaauggaugcuuuaagaucuaccacaaaugugauaacgccugcaccggcuccauuagaaaugggacauaugaccaugacguguaccgcgaugaggcucugaacaaucgguuccagaucaagggcguugaagugaaaagcggauacaaggacuggauucucuggaucucuuuugccauuuccugcuuccugcuuugugucgcccugcucggcuuuaucaugugggcuugccaaaaagggaacaucagauguaauauuugcaucuga

SEQ ID NO: 194118 - RNA, 1701 nt, Artificial Sequence
  derived and/or modified sequence opt5 from hemagglutinin__InfluenzaA__AHJ57651
augaucgccuucauugugaucgcuauucuggccgcgaccggcaagagcgacaaaaucugcauuggguaccacgcuaacaauuccacaacgaaggucgauaccauccucgagaaaaacguuacagugacccauucuguggaacugcuugagaaucagaaggaagagagauuuuguaaaaucagcaacaaggcuccccuggaccuccgggauugcacacuggaaggauggauucuuggcaauccucgcugugggauccugcucgccgaccaauccuggucuuauauugucgagagaccgaacgcccggaauggaaucugcuaccccggcacccugaacgagguggaggaacugaaggcccucauugggagcggagaacgcguugagagauucgagauguuuccuaaauccacaugggcuggcguggauaccgacucuggcgucagcuccgccuguccccuggggaauggaccuagcuucuaucggaaccuucuguggaucauuaagcucaaaucuuccgaauaccccgugauccgcggcacguuuaauaacaccggggauaagagcauccuguauuucuggggaguucaccauccuccggugacaaccgagcaggaagcgcuuuacggcucuggggacagauauguccggaugggaacagaguccaugaauuuugcccgcagccccgaaauugcugccagaccugcugugaacggccagcggggccgcaucgauuacuucuggucuauucugaaacccggggagacccucaauguggaguccaacggaaaccugaucgccccuugguacgcguauagauuugucaauaaggacagcaagggcgccauuuuccgguccacgcugcccaucgaaaacugcgaugcuacaugucagaccacagaggggguuauccgcaccaauaaaaccuuucaaaacgugucuccgcucuggauuggagaaugcccuaaguacgugaaaagcaagucccugagacuugccacaggccugcggaaugucccccagaucgagacgagagggcuuuucggagcuauugccggcuuuaucgaaggcggguggaccggaaugauugacggcugguauggguaccaccaugagaacagccagggaucuggcuaugccgcugaucgcgaguccacacagaaagcgaucgacgggaucaccaauaaggugaacagcauuaucgacaaaaugaauacacaauucgaagccguuggccacgaguucucuaaccuggaacggagaauugauaaucuuaacaagcgcauggaggacggauuucuggauguguggaccuacaaugcugaacuccugguccugcucgagaacgagcggacgcuggacaugcacgaugccaaugugaagauccuuuaugaaaaaguuagaagccagcugcgcgacaacgccaaggaucucggcaacggguguuucgaguuuuggcauaaaugcgacaaugaauguauugaguccgugaagaacggaacauacaauuacccuaaauaucagucugagagccggcugaacagacagaccaucgaauccgucaagcucgagaaucugggcguguaccaaauucucgcuaucuauagcaccgucucuuccagccuggugcugguugggcucauccuggccaugggacuuuggaugugcucuaacggcuccaugcagugccgcauuuguaucuga

SEQ ID NO: 194119 - RNA, 1701 nt, Artificial Sequence
  derived and/or modified sequence opt5 from hemagglutinin__InfluenzaA__AHJ57663
augaucgccuucauugugaucgcuacccuggucgccacaggcaagagcgacaaaauuugcaucggguaccacgcgaacaauuccacgaccaagguugauacaauucucgagaaaaacgugaccgugacacauucugucgaacugcuugagaaucagaaggaagagagauuuuguaaaaucagcaacaaggcuccccuggaccuccgggauugcacccuggaaggauggauccuuggcaauccucgcugugggauucugcucgccgaccaauccuggucuuauaucguggagagaccgaacgcccggaauggaauuugcuaccccggcacacugaacgaggcugaagaacugaaggcccucaucgggagcggagaacgcguugagagauucgagauguuuccuaaauccaccuggacgggcguggauaccgaaucuggcgucagcuccgcuuguccccuggggaauggaccuagcuucuaucggaaccuucuguggauuaucaagcucaaaucuuccgaguaccccgugauucgcggcacauuuaauaacaccggggacaagagcauccuguauuucuggggaguucaccauccuccggugacaaccgaacagaaugcccuuuacggcucuggggauagauauguccggaugggaacggaguccaugaacuuugcgcgcagccccgaaaucgccgcuagaccugccgugaauggccagcggggccgcauugacuacuucuggucuauccugaaacccggggagacacucaacguggaguccaacggaaaucugauugcuccuugguacgccuauagauuugucaacaaggauagcaagggcgcgaucuuccgguccaaucugcccauugaaaacugcgacgccaccugucagacaaccgaggggguuauccgcaccaauaaaacauuucaaaacgugucuccgcucuggaucggagaaugcccuaaguacgugaaaagcaagucccugagacuugcuacgggccugcggaaugucccccagauugagaccagaggacucuucggggccaucgcuggcuuuauugaaggcggguggacaggaaugaucgauggcugguauggguaccaccaugagaacagccagggaucuggcuaugccgccgacaaagaguccacccagaaggcuauugaugggaucacaaauaaagugaacagcaucauugacaagaugaauacccaauucgaagcgguuggccacgaguucucuaaccuggaacgccggaucgacaaucuuaacaagagaauggaggauggauuucuggacguguggacguacaaugccgaacuccugguccugcucgagaacgagcgcacacuggaucuucacgacgcuaacgugaaaaaucugcaugaacggguuaagagccagcucagagauaacgccaaugaccugggcaacggguguuucgaguuuuggcacaaaugcgauaaugaauguauggaguccgugaagaacggaaccuauaauuacccuaaauaccaggccgagucucgccuuaacaagcagaagauugaaagcgucaaacuggaggaguucggcguguaucaaauccucgcuauuuacuccaccgucucuagcucccuggugcugguugggcucaucauggccaugggacuguggaugugccccaauggcagcaugcagugccggauuuguaucuga

SEQ ID NO: 194120 - RNA, 1701 nt, Artificial Sequence
  derived and/or modified sequence opt5 from hemagglutinin__InfluenzaA__AHJ57674
augaucgccuucauugugaucgcuauucuggucaccacaggcaagagcgacaaaaucugcauuggguaccacgccaacaauuccacgaccaagguugauacaauccucgagaaaaacgugaccgugacacauucugucgaacugcuugagaaucagaaggaagagagauuuuguaaaaucagcaacaaggcgccccuggaccuccgggauugcacccuggaaggauggauucuuggcaauccucgcugugggauccugcucgcugaccaauccuggucuuauauuguggagagaccgaacgcccggaauggaaucugcuaccccggcacacugaacgagguugaagaacugaaggcccucauugggagcggagaacgcguggagagauucgagauguuuccuaaauccaccugggcuggcgucgauaccaauucuggcgugagcuccgccuguccccugggggaaggaccuagcuucuaucggaaccuucuguggaucauuaagcacacgacaucuggcuaccccguuaucaaagggaccuaucgcaauacaggagacaaguccgugcucuacuuuuggggcguccaucacccuccggauaccacggagcagaacgugcuguaugggagcggaaauagauacgugcggaugggcacagaaucuaugaacuucgcucgcucccccgagaucgccgcgagaccugccgucaauggccagcgggggcgcauugacuacuuuuggagcauccuuaaacccggagaaacccugaacguugagucuaacggcaaucucauugcuccuugguaugccuacagauucgugaacaaggauuccaagggggcuaucuuucggagcaaucugcccauugagaacugcgacgccacaugucagaccaccgaaggagugauccgcacaaauaaaacguuccaaaacgucuccccgcuguggaucggcgagugcccuaaguaugugaaaucuaagagccucagacuggcgaccgggcuucggaauguuccccagauugaaacaagaggacuguuuggcgccaucgcuggcuucauugaagggggauggaccggcaugaucgaugggugguacggauaucaucacgaaaacucccagggcagcggguacgccgcugaccgcgagucuacacagaaagccauugauggcaucaccaauaaggugaacuccaucauugacaaaaugaauacgcaauuugaggccgucggacacgaguucagcaaccucgagcggagaaucgacaaucugaacaagcgcauggaagauggcuuccuugacguguggacauauaaugcugagcugcucguucugcuggaaaacgagcggacccucgaucugcaugacgcgaacgugaagaaucuucacgagagaguccgcucucagcugcgggauaacgccaaugaccucgggaacggauguuuugaguucuggcauaaaugcgauaaugaguguauggaaagcgugaagaacggcaccuacaauuacccuaaauaucaggcugaguccagacugaaccgccagaagauugagucugucaaacuugaagaguuugggguguaccaaauccuggccauuuauagcacaguuuccagcucucucgugcuggucggacugaucauggccaugggccucuggaugugcuccaaugggagcaugcagugccggauuuguaucuga

SEQ ID NO: 194121 - RNA, 1701 nt, Artificial Sequence
  derived and/or modified sequence opt5 from hemagglutinin__InfluenzaA__AHJ57686
augaucgccuucauugugaucgcuauucuggccgcgaccggcaagagcgacaaaaucugcauuggguaccacgcuaacaauuccacaacgaaggucgauaccauccucgagaaaaacguuacagugacccauucuguggaacugcuugagaaucagaaggaaggaagauuuuguaaaaucagcaacaaggcuccccuggaccuccgggauugcacacuggagggcuggauucuugggaauccucgcuguggaauccugcucgccgaccaauccuggucuuauauugucgaaagaccgaacgcccggaauggcaucugcuaccccgggauucugaacgaggccgaggaacugaaggcucucaucggaagcggcgagcgcguggaaagauucgagauguuuccuaaauccaccugggccggcguugauacaaauucuggggugagcuccgcguguccccugggaaacggcccuagcuucuaucggaaucuucuguggauuaucaagcucaaaucuuccgccuaccccgucauccgcgggaccuuuaacaauacgggagacaagagcauucuguauuucuggggcgugcaccauccuccgguugcuaccgagcaggaagcccuuuacgggucuggaaacagauaugugcggaugggcacagaguccaugaauuuugcucgcaaccccgaaaucgccgcgagaccugccgucaacggccagcgggggcgcauugauuacuucuggagcauccugaaacccggagagacccucaauguggaaucuaacggcaaucugauugcuccuugguacgccuauagauuugugaacaaggacuccaagggggcuaucuuccggagcaaucugcccaucgagaacugcgaggccacaugucagaccacggaaggagucauucgcacaaauaaaaccuuucaaaacguuuccccgcucuggaucggcgagugcccuaaguacgugaaaucuaagagccugagacuugccacagggcugcggaaugugccccagauugaaaccagaggacucuucggcgcuaucgcgggcuuuauugaagggggauggaccggcaugaucgaugggugguauggauaccaccaugaaaacucccagggcagcggguaugccgcugaccgcgagucuacacagaaagccaucgauggcauuacgaauaaggucaacuccaucauugacaaaaugaauacccaauucgaggccgugggacacgaguucagcaaccuggagcggagaaucgauaaucuuaacaagcgcauggaagacggcuuucuggacguuuggacauacaacgcugagcuccuggugcugcucgaaaaugagcggacccuggaucuucacgacgccaacgucaagaaucugcaugagaaagugagaucucagcuccgcgauaacgcgaaugaccuggggaacggauguuucgaauuuuggcacaagugcgauaaugaguguauggaaagcguuaaaaacggcacauaugacuacccuaaguaccaggcugagucccggcuuaauagacagaaaauugagucugugaagcuggaaaacuucgaugucuaucaaauccucgccauuuacagcaccguguccagcucucugguccugguggggcucaucauggccaugggacuguggaugugcuccaauggcagcaugcagugccgcaucuguauuuga

SEQ ID NO: 194122 - RNA, 1701 nt, Artificial Sequence
  derived and/or modified sequence opt5 from hemagglutinin__InfluenzaA__AHJ57697
augaucgccuucauugugaucgcuauucuggccgcgaccggcaagagcgacaaaaucugcauuggguaccacgcuaacaauuccacaacgaaggucgauaccauccucgagaaaaacguuacagugacccauucuguggaacugcuugagaaucagaaggaagagagauuuuguaaaaucagcaacaaggcuccccuggaccuccgggauugcacacuggaaggauggauucuuggcaauccucgcugugggauccugcucgccgaccaauccuggucuuauauugucgagagaccgaacgcccggaauggaaucugcuaccccggcacccugaacgagguggaggaacugaaggcccucauugggagcggagaacgcguugagagauucgagauguuuccuaaauccacaugggcuggcguggauaccaauucuggcgucagcuccgccuguccccuggggaacggaccuagcuucuaucggaaucuucuguggaucauuaagcucaaaucuuccgaauaccccgugauccgcggcacguuuaacaauaccggggacaagagcauccuguauuucuggggaguucaccauccuccggugacaaccgagcaggaagcgcuuuacggcucuggggauagauauguccggaugggaacagaguccaugaacuuugcccgcagccccgaaauugcugccagaccugcugugaauggccagcggggccgcaucgacuacuucuggucuauucugaaacccggggagacccucaacguggaguccaacggaaaucugaucgccccuugguacgcguauagauuugucaacaaggauagcaagggcgccauuuuccgguccaaucugcccaucgaaaacugcgacgcuacgugucagacaaccgaggggguuauccgcacaaauaaaaccuuucaaaacgugucuccgcucuggauuggagaaugcccuaaguacgugaaaagcaagucccugagacuugccaccggccugcggaaugucccccagaucgagacaagaggacucuucggggcuauugccggcuuuaucgaaggcggguggacgggaaugauugauggcugguauggguaccaccaugagaacagccagggaucuggcuaugccgcugaccgcgaguccacccagaaagcgaucgaugggaucacaaauaaggugaacagcauuaucgacaaaaugaauacccaauucgaagccguuggccacgaguucucuaaccuggaacggagaauugacaaucuuaacaagcgcauggaggauggauuucuggacguguggacauacaaugcugaacuccugguccugcucgagaacgagcggacccuggaucuucacgacgccaacgugaagaaucugcaugaaaaaguuaagagccagcucagagauaacgccaaugaccugggcaacggguguuucgaguuuuggcacaaaugcgauaaugaauguauggaguccgugaagaacggaacguaugacuacccuaaauaccaggcugagucucgccuuaaucggcagaagaucgaaagcgucaagcuggagaacuucgauguguaucaaauucucgccaucuacuccacagucucuagcucccuggugcugguuggccucauuauggcgauggggcuguggaugugcagcaauggaucuaugcagugcagaaucuguaucuga

SEQ ID NO: 194123 - RNA, 1701 nt, Artificial Sequence
  derived and/or modified sequence opt5 from hemagglutinin__InfluenzaA__AHJ57707
augaucgccuucauugugaucgcuauucuggucaccacaggcaagagcgacaagaucugcguuggguaccacgccaacaauuccacgaccaagguggauacaauucucgagaaaaacgugaccgucacacauucuguggaacugcuugagaaucagaaggaagagagauuuuguaaaaucagcaacaaggcgccccuggaccuccgggauugcacccuggaaggauggauccuuggcaauccucgcugugggauucugcucgcugaccaauccuggucuuauaucguugagagaccgaacgcccggaauggaauuugcuaccccggcacacugaacgagguggaagaacugaaggcccucaucgggagcggagaacgcgucgagagauucgagauguuuccuaaauccaccuggacgggcguggauaccaauucuggcguuagcuccgcuuguccccugggggaaggaccuagcuucuaucggaaccuucuguggauuaucaagcacacaaccucuggcuaccccgugauuaaagggacauaucgcaauaccggagacaaguccguccucuacuuuuggggcgugcaucacccuccggauacgacagagcagaacgugcuguaugggagcggaaauagauacguccggaugggcaccgaaucuaugaacuucgcccgcucccccgagaucgcugccagaccugcgguuaauggccagcgggggcgcaucgacuacuuuuggagcauucuuaaacccggagaaacacugaacguggagucuaacggcaaucucaucgccccuugguaugcuuacagauucgugaacaaggauuccaagggggccauuuuucggagcaaucugcccaucgagaacugcgacgcuaccugucagaccacagaaggagucauucgcacgaauaaaaccuuccaaaacguguccccgcuguggaucggcgagugcccuaaguauguuaaaucuaagagccucagacuggccacagggcuucggaaugugccccagaucgaaaccagaggacuguuuggcgcgauugccggcuucaucgaagggggauggacaggcaugauugaugggugguacggauaucaucacgaaaacucccagggcagcggguacgcugccgaccgcgagucuacccagaaagcuaucgauggcauuacgaauaaggucaacuccaucaucgacaaaaugaauacacaauuugaggccgugggacacgaguucagcaaccucgagcggagaauugacaaucugaacaagcgcauggaagauggcuuccuugacguuuggaccuauaaugccgagcugcucgugcugcuggaaaacgagcggacccucgaucugcaugacgcuaacgucaagaaucuucacgagagagugcgcucucagcugcgggauaacgcgaaugaccucgggaacggauguuuugaguucuggcauaaaugcgauaaugaguguauggaaagcgucaagaacggcacauacaauuacccuaaauaucaggccgaguccagacugaacaagcagaaaaucgagucugugaaacuugaagaguuugggguuuaccaaauucuggcuaucuauagcaccguguccagcucucucguccuggugggacugauuauggccaugggccucuggaugugcuccaaugggagcaugcagugccgcaucuguauuuga

SEQ ID NO: 194124 - RNA, 1701 nt, Artificial Sequence
  derived and/or modified sequence opt5 from hemagglutinin__InfluenzaA__AHJ57719
augaucgccuucauugugaucgcuauucuggccgcgaccggcaagagcgacaaaaucugcauuggguaccacgcuaacaauuccacaacgaaggucgauaccauccucgagaaaaacguuacagugacccauucuguggaacugcuugagaaucagaaggaagagagauuuuguaaaaucagcaacaaggcuccccuggaccuccgggauugcacacuggaaggauggauucuuggcaauccucgcugugggauccugcucuccgaccaaucuuggagcuauauugucgagagaccgaacgcccggaauggaaucugcuaccccggcauucugaacgaggccgaagaacugaaggcccucaucggguccggagaacgcguggagagauucgagauguuuccuaaaucuaccugggcuggcguugauacaaauagcggcguguccagcgccuguccccuggggaacggaccuucuuucuuucggaaucuucuguggauuaucaagcucaaauccagcaccuaucccgucauccgcggcacguucaacaauaccggggacaagucuauucuguacuuuuggggagugcaccauccuuccguuacaaccgaacaggaggcgcuuuauggcagcgggaacagauacgugcggaugggaacagaaucuaugaauuucgcccgcuccccggagaucgcugccagacccgcugucaacggccagcggggccgcauugauuauuuuuggagcauccugaaaccuggggaaacccucaacguggaguccaauggaaaccugauugcccccugguacgcguacagauucgugaauaaggacucuaagggcgccaucuuucggagcaaccugccuaucgagaauugcgaugcuacgugucagacaauugaaggggucauccgcaccaacaaaacauuccaaaauguuagcccccucuggauuggagagugcccgaaguaugugaaauccaagucucugagacuugccaccggccugcggaacgugccucagaucgaaaccagagggcucuuuggagcuauugccggcuucaucgagggcggguggacaggaaugaucgacggcugguacggguaucaccaugaaaauucccagggaagcggcuacgccgaugacaaagagucuacgcagaaggcuauugaugggaucaccaacaaagucaauagcauuaucgacaagaugaacacacaauucgaggcggugggccacgaauuuuccaaucuggagcgccggauugacaaccuuaauaagagaauggaagauggauuccuggacguuuggaccuauaacgccgagcuccuggugcugcucgaaaacgagcgcacacuggaucuucacgacgcuaaugucaaaaaccugcaugagaaggugcggucucagcucagagauaaugccaacgaccugggcaauggguguuuugaguucuggcacaaaugcgauaacgaguguauggaaagcguuaagaauggaaccuacgacuaucccaaauaccaggccgagucccgccuuaaccggcagaagaucgagagcgugaagcuggaaaauuuugaugucuaccaaauucucgcuaucuauucuacgguguccagcucucugguccuggugggccucaucauggccauggggcuguggaugugcuccaacggaagcaugcagugcagaauuuguaucuga

SEQ ID NO: 194125 - RNA, 1701 nt, Artificial Sequence
  derived and/or modified sequence opt5 from hemagglutinin__InfluenzaA__AHJ57731
augaucgccuucauugugaucgcuauucuggccgcgaccggcaagagcgacaaaaucugcauuggguaccacgcuaacaauuccacaacgaaggucgauaccauccucgagaaaaacguuacagugacccauucuguggaacugcuugagaaucagaaggaagagagauuuuguaaaaucagcaacaaggcuccccuggaccuccgggauugcacacuggaaggauggauucuuggcaauccucgcugugggauccugcucgccgaccaauccuggucuuauauugucgagagaccgaacgcccggaauggaaucugcuaccccggcauucugaacgaggccgaggaacugaaggcucucaucgggagcggagaacgcguggagagauucgagauguuuccuaaauccaccugggccggcguugauacagacucuggcgugagcuccgcguguccccuggggaauggaccuagcuucuaucggaaccuucuguggauuaucaagcucaaaucuuccgaauaccccgucauccgcggcaccuuuaauaacacgggggauaagagcauucuguauuucuggggagugcaccauccuccgguuaccacagagcaggaagcccuuuacggcucugggaauagauaugugcggaugggaaccgaguccaugaacuuugcucgcagccccgaaaucgccgcuagaccugccgucaauggccagcggggccgcauugacuacuucuggucuauccugaaacccggggagacacucaacguggaguccaacggaaaucugauugcgccuugguacgccuauagauuugugaacaaggauagcaagggcgcuaucuuccgguccaaucugcccaucgaaaacugcgacgccaccugucagacgacagagggggucauucgcaccaauaaaacauuucaaaacguuucuccgcucuggaucggagaaugcccuaaguacgugaaaagcaagucccugagacuugcuaccggccugcggaaugugccccagauugagaccagaggacucuucggggccaucgccggcuuuauugaaggcggguggacaggaaugaucgauggcugguauggguaccaccaugagaacagccagggaucuggcuaugcugcggaccgcgaguccacgcagaaagccaucgaugggauuaccaauaaggucaacagcaucauugacaaaaugaauacacaauucgaagcugugggccacgaguucucuaaccuggaacggagaaucgacaaucuuaacaagcgcauggaggauggauuucuggacguuuggaccuacaaugccgaacuccuggugcugcucgagaacgagcggacacuggaucuucacgacgccaacgucaagaaucugcaugaaaaagugagaagccagcuccgcgauaacgcuaaugaccugggcaacggguguuucgaguuuuggcacaagugcgauaaugaauguauggaguccguuaaaaacggaaccuaugacuacccuaaguaccagacggagucucggcuuaauagacagaaaauugaaagcgugaagcuggagaacuucgaugucuaucaaauccucgccauuuacuccacagugucuagcucccugguccuggugggccucaucauggcgauggggcuguggaugugcagcaauggaucuaugcagugccgcaucuguauuuga

SEQ ID NO: 194126 - RNA, 1701 nt, Artificial Sequence
  derived and/or modified sequence opt5 from hemagglutinin__InfluenzaA__AHJ57743
augaucgccuucauugugaucgcuauucuggucgccaccggcaagagcgacaagaucugcauuggguaccacgcgaacaauuccacaacgaagguugauaccauccucgagaaaaacgugacagugacccauucugucgaacugcuugagaaucagaaggaagagagauuuuguaaaaucagcaacaaggcuccccuggaccuccgggauugcacaauugaaggauggauccugggcaauccucgcugugggauucuucuggccgaccaauccuggucuuauaucguggagagaccggaugcccggaacggaauuugcuaccccggcacccucaaugaggcugaagaacugaaggcccugaucgggagcggagaaaaaguugagcgcuucgagauguuuccuaaguccacaugggcuggcguggacaccucuagcggcgucuccagcgccuguccccucgggaacggaccuucuuucuauagaaaucugcuuuggauuaucaaacugaaguccagcgaauaccccgugauccggggcacguuuaacaauaccggggauaaaucuguucucuauuucuggggagugcaccauccuccggucacaaccgagcagaacgcgcuguacggcuccgggaaucgcuaugugagaaugggaacagaaagcaugaacuuugcccggucucccgagauugcugcccgcccugcugugaauggccagagaggccggaucgacuacuucugguccauucuuaagcccggggaaacccugaacgucgagagcaacggaaaucucaucgccccuugguacgcguaucgcuuuguuaacaaggauuccaaaggcgccauuuucagaucuaaucugcccaucgagaacugcgacgcuacgugucagacaaucgaaggggugauucggaccaauaagacauuucaaaacgugagcccgcuguggaucggagagugcccuaaauacgucaaguccaaaagccuccgccuggccaccggccuuagaaaugugccccagauugaaacccgggggcuguucggagcuaucgccggcuuuauugagggcggguggacaggaaugaucgauggcugguauggguaccaccaugaaaacucucagggauccggcuaugccgcugacagagagagcacgcagaaggcgaucgaugggauuaccaauaaaguuaacucuaucauugacaagaugaauacacaauucgaggccgcuggccacgaguucagcaaccucgagcgccggaucgacaaucugaacaagagaauggaagauggauuucuugacguguggaccuacaaugccgagcugcucguccugcuggaaaacgagcgcacacucgaucugcacgacgccaacgugaaaaaucuucaugagaagguuaaaucccagcugcgggauaacgcuaaugaccucggcaacggguguuucgaauuuuggcacaagugcgauaaugaguguauggaaucugugaaaaacggaaccuaugacuacccuaaguaccagaaggagagcagacugaaucgccagaaaauugaguccgucaaacuugaaaacuucgauguguaucaaauccuggccauuuacagcacggucucuuccagccucgugcugguuggccugaucauggcgauggggcucuggaugugcucuaauggauccaugcagugccggaucuguauuuga

SEQ ID NO: 194127 - RNA, 1701 nt, Artificial Sequence
  derived and/or modified sequence opt5 from hemagglutinin__InfluenzaA__AHJ57755
augaucgccuucauugugaucgcuauucuggucgccaccggcaagagcgacaaaaucugcauuggguaccacgcgaacaauuccacaacgaagguugauaccauccucgagaaaaacgugacagugacccauucugucgaacugcuugagaaucagaaggaagagagauuuuguaaaaucagcaacaaggcuccccuggaccuccgggauugcacaauugaaggauggauccugggcaauccucgcugugacauucuucuggccgaucaauccuggucuuauaucguggagagaccgaacgcccggaaugggauuugcuaccccggaacccucaacgaggcugaagaacugaaggcccugaucggcagcggggaaggaguugagcgcuucgagauguuuccuaaauccacaugggugggcgucgacaccucuagcggcguguccagcgcuuguccccucgggaauggaccuucuuucuauagaaaccugcuuuggauuaucaagcugaaauccagcgaauaccccguuauccggggcacguuuaauaacaccggggauaagucugugcucuauuucuggggaguccaccauccuccggugacaaccgagcagaaugcccuguacggcuccgggaaccgcuaugugagaaugggaacagaaagcaugaauuuugcgcggucucccgagauugccgcucgcccugccgucaacggccagagaggccggaucgacuacuucugguccauucuuaaacccggggaaacccugaacguugagagcaauggaaaccucaucgcuccuugguacgccuaucgcuuugugaauaaggauaacaagggcgcgauuuucagauccaaucugcccaucgagaacugcgacgccacgugucagacaaccgaaggggugauccggacaaauaaaaccuuucaaaacgucucuccgcuguggauuggagagugcccuaaguacgugaaaagcaagucccuccgccuggcuaccggccuuagaaauguuccccagaucgaaacacgggggcuguucggagccauugcuggcuuuaucgagggcggguggacgggaaugauugauggcugguauggguaccaccaugaaaacagccagggaucuggcuaugccgccgacagagaguccacccagaaagcuaucgaugggaucacaaauaaggugaacagcauuaucgacaaaaugaauacccaauucgaggcggccggccacgaguucucuaaccucgagcgccggauugacaaucugaacaagagaauggaagauggauuucuugacgucuggacauacaacgcugagcugcucgugcugcuggaaaaugagcgcacccucgaucugcacgacgccaacguuaagaaucuucaugagaaagugaagucucagcugcgggauaacgccaaugaccucggcaacggguguuucgaauuuuggcacaaaugcgauaaugaguguauggaauccgucaagaacggaacguaugacuacccuaaauaccagaaggagucuagacugaaucgccagaagaucgagagcgugaaacuugaaaacuucgaugucuaucaaauucuggcuaucuacuccacagugagcagcucccucguuguggucggccugauuauggccauggggcuguggaugugcagcaauggaucuaugcagugccggaucuguaucuga

SEQ ID NO: 194128 - RNA, 1701 nt, Artificial Sequence
  derived and/or modified sequence opt5 from hemagglutinin__InfluenzaA__AHJ57767
augaucgccuucauugugaucgcuauucuggccgcgaccggcaagagcgacaaaaucugcauuggguaccacgcuaacaauuccacaacgaaggucgauaccauccucgagaaaaacguuacagugacccauucuguggaacugcuugagaaucagaaggaagagagauuuuguaaaaucagcaacaaggcuccccuggaccuccgggauugcacacuggaaggauggauucuuggcaauccucgcugugggauccugcucgccgaccaauccuggucuuauauugucgagagaccgaacgcccggaauggaaucugcuaccccggcacccugaacgagguggaggaacugaaggcccucauugggagcggagaacgcguugagagauucgagauguuuccuaaauccacaugggcuggcguggauaccaauucuggcgucagcuccgccuguccccuggggaacggaccuagcuucuaucggaaucuucuguggaucauuaagcucaaaucuuccgaauaccccgugauccgcggcacguuuaacaauaccggggacaagagcauccuguauuucuggggaguucaccauccuccggugacaaccgagcaggaagcgcuuuacggcucuggggauagauauguccggaugggaacagaguccaugaacuuugcccgcagccccgaaauugcugccagaccugcugugaauggccagcggggccgcaucgacuacuucuggucuauucugaaacccggggagacccucaacguggaguccaacggaaaucugaucgccccuugguacgcguauagauuugucaacaaggauagcaagggcgccauuuuccgguccaaucugcccaucgaaaacugcgacgcuacgugucagacaaccgaggggguuauccgcacaaauaaaaccuuucaaaacgugucuccgcucuggauuggagaaugcccuaaguacgugaaaagcaagucccugagacuugccaccggccugcggaaugucccccagaucgagacaagaggacucuucggggcuauugccggcuuuaucgaaggcggguggacgggaaugauugauggcugguauggguaccaccaugagagcucucagggauccggcuaugccgcugacaaagagagcacccagaaggcgaucgaugggaucacaaacaaaguuaauucuauuaucgacaagaugaacacccaauucgaagccgugggccacgaguucagcaaucuggaacgccggauugacaaccuuaauaagagaauggaggauggauuucuggacguguggacauacaacgcugaacuccugguccugcucgagaaugagcgcacccuggaucuucacgacgccaacgugaaaaaccugcaugaaaagguucggucccagcucagagauaaugccaacgaccugggcaauggguguuucgaguuuuggcacaaaugcaacaaugaauguauggagucugugaagaacggaacguaugauuacccuaaauaccagaaggagagccgccuuaaucggcagaagaucgaauccgucaaacuggagaacuucgacguguaucaaauucucgcuaucuacagcacagucucuuccagccuggugcugguuggccucauucuggccauggggcuuuggaugugcucuaauggauccaugcagugcagaaucuguaucuga

SEQ ID NO: 194129 - RNA, 1701 nt, Artificial Sequence
  derived and/or modified sequence opt5 from hemagglutinin__InfluenzaA__AHJ57779
augaucgccauuaucauuaucgcuauucugguggccaccggcaagagcgacaaaaucugcaucggguaccacgcgaacaauuccacaacgaaggucgauaccauucucgagaaaaacguuacagugacccauucuguggaacugcuugaggaccagaaggaagagagauucuguaaaaucagcaauaaggcuccccuggaucuccgggacugcacaauugaaggauggauccugggcaacccucgcugugggauucuucuggccgaucaauccuggucuuauaucgucgagagaccgaaugcccggaacggaauuugcuaccccggcacccucaaugaggcugaagaacugaaggcccugaucgggagcggagaaggcguggagcgcuuugagauguucccuaaauccacaugggcuggcguugacaccaacucuggggugagcuccgccuguccccucggaaauggcccuagcuuuuauagaaaccugcuuuggaucauuaagcugaaaucuuccgaauaccccgucauccgggggacguucaauaacaccggagauaagagcgugcucuauuuuuggggcguucaccauccuccggugacaaccgagcagaaugcgcuguacgggucuggaaaccgcuaugucagaaugggcacagaauccaugaauuucgcccggagccccgagauugcugcccgcccugcugugaacggccagagagggcggaucgacuacuuuuggucuauucuuaaacccggagaaacccugaacguggaguccaauggcaaccucaucgccccuugguacgcguaucgcuucgucaauaaggauagcaagggggccaucuuuagauccaaccugcccauugagaauugcgacgcuacgugucagacaaccgaaggaguuauccggacaaacaaaaccuuccaaaaugugucuccgcuguggauuggcgagugcccuaaguacgugaaaagcaagucccuccgccuggccaccgggcuuagaaacgucccccagaucgaaacacggggacuguuuggcgcuauugccggcuucaucgaagggggauggacgggcaugaucgaugggugguauggauaccaccaugaaaauagccagggcucuggguaugccgcugacagagaguccacccagaaagcgauugauggcaucacaaacaaggugaauagcauuaucgacaaaaugaacacccaauuugaggccgcuggacacgaguucucuaaucucgagcgccggauugacaaccugaauaagagaauggaagauggcuuccuugacguuuggacauacaacgccgagcugcucgugcugcuggaaaacgagcgcacccucgaucugcacgacgccaaugucaagaaccuucaugagaaagugaagucucagcugcgggauaaugcuaacgaccucgggaauggauguuuugaguucuggcacaaaugcgauaacgaguguauggaauccguuaagaauggcacguaugacuacccuaaauaccagaaggagucuagacugaaccgccagaagaucgagagcgugaaacuugaaaauuuugaugucuaucaaauucuggccaucuacuccacagugagcagcucccucguccugguggggcugaucauggcgaugggacucuggaugugcagcaacggcucuaugcagugcaugauuuguaucuga

SEQ ID NO: 194130 - RNA, 1701 nt, Artificial Sequence
  derived and/or modified sequence opt5 from hemagglutinin__InfluenzaA__AHJ57791
augaucgccauuaucauuaucgcuauucuggugaccacaggcaagagcgacaaaaucugcaucggguaccacgccaacaauuccacgaccaaggucgauacaauucucgagaaaaacguuaccgugacacauucuguggaacugcuugagaauaagaaagaagagagauucuguaagaucagcaacaaggcgccccuggaccuccgggauugcacccuggaaggauggauucuuggcaauccucgcugugggauccugcucgcugaccaguccuggucuuauauugucgagagaccgaacgcccggaauggaaucugcuaccccggcacacugaacgaggugaaagaacugaaggcccucauugggagcggagagcgcguuaaaagauuugaaauguucccuaaguccaccugggcuggcguggauacgaauagcggcgucagcuccagcuguccccuggggaacggaccuucuuuuuaucggaaucuucuguggaucaucaaacacaccacauccggcuaccccgugauuaaggggaccuauacaaacaccggagacaagagcguucucuacuucuggggcauccaucacccuccggauacgacagagcaaaaugugcuguaugggucuggaaaccgcuacgucagaaugggcaccgaguccaugaauuuugcccggagccccgaaauugcugcccgcccugcggugaacggccagagagggcggaucgacuacuucuggucuauucuuaaacccggagagacacugaacguggaauccaauggcaaccucaucgccccuugguaugcuuaccgcuuugucaauaaggauagcaaaggggccaucuucagauccaaccugcccauugaggacugcgaugcuaccugucagaccacagaaggaguuauccggacgaauaagaccuuucagaacgugucuccgcuguggauuggcgagugcccuaaauaugucaagagcaaaucccuccgccuggccacagggcuuagaaaugugccccaaaucgagacccggggacuguucggcgcgauugccggcuuuaucgaagggggauggacaggcaugaucgacgggugguacggauaucaucacgagaacagccagggcucuggguacgcugccgauagagaauccacccagaaggcuauugacggcaucacgaauaaggugaacagcauuaucgacaaaaugaauacacaguucgaggccguuggacacgaauuuucuaaccucgagcgccggauugauacccugaauaagagaauggaggacggcuuccuugauguguggaccuauaacgccgaacugcucguccugcuggagaaugaacgcacacucgaccugcaugaugcuaacgugaaaaaccuucacgagcggguuaagagccaacugagagacaaugcgaacgaucucgggaauggauguuucgaauuuuggcauaaaugcgacaacgaguguauggaguccgugaagaauggcaccuacaacuacccuaaguaucaggccgaaucucgccugaauaaacagaagaucgagagcgucaaacuugaagaguucgggguguaccagauucuggcuaucuauuccacagucucuucuucccucgugcugguuggacugaucauggccauggugcucuggaugugcagcaacggcucuaugcaaugccgggucuguauuuga

SEQ ID NO: 194131 - RNA, 1701 nt, Artificial Sequence
  derived and/or modified sequence opt5 from hemagglutinin__InfluenzaA__AHJ57815
augaucgccuucauuaucauuaccauccuggugacaacgggcaagagcgacaaaauuugcaucggguaccacgcuaacaauuccaccacaaaggucgauaccauccucgagaaaaacguuacagugacccauucuguggaacugcuugagaaucagaaggaagagagauuuugucggauuagcaacaaagcgccccuggaccucaaggaaugcacacuggagggauggauccuuggcaauccucaaugugaucugcuccugggggaccaguccuggucuuauauugucgagcgcccgaacgccagaaauggaaucugcuaccccggcacccugaacgaaguggaggaacuccgggcucugauugggagcggagagggcguugagcgcuucgaaauguuuccuaaguccacgugggccggcguggauaccaauagaggggucacaucuagcugucccuucggauccggcagcucuuuuuaucggaaccuucuguggaucgugaaacacaccacauccagcuacccuguuauuaaggggaccuuccgcaauacgggagacaaaucugugcucuauuuuuggggcguccaucaccccuucgauacaaacgagcagaaugugcuguacggguccggaaacagauaugugcggaugggcaccgaaagcaugaauuuugcccgcggcccugaggucgcugccagaccgguugugaacgggcagcggggacgcaucgacuacuucuggucuauccuuaagcccggcgaaacacugaacauugaguccaaugggaaccucaucgcuccuugguacgccuauagauuugugaauaaagauagcaagggagcgauuuuccgguccaaccugcccaucgaggacugcgaugccaccugucaaaccauugaaggcgucauccgcacaaauaagacguuucagaacgugucuccucuguggaucggggagugccccaaauacguuaagagcgaaucccucagacuggcuaccggacuucggaaugugccgcagauugagacaagaggccuguucggcgccaucgcuggguucauugaaggaggcuggaccgggaugaucgacggaugguauggcuaccaucacgagaacagccaggggucuggcuaugccgcggaucgcgaguccacacaaaaagccauugacggaaucaccacgaaggucaauagcaucauugacaaaaugaacacacaguuugaagcugugggccacgaguucucuaaucucgaacggagaaucgauaaccugaauaagcgccuugaggacggguuucuggauguuuggaccuacaacgccgaacuccuggugcugcucgagaaugagcggacccuggaccuucaugaugcuaacgucaaaaaccugcacgaaagagugcgcagccagcuccgggacaaugccaacgaucugggaaauggcuguuucgaguuuuggcauaagugcgacaacgaauguauggaguccgucaagaaugggacauauaacuacccuaaauaccaggccgagucuagacuuaauaagcaacgcauugaaagcgugaaacuggagaacuucgauguuuaucagauccucgcuauuuacuccaccgugucuagcucccugguccuggugggacucauccuggcgaugggccuuuggaugugcagcaaugggucuaugcagugccggauuuguaucuga

SEQ ID NO: 194132 - RNA, 1701 nt, Artificial Sequence
  derived and/or modified sequence opt5 from hemagglutinin__InfluenzaA__AHJ57827
augaucgccuucauugugaucgcuauucuggucgccaccggcaagagcgacaaaaucugcauuggguaccacgcgaacaauuccacaacgaagguugauaccauccucgagaaaaacgugacagugacccauucugucgaacugcuugagaaucagaaggaagagagauuuuguaaaaucagcaacaaggcuccccuggaccuccgggauugcacaauugaaggauggauccugggcaauccucgcugugggauucuucuggccgaccaauccuggucuuauaucguggagagaccgaacgcccggaauggaauuugcuaccccggcacccucaacgagguugaagaacugaaggcucugaucgggagcggagaacgcguggagagauucgagauguuuccuaaauccacaugggccggcgucgauaccaauucuggcgugagcuccgcuuguccccucgggaacggaccuagcuucuaucggaaucugcuuuggauuaucaagacgaaaucuuccgaauaccccguuaucaagggcaccuuuaacaauacaggggacaaaagcgugcuguauuucuggggaguccaccauccuccgucucgcaacgagcagaaugugcucuacggcuccggggauagauaugugcggaugggaaccgaaagcaugaacuuugcccgcucucccgagauugcggccagaccugcugucaacggccagcggggccgcaucgacuacuucugguccauucugaagcccggggaaacacuuaauguugagagcaacggaaaucugaucgccccuugguacgcuuauagauuugugaacaaggauucccggggcgccauuuuccgcucuaaucuccccaucgagaacugcgacgcgaccugucagacggccgaaggggugaucagaacaaauaaaaccuuucaaaacgucagcccgcuguggauuggagagugcccuaaguacgugaaauccaagagccugcggcucgcuacaggccugagaaauguuccccagaucgaaacccgcgggcuuuucggagccauugcuggcuuuaucgagggcggguggaccggaaugauugauggcugguauggguaccaccaugaaaacucucagggauccggcuaugccgccgaccgggagagcacacagaaagcuaucgaugggaucacgaauaaggugaacucuauuaucgacaaaaugaauacccaauucgaggcggucggccacgaguucagcaaccuggagagacgcauugacaaucucaacaagcggauggaagauggauuucuggacguguggacauacaacgccgagcuucugguucuccuggaaaaugagagaacccuggaucuccacgacgcuaacgugaagaaucugcaugagcgcgucaaaucccagcuucgggauaacgccaaugaccugggcaacggguguuucgaauuuuggcacaagugcgauaaugaguguauggaaucugugaaaaacggaacauaugacuacccuaaguaccagaaagagagcagacucaaucgccagaagaucgaguccgucaagcuggaaaacuucgauguguaucaaauucuugccaucuacagcaccguuucuuccagccuggugcucgucggccugauuauggcuauggggcuguggaugugcucuaauggauccaugcagugccggaucuguaucuga

SEQ ID NO: 194133 - RNA, 1701 nt, Artificial Sequence
  derived and/or modified sequence opt5 from hemagglutinin__InfluenzaA__AHJ57850
augaucgccuucauugugaucgcuauucuggccaccacaggcaagagcgacaaaaucugcauuggguaccacgcgaacaauuccacgaccaaggucgauacaauccucgagaaaaacguuaccgugacacauucuguggaacugcuugagaaucagaaggaagagagauuuuguaaaaucagcaacaaggcuccccuggaccuccgggauugcacccuggaaggauggauucuuggcaauccucgcugugggauccugcucgccgaccaauccuggucuuauauugucgagagaccgaacgcccggaauggaaucugcuaccccggcauucugaacgaggcugaggaacugaaggcccucaucgggagcggagaacgcguggagagauucgagauguuuccuaaauccacaugggcuggcguugauaccgacucuggcgugagcuccgccuguccccuggggaauggaccuagcuucuaucggaaccuucuguggauuaucaagcucaaaucuuccgaauaccccgucauccgcggcacguuuaauaacaccggggauaagagcauucuguauuucuggggagugcaccauccuccgguuacaaccgagcaggaagcgcuuuacggcucugggaauagauaugugcggaugggaacagaguccaugaacuuugcccgcacccccgaaaucgcugccagaccugcugucaauggccagcggggccgcauugacuacuucuggagcauccugaaacccggggagacgcucaacguggagucuaacggaaaucugauugccccuugguacgcguauagauuugugaacaaggauuccaagggcgccaucuuccggagcaaucugcccaucgaaaacugcgacgcuacaugucagaccacagagggggucauucgcaccaauaaaaccuuucaaaacguuuccccgcucuggaucggagaaugcccuaaguacgugaaaucuaagagccugagacuugccacaggccugcggaaugugccccagauugagacgagaggacucuucggggcuaucgccggcuuuauugaaggcggguggaccggaaugaucgauggcugguauggguaccaccaugagaacucccagggaagcggcuaugccgcugaccgcgagucuacacagaaagcgaucgaugggauuaccaauaaggucaacuccaucauugacaaaaugaauacacaauucgaagccgugggccacgaguucagcaaccuggaacggagaaucgacaaucuuaacaagcgcauggaggauggauuucuggacguuuggaccuacaaugcugaacuccuggugcugcucgagaacgagcggacgcuggaucuucacgacgccaacgucaagaaucugcaugaaaaagugagaucucagcuccgcgauaacgccaaugaccugggcaacggguguuucgaguuuuggcacaagugcgauaaugaauguauggagagcguuaaaaacggaacauaugacuacccuaaguaccaggcugagucccggcuuaauagacagaaaauugaaucugugaagcuggagaacuucgaugucuaucaaauccucgccauuuacagcaccguguccagcucucugguccuggugggccucaucauggcgauggggcuguggaugugcuccaauggaagcaugcagugccgcaucuguauuuga

SEQ ID NO: 194134 - RNA, 1701 nt, Artificial Sequence
  derived and/or modified sequence opt5 from hemagglutinin__InfluenzaA__AHJ57862
augaucgccuucauugugaucgcuauucuggccgcgaccggcaagagcgacaaaaucugcauuggguaccacgcuaacaauuccacaacgaaggucgauaccauccucgagaaaaacguuacagugacccauucuguggaacugcuugagaaucagaaggaagagagauuuuguaaaaucagcaacaaggcuccccuggaccuccgggauugcacacuggaaggauggauucuuggcaauccucgcugugggauccugcucgccgaccaauccuggucuuauauugucgagagaccgaacgcccggaauggaaucugcuaccccggcauucugaacgaggccgaggaacugaaggcucucaucgggagcggagaacgcguggagagauucgagauguuuccuaaauccaccugggccggcguugauacaaauucuggcgugagcuccgcguguccccuggggaacggaccuagcuucuaucggaaucuucuguggauuaucaagcucaaaucuuccgaauaccccgucauccgcggcaccuuuaacaauacgggggacaagagcauucuguauuucuggggagugcaccauccuccgguuaccacagagcaggaagcccuuuacggcucugggaacagauaugugcggaugggaaccgaguccaugaauuuugcucgcagccccgaaaucgccgcuagaccugccgucaacggccagcggggccgcauugauuacuucuggucuauccugaaacccggggagacacucaacguggaguccaauggaaaccugauugcgccuugguacgccuauagauuugugaauaaggacagcaagggcgcuaucuuccgguccaaccugcccaucgaaaauugcgaugccaccugucagacgacagagggggucauucgcaccaacaaaacauuucaaaauguuucuccgcucuggaucggagaaugcccuaaguacgugaaaagcaagucccugagacuugcuaccggccugcggaacgugccccagauugagaccagaggacucuucggggccaucgccggcuuuauugaaggcggguggacaggaaugaucgacggcugguauggguaccaccaugagaauagccagggaucuggcuaugcugcggaucgcgaguccacgcagaaagccaucgacgggauuaccaacaaggucaauagcaucauugauaaaaugaacacacaauucgaagcugugggccacgaguucucuaaucuggaacggagaaucgacaaccuuaauaagcgcauggaggacggauuucuggauguuuggaccuacaacgccgaacuccuggugcugcucgagaacgagcggacacuggaccuucacgaugccaaugucaagaaccugcaugaaaaagugagaagccagcuccgcgacaaugcuaacgaucugggcaauggguguuucgaguuuuggcacaagugcgacaacgaauguauggaguccguuaaaaauggaaccuaugauuacccuaaguaccaggccgagucucggcuuaacagacagaaaauugaaagcgugaagcuggagaauuucgacgucuaucaaauccucgcgauuuacuccacggugucuagcucccugguccuggugggccucaucauggcuauggggcuguggaugugcagcaacggaucuaugcagugccgcaucuguauuuga

SEQ ID NO: 194135 - RNA, 1701 nt, Artificial Sequence
  derived and/or modified sequence opt5 from hemagglutinin__InfluenzaA__AHJ57873
augaucgccuucauugugaucgcuacccuggucgccacaggcaagagcgacaaaauuugcaugggguaccacgcgaacaauuccacgaccaagguugauacaauccucgagaaaaacgugaccgugacacauucugucgaacugcuugagaaucagaaggaagagagauuuuguaaaauuagcaacaaggcuccccuggaccuccgggauugcacccuggaaggauggauccuuggcaauccucgcugugggauccugcucgccgaccaauccuggucuuauauuguggagagaccgaacgcccggaauggaaucugcuaccccggcacacugaacgaggcugaggaacugaaggcccucauugggagcggagaacgcguugagagauucgagauguuuccuaaauccaccuggacgggcguggauaccgaaucuggcgucagcuccgcuuguccccuggggaauggaccuagcuucuaucggaaccuucuguggaucauuaagcucaaaucuuccgaguaccccgugauccgcggcacauuuaauaacaccggggacaagagcauucuguauuucuggggaguucaccauccuccggugacaaccgaacagaaugcccuuuacggcucuggggauagauauguccggaugggaacggaguccaugaacuuugcgcgcagccccgaaaucgccgcuagaccugccgugaauggccagcggggccgcaucgacuacuucuggucuauucugacacccggggagacccucaacguggaguccaacggaaaucugaucgcuccuugguacgccuauagauuugucaacaaagauagcaagggcgcgauuuuccgguccaaucugcccaucgaaaacugcgacgccacaugucagaccaccgaggggguuauucgcacaaauaagacguuucaaaacgugucuccgcucuggaucggagaaugcccuaaauacgugaagucuaaaucccugagacuugcuaccggccugcggaaugucccccagaucgagacaagaggacucuucggggccauugcuggcuuuaucgaaggcggguggaccggaaugauugauggcugguauggguaccaccaugagaacagccagggaucuggcuaugccgccgacaaggaguccacacagaaagcuaucgaugggauuaccaauaaggugaacagcaucaucgacaaaaugaauacgcaauucgaagcgguuggccacgaguucucuaaccuggaacgccggauugacaaucuuaacaagagaauggaggauggauuucuggacguguggacauacaaugccgaacuccugguccugcucgagaacgagcgcacccuggaucuucacgacgcuaacgugaagaaucugcaugaaaaaguucggagccagcucagagauaacgccaaugaccugggcaacggguguuucgaguuuuggcacaagugcgauaaugaauguauggaguccgugaaaaacggaaccuaugacuacccuaaguaccagaaagagucucgccuuaaucggcagaagaucgaaagcgucaagcuggagaacuucgauguguaucaaauucucgccaucuacuccacagucagcagcucccuggugcugguuggccucauucuggcuauggggcuuuggaugugcagcaauggaucuaugcauugcagaaucuguauuuga

SEQ ID NO: 194136 - RNA, 1701 nt, Artificial Sequence
  derived and/or modified sequence opt5 from hemagglutinin__InfluenzaA__AHJ57885
augaucgccuucauugugauggcuauccuggccgcgaccggcaagagcgacaagauuugcaucggguaccacgcuaacaauuccacaacgaaggucgauaccauucucgagaaaaacguuacagugacccauucuguggaacugcuugagaaucagaaggaagagagauuuuguaaaaucagcaacaaggcuccccuggaccuccgggauugcacacuggaaggauggauccuuggcaauccucgcugugggauucugcucgccgaccaauccuggucuuauaucgucgagagaccgaacgcccggaauggaauuugcuaccccggcauccugaacgaggccgaagaacugaaggcucucauugggagcggagaacgcguggagagauucgagauguuuccuaaauccaccugggccggcguugauacagacucuggcgugagcuccgcguguccccuggggaauggaccuagcuucuaucggaaccuucuguggaucauuaagcgcaaaucuuccgccuaccccgucaucagaggcaccuuuaauaacacgggggauaagagcauccucuauuucuggggagugcaccauccuccgguuaccacagaacaggaggcucuguacggcucugggaaucgguaugugcgcaugggaaccgaauccaugaacuuugccagaaaucccgagauugcugcccggccugcggucaacggccagcgcggcagaaucgacuacuucuggagcauucuuaaacccggggaaacacugaacaucgagucuaauggaaaccucauugccccuugguacgcuuaucgguuugugaauaaggauuccaagggcgccaucuuccgcagcaaccugcccaucgaggacugcgaugcuuccugucagaccacggaaggggugauuagaacaaauaaaaccuuucaaaacgucucuccgcuguggaucggagagugcccuaaguacguuaaaagcaagucccuccggcuggccacaggccuuagaaaugugccccagauugaaacccgcgggcuguucggagccaucgcuggcuuuauugagggcggguggaccggaaugaucgacggcugguauggguaccaccaugaaaacagccagggaucuggcuaugcggccgaucgggaguccacacagaaagcuaucgacgggauuacgaauaaggugaacagcaucauugacaaaaugaauacccaauucgaggccgucggccacgaguucucuaaccucgagagacgcaucgauaaucuggacaagcggauggaagauggauuucuugacguguggacauacaacgccgagcugcucguucugcuggaaaaugagagaacccucgaucugcacgacgcuaacgugaagaaccuucaugagaaaguccgcagccagcugcgggauaaugccaacgaccucggcaauggguguuucgaauuuuggcacaagugcgauaacgaguguauggaauccgugaaaaauggaacauaugacuacccuaaguaccaggcggagucuagacugaaccgccagaaaauugagagcguuaaacuugaaaauuucgauguguaucaaauccuggcuauuuacuccaccgucucuagcucccucgugcuggucggccugaucauggccauggggcucuggaugugcagcaacggaucuaugcagugccggaucuguauuuga

SEQ ID NO: 194137 - RNA, 1701 nt, Artificial Sequence
  derived and/or modified sequence opt5 from hemagglutinin__InfluenzaA__AHJ57897
augaucgccuucauugugaucgcuauucuggccgcgaccggcaagagcgacaagaucugcauuggguaccacgcuaacaauuccacaacgaaggucgauaccauccucgagaaaaacguuacagugacccauucuguggaacugcuugagaaucagaaggaagagagauuuuguaaaaucagcaacaaggcuccccuggaccuccgggauugcacacuggaaggauggauucuuggcaauccucgcugugggauccugcucgccgaccaauccuggucuuauauugucgagagaccgaacgcccggaauggaaucugcuaccccggcauucugaacgaggccgaagaacugaaggcucucaucgggagcggagaacgcguggagagauucgagauguuuccuaaauccaccugggccggcguugauacagacucuggcgugagcuccgcguguccccuggggaauggaccuagcuucuaucggaaccuucuguggauuaucaagcgcaaaucuuccgccuaccccgucaucagaggcaccuuuaauaacacgggggauaagagcauucucuauuucuggggagugcaccauccuccgguuaccacagaacaggaggcucuguacggcucugggaaucgguaugugcgcaugggaaccgaauccaugaacuuugccagaaaucccgagaucgcugcccggccugcggucaacggccagcgcggcagaauugacuacuucuggagcauccuuaaacccggggaaacacugaacauugagucuaauggaaaccucaucgccccuugguacgcuuaucgguuugugaauaaggauuccaagggcgccaucuuccgcagcaaccugcccauugaggacugcgaugcuuccugucagaccacggaaggggugaucagaacaaauaaaaccuuucaaaacgucucuccgcuguggauuggagagugcccuaaguacguuaaaagcaagucccuccggcuggccacaggccuuagaaaugugccccagaucgaaacccgcgggcuguucggagccauugcuggcuuuaucgagggcggguggaccggaaugaucgacggcugguauggguaccaccaugaaaacagccagggaucuggcuaugcggccgaucgggaguccacacagaaagcuauugacgggaucacgaauaaggugaacagcauuaucgacaaaaugaauacccaauucgaggccgucggccacgaguucucuaaccucgagagacgcauugauaaucugaacaagcggauggaagacggauuucuugauguguggacauacaaugccgagcugcucguucugcuggaaaacgagagaacccucgaccugcacgaugcuaacgugaagaaucuucaugagaaaguccgcagccagcugcgggacaacgccaaugaucucggcaacggguguuucgaauuuuggcacaagugcgacaaugaguguauggaauccgugaaaaacggaacauaugauuacccuaaguaccaggcggagucuagacugaaucgccagaaaaucgagagcguuaaacuugaaaacuucgacguguaucaaauucuggcuaucuacuccaccgucucuagcucccucgugcuggucggccugaucauggccauggggcucuggaugugcagcaauggaucuaugcagugccggauuuguaucuga

SEQ ID NO: 194138 - RNA, 1701 nt, Artificial Sequence
  derived and/or modified sequence opt5 from hemagglutinin__InfluenzaA__AHJ57908
augaucgccuucauugugaucgcuauucuggucgccaccggcaagagcgacaaaaucugcauuggguaccacgcgaacaauuccacaacgaagguugauaccauccucgagaaaaacgugacagugacccauucugucgaacugcuugagaaucagaaggaagagagauuuuguaaaaucagcaacaaggcuccccuggaccuccgggauugcacaguggaaggauggauucugggcaauccucgcugugggauccuuauugccgaccaauccuggucuuauaucguugagagaccgaacgcccggaauggaauuugcuaccccggcacccugaacgaggcugaggagcucaaggcccugaucgggagcggagaaggcguggagcgcuucgagauguuuccuaaauccacaugggcuggcgucgauaccucuagcgggguguccagcgccuguccccugggaaauggcccuucuuucuauagaaaccuccuguggauuaucaaacuuaaguccagcgaauaccccguuauccgggggacguuuaauaacaccggagacaagucugugcuguauuucuggggcguccaccauccuccggugacaaccgagcaggaugcgcucuacggguccggaaaucgcuaugugagaaugggcacagaaagcaugaacuuugcccggucucccgagauugcugcccgcccugcugucaauggccagagagggcggaucgacuacuucugguccguucugaaacccggagaaacccuuaacguggagagcaacggcaaucugauugccccuugguacgcguaucgcuuugugaacaaggauaauaagggggccaucuucagauccaaccuccccauugagaauugcgacgcuacgugucagacaaccgaaggagucauccggacaaacaaaaccuuucaaaaugugucuccgcuguggaucggcgagugcccuaaguacguuaaaagcaagucccugcgccucgccaccgggcugagaaacgugccccagauugaaacacggggacuuuucggcgcuaucgccggcuuuauugaagggggauggacgggcaugaucgaugggugguauggauaccaccaugaaaauagccagggcucuggguaugccgcugacagagaguccacccagaaagcgauugauggcaucacaaacaaggucaauagcaucauugacaaaaugaacacccaauucgaggccgcuggacacgaguucucuaaucuggaacgccggaucgacaaccucaauaagagaauggaagauggcuuucuggacguguggacauacaacgccgagcuucugguucuccuggaaaacgagcgcacccuggaucuccacgacgccaaugugaagaaccugcaugagaaagucaagagccagcuucgggauaaugcuaacgaccuggggaauggauguuucgaauuuuggcacaaaugcgauaacgaguguauggaauccgugaagaauggcacguaugacuacccuaaauaccagaaggagucuagacucaaccgccagcggauugagagcgucaagcuggaaaauuucgauguguaucaaauccuugccauuuacuccacaguuucuagcucccugguggucguggggcucaucauggcgaugggacuguggaugugcagcaacggcucuaugcagugcaugauuuguaucuga

SEQ ID NO: 194139 - RNA, 1701 nt, Artificial Sequence
  derived and/or modified sequence opt5 from hemagglutinin__InfluenzaA__AHJ57920
augaucgccauuaucauuaucgcuauucugguggccaccggcaagagcgacaaaaucugcaucggguaccacgcgaacaauuccacaacgaaggucgauaccauucucgagaaaaacguuacagugacccauucuguggaacugcuugagaaucagaaggaagagagauucuguaaaaucagcaacaaggcuccccuggaccuccgggauugcacaauugaaggauggauccugggcaauccuuggugugggauucuucuggccgaccaauccuggucuuauaucgucgagcgcccgaacgccagaaauggaauuugcuaccccggcacccucaacgagguggaagaacugaaggcucugaucgggagcggagaacggguugagcgcuuugagauguucccuaaauccacaugggccggcguggauaccaauucuggcgucagcuccgcuuguccccucgggaacggaccuagcuuuuauagaaaucugcuuuggaucauuaagacgaaaucuuccgaauaccccgugaucaagggcaccuucaacaauacaggggacaaaagcguucuguauuuuuggggagugcaccauccuccgucucggaacgagcagaauguccucuacggcuccggggaucgcuaugugagaaugggaaccgaaagcaugaacuucgcccggucucccgagauugcggcccgcccugcugugaacggccagagaggccggaucgacuacuuuugguccauucugaagcccggggaaacacuuaaugucgagagcaacggaaaucugaucgccccuugguacgcuuaucgcuucguuaacaaggauuccagaggcgccaucuuucggucuaaucuccccauugagaacugcgacgcgaccugucagacggccgaaggggugauccgcacaaauaaaaccuuccaaaacgugagcccgcuguggauuggagagugcccuaaguacgucaaauccaagagccugagacucgcuacaggccugcggaaugugccccagaucgaaaccagagggcuuuuuggagccauugcuggcuucaucgagggcggguggaccggaaugaucgauggcugguauggguaccaccaugaaaacucucagggauccggcuaugccgccgaccgcgagagcacacagaaagcuacggaugggauuaccaauaagguuaacucuaucauugacaaaaugaauacacaauuugaggcggugggccacgaguucagcaaccuggagcggagaaucgacaaucucaacaagcgcauggaagauggauuccuggacgucuggaccuacaacgccgagcuucuggugcuccuggaaaaugagcggacacuggaucuccacgacgcuaacguuaagaaucugcaugagagagugaaaucccagcuucgcgauaacgccaaugaccugggcaacggguguuuugaguucuggcacaagugcgauaaugaauguauggaaucugucaaaaacgacaccuaugauuacccuaaguaccagaaagagagccggcucaauagacagaagauugaguccgugcgccuggaaaacuuugacgucuaucaaauccuugccauuuacagcacggugucuuccagccugguucucgugggacugaucauggcuaugggccuguggaugugcucuaauggguccaugcagugccggaucuguauuuga

SEQ ID NO: 194140 - RNA, 1701 nt, Artificial Sequence
  derived and/or modified sequence opt5 from hemagglutinin__InfluenzaA__AHJ57932
augaucgcccugauuaucauuaccauccucgugacaacgggcaagagcgacaaaauuugcaucggguaccacgcuaacaauuccaccacaaaggucgauaccauccuggagaaaaacguuacagugacccauucuguggaacuucuggagaaucagaaggaagagagauucugucggauuagcaacaaagcgccccucgaccugaaggaaugcacacuugagggauggauccugggcaauccucaaugugaucuccugcugggggaccaguccuggucuuauauugucgagcgcccgaacgccagaaauggaaucugcuaccccggcacccucaacgaaguggaggaacugcgggcucuuauugggagcggagagggcguugagcgcuuugaaauguucccuaaguccacgugggccggcguggauaccaauagaggggucacaucuagcugucccuuuggauccggcagcucuuucuaucggaaccugcucuggaucgugaaacacaccacauccagcuacccuguuauuaaggggaccuuucgcaauacgggagacaaaucugugcuguauuucuggggcguccaucaccccuuugauacaaacgagcagaaugugcuuuacggguccggaaacagauaugugcggaugggcaccgaaagcaugaauuucgcccgcggcccugaggucgcugccagaccgguugugaacgggcagcggggacgcaucgacuacuuuuggucuauccugaagcccggcgaaacacucaacauugaguccaaugggaaccugaucgcuccuugguacgccuauagauucgugaauaaagauagcaagggagcgauuuuucgguccaaccugcccaucgaggacugcgaugccaccugucaaaccauugaaggcgucauccgcacaaauaagacguuccagaacgugucuccucucuggaucggggagugccccaaauacguuaagagcgaaucccugagacuugcuaccggacugcggaaugugccgcagauugagacaagaggccucuuuggcgccaucgcuggguucauugaaggaggcuggaccgggaugaucgacggaugguauggcuaccaucacgagaacagccaggggucuggcuaugccgcggaucgcgaguccacacaaaaagccauugacggaaucaccacgaaggucaauagcaucauugacaaaaugaacacacaguucgaagcugugggccacgaguuuucuaaucuggaacggagaaucgauaaccuuaauaagcgccuggaggacggguuccucgauguuuggaccuacaacgccgaacugcuggugcuccuggagaaugagcggacccuugaccugcaugaugcuaacgucaaaaaccuccacgaaagagugcgcagccagcugcgggacaaugccaacgaucuuggaaauggcuguuuugaguucuggcauaagugcgacaacgaauguauggaguccgucagaaaugggacauauaacuacccuaaguaccaggccgagucucgccugaauaaacaacggauugaaagcgugaagcucgagaacuuugauguuuaucagauccuggcuauuuacuccaccgugucuagcucccugguccucgugggacugauccuugcgaugggccuguggaugugcagcaaugggucuaugcagugcagaauuuguaucuga

SEQ ID NO: 194141 - RNA, 1701 nt, Artificial Sequence
  derived and/or modified sequence opt5 from hemagglutinin__InfluenzaA__AHJ57943
augaucgccuucauugugaucgcuacccuggucgccacaggcaagagcgacaaaauuugcaucggguaccacgcgaacaauuccacgaccaagguugauacaauucucgagaaaaacgugaccgugacacauucugucgaacugcuugagaaucagaaggaagagagauuuuguaaaaucagcaacaaggcuccccuggaccuccgggauugcacccuggaaggauggauccuuggcaauccucgcugugggauucugcucgccgaccaauccuggucuuauaucguggagagaccgaacgcccggaauggaauuugcuaccccggcacacugaacgaggcugaggaacugaaggcccucaucgggagcggagaacgcguugagagauucgagauguuuccuaaauccaccuggacgggcguggauaccgaaucuggcgucagcuccgcuuguccccuggggaauggaccuagcuucuaucggaaccuucuguggauuaucaagcucaaaucuuccgaguaccccgugauucgcggcacauuuaauaacaccggggacaagagcauccuguauuucuggggaguucaccauccuccggugacaaccgaacagaaugcccuuuacggcucuggggauagauauguccggaugggaacggaguccaugaacuuugcgcgcagccccgaaaucgccgcuagaccugccgugaauggccagcggggccgcauugacuacuucuggucuauccugaaacccggggagacacucaacguggaguccaacggaaaucugauugcuccuugguacgccuauagauuugucaacaaggauagcaagggcgcgaucuuccgguccaaucugcccauugaaaacugcgacgccaccugucagacaaccgaggggguuauccgcaccaauaaaacauuucaaaacgugucuccgcucuggaucggagaaugcccuaaguacgugaaaagcaagucccugagacuugcuacgggccugcggaaugucccccagauugagaccagaggacucuucggggccaucgcuggcuuuauugaaggcggguggacaggaaugaucgauggcugguauggguaccaccaugagaacagccagggaucuggcuaugccgccgacaaagaguccacccagaaggcuauugaugggaucacaaauaaagugaacagcaucauugacaagaugaauacccaauucgaaacgguuggccacgaguucucuaaccuggaacgccggaucgacaaucuuaacaagagaauggaggauggauuucuggacguguggacauacaaugcggaacuccugguccugcucgagaacgagcgcacccuggaucuucacgacgccaacgugaaaaaucugcaugaaaagguucggagccagcucagagauaacgcuaaugaccugggcaacggguguuucgaguuuuggcacaaaugcaauaacgaauguauggaguccgugaagaauggaaccuaugauuacccuaaauaccagaaggagucucgccuuaaccggcagaagauugaaagcgucaaacuggagaauuucgacguguaucaaauccucgccauuuacuccacagucucuagcucccuggugcugguuggccucauccuggccauggggcuuuggaugugcagcaacggaucuaugcagugcagaauuuguaucuga

SEQ ID NO: 194142 - RNA, 1701 nt, Artificial Sequence
  derived and/or modified sequence opt5 from hemagglutinin__InfluenzaA__AHJ57954
augaucgccuucauugugaucgcuauucuggccgcgaccggcaagagcgacaaaaucugcauuggguaccacgcuaacaauuccacaacgaaggucgauaccauccucgagaaaaacguuacagugacccauucuguggaacugcuugagaaucagaaggaagagagauuuuguaaaaucagcaacaaggcuccccuggaccuccgggauugcacacuggaaggauggauucuuggcaauccucgcugugggauccugcucgccgaccaauccuggucuuauauugucgagagaccgaacgcccggaauggaaucugcuaccccggcauucugaacgaggccgaagaacugaaggcucucaucgggagcggagaacgcguggagagauucgagauguuuccuaaauccaccugggccggcguugauacaaauucuggcgugagcuccgcguguccccuggggaacggaccuagcuucuaucggaaucuucuguggauuaucaagcagaaaucuuccgccuaccccgucauccgcggcaccuuuaacaauacgggggacaagagcauucucuauuucuggggagugcaccauccuccgguuaccacagaacaggaggcucuguacggcucugggaacagauaugugcggaugggaaccgaauccaugaauuuugcccgcaaccccgagaucgcugccagaccugcggucaacggccagcggggccgcauugauuacuucuggagcauccuuaaacccggggaaacacugaauguggagucuaacggaaaucucauugccccuugguacgcuuauagauuugugaacaaggacuccaagggcgccaucuuccggagcaaucugcccaucgagaacugcgaugcuaccugucaaacgacagaaggggucauucgcaccaauaaaacauuucagaacguuuccccgcuguggaucggagagugcccuaaguacgugaaaucuaagagccucagacuggccaccggccuucggaaugugccccagauugaaaccagagggcuguucggagccaucgcuggcuuuauugagggcggguggacaggaaugaucgacggcugguauggguaccaccaugaaaacucccagggaagcggcuaugcggccgaucgcgagucuacgcaaaaagcuaucgacgggauuaccaauaaggucaacuccaucauugauaaaaugaauacacaguucgaggccgugggccacgaguucagcaaccucgagcggagaaucgacaaucugaacaagcgcauggaagacggauuucuugauguuuggaccuacaacgccgagcugcucgugcugcuggaaaaugagcggacacucgaccugcacgaugcuaacgucaagaaucuucaugagaaagugagaucucagcugcgcgacaacgccaaugaucucggcaacggguguuucgaauuuuggcacaagugcgacaaugaguguauggaaagcguuaaaaacggaaccuaugauuacccuaaguaccaggcggagucccggcugaauagacaaaagauugagucugugaaacuugaaaacuucgacgucuaucagauccuggcuauuuacagcacgguguccagcucucucguccuggugggccugaucauggccauggggcucuggaugugcuccaauggaagcaugcagugccgcaucuguauuuga

SEQ ID NO: 194143 - RNA, 1701 nt, Artificial Sequence
  derived and/or modified sequence opt5 from hemagglutinin__InfluenzaA__AHJ57965
augaucgccuucauuaucauuaccauccuggugacaacgggcaagagcgacaaaauuugcaucggguaccacgcuaacaauuccaccacaaaggucgauaccauccucgagaaaaacguuacagugacccauucuguggaacugcuugagaaucagaaggaagagagauuuuguaaaauuagcaacaaggcgccccuggaccucaaggaaugcacacuggagggauggauccuuggcaauccucaaugugaucugcuccugggggaccaguccuggucuuauauugucgagcggccgaacgcccgcaauggaaucugcuaccccggcacccugaacgaaguggaggaacucaaagcucugauugggagcggagagagaguugagcgguucgaaauguuuccuaaguccacgugggccggcguggauaccaauucuggcgucacaagcuccuguagcuucgggucuggauccagcuuuuaucgcaaccuucuguggaucauuaaacacaccacaucuuccuaccccgugaucaagggcaccuucagaaauacgggggacaaaagcguucucuauuuuuggggagugcaucacccuaucgauacaaccgagcagaacguccuguacggcucugggaaucgguaugugcgcaugggaacagaauccaugaacuucgccagaagccccgagauugcugcccggccuguggucaauggccagcgcggcagaaucgacuacuuuugguccauucuuaagccgggggaaacccugaacaucgagucuaacggaaaucucauugcucccugguacgccuaucgguucguuaacaaggauagcaaaggcgcgaucuuucgcuccaaucugccuaucgagaacugcgacgccaccugucaaacaauugaaggggugaucagaacgaauaagaccuuccagaacgugagcccccuguggauuggagagugcccuaaauacgucaagucugaaucccuccggcuggcuacaggccuucgcaaugugccccagaucgagaccagagggcuguuuggagccauugcuggcuucaucgaaggcggguggacaggaaugaucgauggcugguauggguaccaucacgagaacagccagggaucuggcuaugccgcggaccgggagagcacccaaagagccauugaugggaucacgacaaaaguuaauuccauuaucgacaagaugaacacccaguucgaagcugugggccacgaguuuucuaaucucgaacgccggauugacaaccugaauaaaagaauggaggauggauuccuugacgucuggaccuacaacgccgaacugcucgugcugcuggagaaugagcgcacacucgaucugcaugacgcuaacguuaagaaccuucacgaacgggugagaagccagcugcgcgauaaugccaacgacggcgggaauggauguuuugaguucuggcauaagugcgauaacgaauguauggaguccgucaaaaauggcaccuaugacuacccgaaguaccaggccgagagccggucuaacagacaacgcaucgaauccgugaaacucgagaauuuugaugucuaucagauucuggcuaucuacagcacagugucuuccagccuuguuguggucuggcugauccucgcgauggggcuguggaugugcgccaacggauccaugcagugccggauuuguaucuga

SEQ ID NO: 194144 - RNA, 1701 nt, Artificial Sequence
  derived and/or modified sequence opt5 from hemagglutinin__InfluenzaA__AHJ57977
augaucgccuucauugugaucgcuauucuggccgcgaccggcaagagcgacaaaaucugcauuggguaccacgcuaacaauuccacaacgaaggucgauaccauccucgagaaaaacguuacagugacccauucuguggaacugcuugagaaucagaaggaagagagauuuuguaaaaucagcaacaaggcuccccuggaccuccgggauugcacaauugaaggauggauccugggcaauccucgcugugggauucuucuggccgaccaauccuggucuuauaucgucgagagaccgaacgcccggaauggaauuugcuaccccggcacccucaacgagguggaggaacugaaggcccugaucgggagcggagaacgcguugagagauucgagauguuuccuaaauccacaugggcuggcguggauaccaauucuggcgucagcuccgccuguccccucgggaacggaccuagcuucuaucggaaucugcuuuggauuaucaagcugaaaucuuccgaauaccccgugauccgcggcacguuuaacaauaccggggacaagagcauucucuauuucuggggaguucaccauccuccggugacaaccgagcaggaagcgcuguacggcucuggggauagauauguccggaugggaacagaguccaugaacuuugcccgcagccccgaaaucgcugccagaccugcugugaauggccagcggggccgcauugacuacuucuggucuauccuuaaacccggggagacccugaacguggaguccaacggaaaucucauugccccuugguacgcguauagauuugucaacaaggauagcaagggcgccaucuuccgguccaaucugcccaucgaaaacugcgacgcuacgugucagacaaccgaggggguuauucgcacaaauaaaaccuuucaaaacgugucuccgcuguggaucggagaaugcccuaaguacgugaaaagcaagucccucagacuggccaccggccuucggaaugucccccagauugagacaagagggcuguucggagcuaucgccggcuuuauugaaggcggguggacgggaaugaucgauggcugguauggguaccaccaugagaacagccagggaucuggcuaugccgcugacaaagaguccacccagaaggcgaucgaugggauuacaaauaaagugaacagcaucauugacaagaugaauacccaauucgaagccguuggccacgaguucucuaaccucgaacgccggaucgacaaucugaacaagagaauggaggauggauuucuugacguguggacauacaaugcugaacugcucguccugcuggagaacgagcgcacccucgaucugcacgacgccaacgugaaaaaucuucaugaaaagguucggagccagcugagagauaacgccaaugaccucggcaacggguguuucgaguuuuggcacaaaugcaauaacgaauguauggaguccgugaagaauggaacguaugauuacccuaaauaccagaaggagucucgccugaaccggcagaagauugaaagcgucaaacuugagaauuucgacguguaucaaauccuggcuauuuacuccacagucucuagcucccucgugcugguuggccugauccucgccauggggcuguggaugugcagcaacggaucuaugcagugcagaaucuguauuuga

SEQ ID NO: 194145 - RNA, 1701 nt, Artificial Sequence
  derived and/or modified sequence opt5 from hemagglutinin__InfluenzaA__AHJ57989
augaucgccuucauugugaucgcuauucuggucaccacaggcaagagcgacaaaaucugcauuggguaccacgccaacaauuccacgaccaagguugauacaauccucgagaaaaacgugaccgugacacauucugucgaacugcuugagaaucagaaggaagagagauuuuguaaaaucagcaacaaggcgccccuggaccuccgggauugcacccuggaaggauggauucuuggcaauccucgcugugggauccugcucgcugaccaauccuggucuuauauuguggagagaccgaacgcccggaauggaaucugcuaccccggcacacugaacgagguugaagaacugaaggcccucauugggagcggagaacgcguggagagauucgagauguuuccuaaauccaccugggcucgggucgauacggaccgcggcgugucuagcgccuguccccugggcaaugggccuuccuucuauagaaaccuucuguggaucguuaagcacaccacaagcgaauaccccgugauuaaaggaaccuauacaaauaccggcgauaagucuguccucuacuuuuggggagugcaucacccuccggacacgacagagcagaacgugcuguauggguccggcaaucgguacguccgcauggggaccgaaagcaugaacuucgcuagaucucccgagaucgccgcgcggccugccguuaauggacagcgcggcagaaucgauuacuuuugguccauucuuaaacccggcgaaacacugaacguggagagcaacgggaaucucaucgcuccuugguaugccuaccgguucgugaacaaggacucuaagggagcuauuuuucgcuccaaucugcccaucgagaacugcgaugccaccugucagaccacagaaggcgucauuagaacgaauaaaaccuuccaaaacgugagcccgauguggaucggggagugcccuaaguauguuaaauccaagucucugcggcucgcgacaggacugagaaaugugccccagaucgaaacccgcggccuuuuuggggccauugcuggauucaucgagggcggcuggacagggaugauugacggaugguacggcuaucaucacgaaaacagccagggguccggauacgccgcugaucgggagagcacccagaaagccaucgacggcauuacgaauaaggucaacucuaucaucgacaaaaugaauacacaauuugaggccguggggcacgaguucuccaaccuggagagacgcauugauaaucucaacaagcggauggaagacggcuuccuggauguuuggaccuauaaugcugagcuucuggugcuccuggaaaacgagagaacccuggaccuccaugauagcaacgucaagaaucugcacgagcgcgugaaaucucagcuucgggacaacgcgaaugaucugggaaacggcuguuuugaguucuggcauaagugcgacaaugaauguauggaaagcgucaaaaacgggacauacaauuacccuaaguaucaggccgaguccagacucaaccgccagaaaaucgagucugugaagcuggaagaguuuggaguuuaccaaauucuugcuaucuauagcaccguguccagcucucugguccucgugggccugauuauggccauggggcuguggaugugcuccaauggaagcaugcagugccggaucuguauuuga

SEQ ID NO: 194146 - RNA, 1701 nt, Artificial Sequence
  derived and/or modified sequence opt5 from hemagglutinin__InfluenzaA__AHJ58001
augaucgccuucauugugaucgcuauucuggccgcgaccggcaagagcgacaagaucugcauuggguaccacgcuaacaauuccacaacgaaggucgauaccauccucgagaaaaacguuacagugacccauucuguggaacugcuugagaaucagaaggaagagagauuuuguaaaaucagcaacaaggcuccccuggaccuccgggauugcacacuggaaggauggauucuuggcaauccucgcugugggauccugcucgccgaccaauccuggucuuauauugucgagagaccgaacgcccggaauggaaucugcuaccccggcauucugaacgaggccgaggaacugaaggcucucaucgggagcggagaacgcguggagagauucgagauguuuccuaaauccaccugggccggcguugauacagacucuggcgugagcuccgcguguccccuggggaauggaccuagcuucuaucggaaccuucuguggauuaucaagcucaaaucuuccgaauaccccgucauccgcggcaccuuuaauaacacgggggauaagagcauucuguauuucuggggagugcaccauccuccgguuaccacagagcaggaagcccuuuacggcucugggaauagauaugugcggaugggaaccgaguccaugaacuuugcucgcagccccgaaaucgccgcuagaccugccgucaauggccagcggggccgcauugacuacuucuggucuauccugaaacccggggagacacucaacguggaguccaacggaaaucugauugcgccuugguacgccuauagauuugugaacaaggauagcaagggcgcuaucuuccgguccaaucugcccaucgaaaacugcgacgccaccugucagacgacagagggggucauucgcaccaauaaaacauuucaaaacguuucuccgauguggaucggagaaugcccuaaguacgugaaaagcaagucccucagacuggcuaccggccuucggaaugugccccagauugagaccagagggcuguucggagccaucgccggcuuuauugaaggcggguggacaggaaugaucgauggcugguauggguaccaccaugagaacagccagggaucuggcuaugcugcggaccgcgaguccacgcagaaagccaucgaugggauuaccaauaaggucaacagcaucauugacaaaaugaauacacaauucgaagcugugggccacgaguucucuaaccucgaacggagaaucgacaaucugaacaagcgcauggaggauggauuucuugacguuuggaccuacaaugccgaacugcucgugcugcuggagaacgagcggacacucgaucugcacgacgccaacgucaagaaucuucaugaaaaagugagaagccagcugcgcgauaacgcuaaugaccucggcaacggguguuucgaguuuuggcacaagugcgauaaugaauguauggaguccguuaaaaacggaaccuaugacuacccuaaguaccagacggagucucggcugaauagacagaaaauugaaagcgugaaacuugagaacuucgaugucuaucaaauccuggccauuuacuccacagugucuagcucccucguccuggugggccugaucauggcgauggggcucuggaugugcagcaauggaucuaugcagugccgcaucuguauuuga

SEQ ID NO: 194147 - RNA, 1701 nt, Artificial Sequence
  derived and/or modified sequence opt5 from hemagglutinin__InfluenzaA__AHJ58013
augaucgccuucauugugaucgcuauucuggucaccacaggcaagagcgacaagaucugcauuggguaccacgccaacaauuccacgaccaagguugauacaauccucgagaaaaacgugaccgugacacauucugucgaacugcuugagaaucagaaggaagagagauuuuguaaaaucagcuccaaggcgccccuggaccuccgggauugcucucuggaaggauggauucuuggcaacccucgcugugggauccugcucgcugaccaaagcugguccuauauuguggagagaccgaaugcccggaacggaaucugcuaccccggcacccugaaugagguugaagaacugaaggcccucauugggucuggagaacgcguggagagauucgagauguuuccuaaaagcacaugggcuggcgucgauaccaacuccggcgugagcucugccuguccccugggggaaggaccuuccuucuaucggaaucuucuguggaucauuaagcgcacgaccagcgaguaccccguuaucaaaggcacauauagaaacaccggggacaagucugugcucuacuuuuggggaguccaccauccuccggauacaaccgaacagaaugugcuguauggcuccgggaaccgguacgugcgcaugggaacggagagcaugaauuucgcuagaucucccgaaaucgccgcgcggccugccgucaacggccagcgcggcagaauugacuacuuuugguccauccuuaaacccggggagacacuggauguugagagcaauggaaaccucauugcuccuugguaugccuaccgguucgugaacaaggaauccaagggcgcuaucuuucgcucuaaucugcccauugagaacugcgacgccaccugucagacaaccgaaggggugaucagaaccaauaaaacauuccaaaacgucagcccgcuguggaucggagagugcccuaaguaugugaaauccaagagccuccggcuggcgacgggccuuagaaauguuccccagauugaaacccgcgggcuguuuggagccaucgcuggcuucauugagggcggguggacaggaaugaucgauggcugguacggguaucaccaugagaacucucagggauccggcuacgccgcugacaaagaaagcacccagaaggccauugaugggaucacaaauaaagugaacucuaucauugacaagaugaauacccaauuugaggccgucggccacgaguucagcacgcucgagcggagaaucgacaaccugaauaagcgcauggaagauggauuccuugacguguggacauauaacgcugagcugcucguucugcuggagaaugaacggacccucgaucugcacgacgcgaacgugaaaaaucuucaugagagaguccgcucccagcugcgggauaacgccaacgaccucggcaauggguguuuugaguucuggcacaagugcgauaacgaauguauggagucugugaaaaauggaaccuacaacuacccuaaguaucaggcugaaagcagacugaauaaacagaagauugaguccgucaaacuugaagaguuuggcguguaccaaauccuggccauuuauagcacaguuucuuccagccucgugcuggucgggcugaucauggccaugggacucuggaugugcucuaacggcuccaugcagugccgcauuuguaucuga

SEQ ID NO: 194148 - RNA, 1701 nt, Artificial Sequence
  derived and/or modified sequence opt5 from hemagglutinin__InfluenzaA__AHJ58025
augaucgccuucauugugaucgcuauucuggucaccacaggcgagagcgacaagaucugcauuggguaccacgccaacaauuccacgaccaaaguugauacaauccucgaaaagaacgugaccgugacacauucugucgagcugcuugaaaaucagaaagaggaaagauuuuguaagaucagcaacaaagcgccccuggaccuccgggauugcaccauugagggauggauccugggcaauccucgcugugggauucuucuggcugaccaauccuggucuuauaucguggagagaccgaacgcccggaauggaauuugcuaccccggcacacucaacgaagccgaggaacugaaggcucugaucgggagcggagagggcguugagcgcuucgaaauguuuccuaaguccaccugggccggcguggauacgaauagcggggucagcuccgcuuguccccucggaaacggcccuagcuucuauagaaaucugcuuuggauuaucaaacugaagucuuccgaguaccccgugauccgggggaccuuuaacaauacaggagacaaaagcguucucuauuucuggggcgugcaccauccuccggucaccacagaacagaacgaucuguacgggucuggaaaucgcuaugugagaaugggcaccgaguccaugaacuuugcccggaaccccgaaauugcgcuucgcccugccgugaauggccagagagggcggaucgacuacuucuggagcauucugaagcccggagagacgcucaacgucgagucuaauggcaaccugaucgcuccuugguacgccuaucgcuuuguuaauaaagauuccaagggggcuauuuucagaagcucccugcccaucgaaaacugcgacgccacaugucagaccgcggagggagugauccggacaaauaagaccuuucaaaacgugucuccgcucuggauuggcgaaugcccuaaauacgucaagagcaaaucccugcgccuugccaccgggcugagaaaugugccccagaucgagacacggggacucuucggcgcuauugccggcuuuaucgaagggggauggacgggcaugguugaugggugguauggauaccaccaugagaacagccagggcucuggguaugcugccgacagagaguccacccagaaggccauugauggcaucacaaauaaagugaacagcaucauugacaagaugaauacccaauucgaagcugucgaccacgaguucucuaaccuggaacgccggaucgauaaucuuaacaaaagaauggaggacggauuucuggauguguggacauacaacgcggaacuccugguucugcucgagaaugagcgcacccuggaccuucacgaugccaacgugaagaaucugcaugaaaaggucaaaagccagcuccgggacaacgcuaaugaucugggcaacggguguuucgaguuuuggcacaagugcgacaaugaauguauggaguccgugaaaaacggaacguauaauuacccuaaguaccagaaagagucuagacuuaaccgccagaagauugaaagcgucaagcuggagaauuucgauguguaucaaauccucgccauuuacuccacaguuucuucuucccuggugcuggucggccucaucauggccauggggcuguggaugugcagcaacggaucuaugcagugccggauuuguaucuga

SEQ ID NO: 194149 - RNA, 1701 nt, Artificial Sequence
  derived and/or modified sequence opt5 from hemagglutinin__InfluenzaA__AHJ58037
augaucgccuucauuaucauuaccauccuggugacaacgggcgagagcgacaagauuugcaucggguaccacgcuaacaauuccaccacaaaggucgauaccauccucgaaaagaacguuacagugacccauucuguggagcugcuugaaaaucagaaagaggaaagauuuuguaagauuagcaacaaagcgccccuggaccucaaggagugcacacuggagggauggauccuuggcaauccucaaugugaucugcuccugggggaccaguccuggucuuauauugucgaacggccgaacgcccgcaauggaaucugcuaccccggcacccugaacgagguggaagaacucaaggcucugauugggagcggagagagaguugaacgguucgagauguuuccuaaauccacgugggccggcguggauaccaauucuggcgucacacgcagcugucccuucggguccggaagcucuuuuuauagaaaccuucuguggaucauuaagcacaccacauccagcuacccugugaucaaaggcaccuuccggaauacgggggacaagucuguucucuauuuuuggggagugcaucaccccaucgauacaaccgaacagaacguccuguacggcuccgggaaucgcuaugugagaaugggaacagagagcaugaacuucgcccggucuccugaaauugcugcccgcccgguggucaauggccagagaggccggaucgacuacuuuugguccauucuuaaacccggggagacccugaacaucgagagcaacggaaaucucauugcuccuugguacgccuaucgcuucguuaacaaggauuccaagggcgcgaucuuuagaucuaaucugcccaucgaaaacugcgacgccaccugucaaacaauugagggggugauccggacgaauaaaaccuuccagaacgugagcccucuguggauuggagaaugccccaaguacgucaaauccgagagccuccgccuggcuacaggccuuagaaaugugccgcagaucgaaacccgggggcuguuuggagccauugcuggcuucaucgagggcggguggacaggaaugaucgauggcugguauggguaccaucacgagaacucucagggauccggcuaugccgcggacagagaaagcacccaacgcgccauugaugggaucacgacaaagguuaauucuauuaucgacaaaaugaacacccaguucgaggcugugggccacgaauuuagcaaucucgagcggagaauugacaaccugaauaagcgcauggaagauggauuccuugacgucuggaccuacaacgccgagcugcucgugcugcuggagaaugaacggacacucgaucugcaugacgcuaacguuaaaaaccuucacgagagagugaagucccagcugcgcgauaaugccaacgaccucggcaauggguguuuugaguucuggcauaagugcgauaacgaguguauggagucugucaaaaauggaaccuaugacuacccuaaguaccaggccgaaagccggcugaacaaacaaagaaucgaguccgugaaacuugaaaauuuugaugucuaucagauucuggcuaucuacagcacagugucuuccagccucguucuggugggccugaucauggcgauugggcucuggaugugcucuaacggauccaugcagugccgcaucuguauuuga

SEQ ID NO: 194150 - RNA, 1701 nt, Artificial Sequence
  derived and/or modified sequence opt5 from hemagglutinin__InfluenzaA__AHJ58049
augaucgccuucauugugaucgcuauucuggccgcgaccggcaagagcgacaaaaucugcauuggguaccacgcuaacaauuccacaacgaaggucgauaccauccucgagaaaaacguuacagugacccauucuguggaacugcuugagaaucagaaggaagagagauuuuguaaaaucagcaacaaggcuccccuggaccuccgggauugcacacuggaaggauggauucuuggcaauccucgcugugggauccugcucgccgaccaauccuggucuuauauugucgagagaccgaacgcccggaauggaaucugcuaccccggcauucugaacgaggccgaggaacugaaggcucucaucgggagcggagaacgcguggagagauucgagauguuuccuaaauccaccugggccggcguugauacagacucuggcgugagcuccgcguguccccuggggaauggaccuagcuucuaucggaaccuucuguggauuaucaagcucaaaucuuccgaauaccccgucauccgcggcaccuuuaauaacacgggggauaagagcauucuguauuucuggggagugcaccauccuccgguuaccacagagcaggaagcccuuuacggcucugggaauagauaugugcggaugggaaccgaguccaugaacuuugcucgcacacccgaaaucgccgcuagaccugccgucaauggccagcggggccgcauugacuacuucuggagcauccugaaacccggggagacccucaacguggagucuaacggaaaucugauugcgccuugguacgccuauagauuugugaacaaggauuccaagggcgcuaucuuccggagcaaucugcccaucgaaaacugcgacgccacgugucagacaaccgagggggucauucgcacaaauaaaaccuuucaaaacguuuccccgcucuggaucggagaaugcccuaaguacgugaaaucuaagagccugagacuugcuaccggccugcggaaugugccccagauugagacaagaggacucuucggggccaucgccggcuuuauugaaggcggguggacgggaaugaucgauggcugguauggguaccaccaugagaacucccagggaagcggcuaugcugcggaccgcgagucuacccagaaagccaucgaugggauuacaaauaaggucaacuccaucauugacaaaaugaauacccaauucgaagcugugggccacgaguucagcaaccuggaacggagaaucgacaaucuuaacaagcgcauggaggauggauuucuggacguuuggacauacaaugccgaacuccuggugcugcucgagaacgagcggacccuggaucuucacgacgccaacgucaagaaucugcaugaaaaagugagaucucagcuccgcgauaacgcuaaugaccugggcaacggguguuucgaguuuuggcacaagugcgauaaugaauguauggagagcguuaaaaacggaacguaugacuacccuaaguaccaggccgagucccggcuuaauagacagaaaauugaaucugugaagcuggagaacuucgaugucuaucaaauccucgcgauuuacagcacaguguccagcucucugguccuggugggccucaucauggcuauggggcuguggaugugcuccaauggaagcaugcagugccgcaucuguauuuga

SEQ ID NO: 194151 - RNA, 1701 nt, Artificial Sequence
  derived and/or modified sequence opt5 from hemagglutinin__InfluenzaA__AHJ58061
augaucgccuucauugugaucgcuacccuggucgccacaggcaagagcgacaaaauuugcaucggguaccacgcgaacaauuccacgaccaagguugauacaauucucgagaaaaacgugaccgugacacauucugucgaacugcuugagaaucagaaggaagagagauuuuguaaaaucagcaacaaggcuccccuggaccuccgggauugcacccuggaaggauggauccuuggcaauccucgcugugggauucugcucgccgaccaauccuggucuuauaucguggagagaccgaacgcccggaauggaauuugcuaccccggcacacugaacgaggcugaggaacugaaggcccucaucgggagcggagaacgcguugagagauucgagauguuuccuaaauccaccuggacgggcguggauaccgaaucuggcgucagcuccgcuuguccccuggggaauggaccuagcuucuaucggaaccuucuguggauuaucaagcucaaaucuuccgaguaccccgugauucgcggcacauuuaauaacaccggggacaagagcauccuguauuucuggggaguucaccauccuccggugacaaccgaacagaaugcccuuuacggcucuggggauagauauguccggaugggaacggaguccaugaacuuugcgcgcagccccgaaaucgccgcuagaccugccgugaauggccagcggggccgcauugacuacuucuggucuauccugaaacccggggagacacucaacguggaguccaacggaaaucugauugcuccuugguacgccuauagauuugucaacaaggauagcaagggcgcgaucuuccgguccaaucugcccauugaaaacugcgacgccaccugucagacaaccgaggggguuauccgcaccaauaaaacauuucaaaacgugucuccgcucuggaucggagaaugcccuaaguacgugaaaagcaagucccugagacuugcuacgggccugcggaaugucccccagauugagaccagaggacucuucggggccaucgcuggcuuuauugaaggcggguggacaggaaugaucgauggcugguauggguaccaccaugagaacagccagggaucuggcuaugccgccgacaaagaguccacccagaaggcuauugaugggaucacaaauaaagugaacagcaucauugacaagaugaauacccaauucgaagcgguuggccacgaguucucuaaccuggaacgccggaucgacaaucuuaacaagagaauggaggauggauuucuggacguguggacguacaaugccgaacuccugguccugcucgagaacgagcgcacacuggaucuucacgacgcuaacgugaaaaaucugcaugaaaagguucggagccagcucagagauaacgccaaugaccugggcaacggguguuucgaguuuuggcacaaaugcaauaacgaauguauggaguccgugaagaauggaaccuaugauuacccuaaauaccagaaggagucucgccuuaaccggcagaagauugaaagcgucaaacuggagaauuucgacguguaucaaauccucgccauuuacuccaccgucucuagcucccuggugcugguuggccucauccuggcuauggggcuuuggaugugcagcaacggaucuaugcagugcagaauuuguaucuga

SEQ ID NO: 194152 - RNA, 1701 nt, Artificial Sequence
  derived and/or modified sequence opt5 from hemagglutinin__InfluenzaA__AHJ58084
augaucgccuucauugugaucgcuacccuggucgccacaggcaagagcgacaaaauuugcaucggguaccacgcgaacaauuccacgaccaagguugauacaauucucgagaaaaacgugaccgugacacauucugucgaacugcuugagaaucagaaggaagagagauuuuguaaaaucagcaacaaggcuccccuggaccuccgggauugcacccuggaaggauggauccuuggcaauccucgcugugggauucugcucgccgaccaauccuggucuuauaucguggagagaccgaacgcccggaauggaauuugcuaccccggcacacugaacgaggcugaggaacugaaggcccucaucgggagcggagaacgcguugagagauucgagauguuuccuaaauccaccuggacgggcgugaauaccgaaucuggcgucagcuccgcuuguccccuggggaacggaccuagcuucuaucggaaucuucuguggauuaucaagcucaaaucuuccgaguaccccgugauucgcggcacauuuaacaauaccggggauaagagcauccuguauuucuggggaguucaccauccuccggugacaaccgaacagaacgcccuuuacggcucuggggacagauauguccggaugggaacggaguccaugaauuuugcgcgcagccccgaaaucgccgcuagaccugccgugaacggccagcggggccgcauugauuacuucuggucuauccugaaacccggggagacacucaacguggaguccaauggaaaccugauugcuccuugguacgccuauagauuugucaauaaggacagcaagggcgcgaucuuccgguccaaccugcccauugaaaauugcgaugccaccugucagacaaccgaggggguuauccgcaccaacaaaacauuucaaaaugugucuccgcucuggaucggagaaugcccuaaguacgugaaaagcaagucccugagacuugcuacgggccugcggaacgucccccagauugagaccagaggacucuucggggccaucgcuggcuuuauugaaggcggguggacaggaaugaucgacggcugguauggguaccaccaugagaauagccagggaucuggcuaugccgccgauaaagaguccacccagaaggcuauugacgggaucacaaacaaagugaauagcaucauugauaagaugaacacccaauucgaagcgguuggccacgaguucucuaaucuggaacgccggaucgacaaccuuaauaagagaauggaggacggauuucuggauguguggacguacaacgccgaacuccugguccugcucgagaacgagcgcacacuggaccuucacgaugcuaaugugaaaaaccugcaugaaaagguucggagccagcucagagacaaugccaacgaucugggcaauggguguuucgaguuuuggcacaaaugcaacaaugaauguauggaguccgugaagaacggaaccuaugacuacccuaaauaccagaaggagucucgccuuaaucggcagaagauugaaagcgucaaacuggagaacuucgauguguaucaaauccucgccauuuacuccaccgucucuagcucccuggugcugguuggccucauccuggcuauggggcuuuggaugugcagcaauggaucuaugcagugcagaauuuguaucuga

SEQ ID NO: 194153 - RNA, 1701 nt, Artificial Sequence; identical to SEQ ID NO: 189879
  derived and/or modified sequence opt5 from hemagglutinin__InfluenzaA__AHL80708

SEQ ID NO: 194154 - RNA, 1701 nt, Artificial Sequence
  derived and/or modified sequence opt5 from hemagglutinin__InfluenzaA__AHL80718
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaucagcucuuggccuaaccacgacuccaauaagggagugaccgccgcuuguccccaugccggcgcgaaaucuuuuuauaagaaccugauuuggcucguuaaaaagggcaauagcuacccuaaacuguccaagagcuauaucaacgauaaggggaaagaagugcuuguccuguggggcauucaccaccccuccacaaccgccgaccaacagucucucuaccagaaugcugaugccuacguguucgugggaacaagcagauauuccaagaaauuuaagccugagaucgcuauucggccgaaaguccgcgaccaggaggggagaaugaacuacuauuggacccugguugaacccggagauaagaucacguucgaggccacaggcaaccugguggugccucgguacgcguuugccauggaacgcaaugcugggagcggaauuaucaucucugacaccuccguccaugauugcaacacaaccugucaaacccccaaaggcgccauuaauacaagccucccuuuccagaacauccaccccauuacgaucggcaagugcccgaaguaugugaaaucuaccaagcugagacuugcuacagggcugcggaauguuccuagcauucagucccgcggacucuuuggcgccaucgccggguucaucgagggaggcuggaccgggaugguggacggaugguacggcuaucaucaccagaacgaacaaggcucuggguacgcugcggaccugaaaagcacacagaaugccauugauaagaucaccaacaaagucaauuccgugauugagaagaugaacacgcaguuuacagcuguuggaaaggaguucaaucaccuugagaaaagaaucgagaaccugaauaagaaaguggacgauggcuuccucgacauuuggaccuacaacgccgaacugcugguccuccuggagaaugaacggacccuugauuaucaugacagcaacgugaagaaccuguacgagaaaguccgcucucagcucaagaauaacgccaaggagaucgggaauggauguuuugaguucuaucacaaaugcgauaacacauguauggaauccgugaagaauggcaccuacgacuaucccaaauacagcgaagaggcuaagcugaacagagaagagaucgaugggguuaaacuugagucuacacggauuuaucaaauccuggccauuuacuccacgguggcgagcucccucguccuggugguuucucugggcgcuaucagcuuuuggaugugcuccaauggaucucuccagugccgcauuuguaucuga

SEQ ID NO: 194155 - RNA, 1710 nt, Artificial Sequence
  derived and/or modified sequence opt5 from hemagglutinin__InfluenzaA__AHL80729
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcgagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcacauccagauauagcaaaaaguuuaaaccugagauugcuauccggccgaagguccgcgaucaggaagggagaaugaauuacuauuggacccugguugagcccggagacaaaauuacguucgaagccacaggcaaccugguggugccucgguacgcguuugccauggagcgcaacgcugggucuggaaucauuaucuccgauacccccguccaugacugcaauacaaccugucaaaccccuaagggcgccaucaacacaagccucacgucucugcccuuccagaaugugcacccgauuaccaucggcaaaugcccuaaguauguuaagagcacaaaacuuagacuggcuaccgggcuccggaacgugcccuccauucagucucgcggacuguuuggcgccaucgccggguucauugaaggaggcuggacagggauggucgacggaugguacggcuaucaucaccagaaugagcaaggcagcggguacgcugcggaucuuaaguccacccagaacgccaucgacgagaucacgaauaaagugaacagcguuauugaaaagaugaauacacaguuuaccgcugugggaaaagaguucaaccaccuggaaaagagaaucgagaaucucaacaagaaagucgaugacggcuuccuggauauuuggaccuacaaugccgaacugcucgugcugcuugagaacgagcggacacuggacuaucaugauucuaaugucaagaaccucuacgaaaaagugcgcucccagcugaagaacaaugccaaagagaucgggaacggauguuuugaguucuaucacaagugcgacaauaccuguauggaaagcguuaagaacggcacauacgauuauccuaaauacucugaagaggcuaaacuuaauagagaggaaauugacggggugaagcuggaguccacgcggaucuaucaaauccucgccauuuacagcaccgucgcguccucucuggugcugguugugagccucggcgcuaucuccuuuuggaugugcucuaacggaagccugcagugccgcauuuguaucuga

SEQ ID NO: 194156 - RNA, 1701 nt, Artificial Sequence
  derived and/or modified sequence opt5 from hemagglutinin__InfluenzaA__AHL80740
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaacuccugucuacagccagcuccuggucuuacaucguggagaccagcuccucugacaacggcacgugcuauccgggggauuuuauuaauuacgaagaacuucgggagcagcugagcuccgucagcucuuucgaacgcuuugagaucuuccccaagaccuccagcuggccuaaccacgacucuaauaagggagugacagccgcuuguccccaugccggcgcgaaauccuuuuauaagaaccucaucuggcugguuaaaaagggcaauagcuacccuaaacuuucuaaguccuauauuaacgauaaggggaaagaagugcugguccucuggggagugcaccaccccagcaccuccgccgaccaacagucucuguaccagaaugcugaugccuacguguucgucggcacaagcagauauuccaagaaauuuaagccugagaucgcuauucggccgaaaguucgcgaccaggaggggagaaugaacuacuauuggacccugguggaacccggagauaagaucacguucgaggccacaggcaaccucguggucccucgguacgcguuugccauggaacgcaaugcugggagcggaauuaucauuucugacacccccgugcaugauugcaacacaaccugucaaaccccuaaaggcgccaucaauacaucccugcccuuccagaacauccacccgauuacgaucggcaagugcccuaaguauguuaaaagcaccaaacuuagacuggcuacagggcuccggaaugugcccucuauucagagccgcggacuguuuggcgccaucgccggguucauugagggaggcuggaccgggauggucgacggaugguacggcuaucaucaccagaacgaacaaggcuccggguacgcugcggaccuuaaaucuacacagaaugccaucgauaagaucaccaacaaagugaauagcguuauugagaagaugaacacgcaguuuacagcugugggaaaggaguucaaucaccuggaaaagagaaucgagaaccucaauaagaaagucgacgauggcuuccuggacauuuggaccuacaacgccgaacugcucgugcugcuugagaaugaacggacccuggauuaucaugacuccaacgucaagaaccucuacgagaaagugcgcagccagcugaagaauaacgccaaggagaucgggaauggauguuuugaguucuaucacaaaugcgauaacacauguauggagucuguuaagaauggcaccuacgacuauccuaaauacuccgaagaggcuaaacuuaacagagaaaagauugauggggugaagcuggagagcacacggaucuaucaaauccucgccauuuacucuacggucgcguccagccuggugcugguugugucccucggcgcuaucucuuuuuggaugugcagcaauggaucccugcagugccgcauuuguaucuga

SEQ ID NO: 194157 - RNA, 1701 nt, Artificial Sequence
  derived and/or modified sequence opt5 from hemagglutinin__InfluenzaA__AHL80751
augaaggccauccuggugguccuccuguacaccuucgcuacagccaacgcggacacgcuuugcauuggcuaucacgcuaauaacagcaccgauacaguugacaccauccuggagaaaaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaauucuuguucuguggggaauccaccaccccuccaccucugccgaucaacagagccucuaccagaacgcugacgccuacguguucgucggcacauccagauauagcaagaaauuuaagccugagauugcuauccggccgaaagugcgcgaucaggaggggagaaugaauuacuauuggacccugguggaacccggagacaagauuacguucgaggccacaggcaaccuggucguuccucgguacgcguuugccauggaaaagaacgcugggucuggaaucaucauuuccgauacccccgugcaugacugcaauacaaccugucaaaccccuaagggcgccaucaacacaagccuccccuuccagaauauucacccgaucacgauuggcaagugcccuaaauaugugaagucuaccaaacugcgccuugcuacagggcugagaaacguccccagcauccagucccggggacucuuuggcgccaucgccggguucauugagggaggcuggaccgggaugguggacggaugguacggcuaucaucaccagaaugaacaaggcucuggguacgcugcggaucugaaaagcacacagaacgccaucgacgagauuaccaauaaaguuaacuccgugaucgagaagaugaauacgcaguuuacagcugucggaaaggaguucaaccaccuugagaaacgcauugaaaaucugaacaagaaaguggaugacggcuuccucgauaucuggaccuacaaugccgagcugcugguucuccuggaaaacgagagaacccuugacuaucaugauagcaaugugaagaaccuguacgagaaaguccggucucagcucaagaacaaugccaaggaaguggggaacggauguuuugaguucuaucacaaaugcgacaauacauguauggaauccgucaagaacggcaccuacgauuauccuaaauacagcgaggaagcuaagcugaaucgcgaggagaucgacggggugaaacuugaaucuacaagaauuuaucaaauccuggccauuuacuccacgguugcgagcucccucgugcuggucgugucucugggcgcuaucagcuuuuggaugugcuccaacggaucucuccagugccggauuuguaucuga

SEQ ID NO: 194158 - RNA, 1701 nt, Artificial Sequence
  derived and/or modified sequence opt5 from hemagglutinin__InfluenzaA__AHL80762
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggauucugguugaacccggagauaagaucaccuucgaggccacgggcaaccugguggugccucgguacgcguuugccauggaacgcaaugcugggucuggaauuaucaucuccgacacacccguccaugauugcaacaccacaugucaaaccccuaaaggcgccauuaauaccagccuccccuuccagaacauccacccgauuacaaucggcaagugcccuaaguaugugaaaucuacgaagcugagacuugcuaccgggcugcggaauguucccagcauucagucccgcggacucuuuggcgccaucgccggguucaucgagggaggcuggacagggaugguggacggaugguacggcuaucaucaccagaacgaacaaggcucuggguacgcugcggaccugaaaagcacccagaaugccauugauaagaucacaaacaaagucaauuccgugauugagaagaugaacacccaguuuacggcuguuggaaaggaguucaaucaccuugagaaaagaaucgagaaccugaauaagaaaguggacgauggcuuccucgacauuuggacauacaacgccgaacugcugguccuccuggagaaugaacggacccuugauuaucaugacagcaacgugaagaaccuguacgagaaaguccgcucucagcucaaggauaaugccaaggagaucgggaacggauguuuugaguucuaucacaaaugcgacaauaccuguauggaauccgugaagaacggcacauacgauuauccuaaauacagcgaagaggcuaagcugaauagagaagagaucgacgggguuaaacuugagucuacccggauuuaucaaauccuggccauuuacuccacaguggcgagcucccucguccuggugguuucucugggcgcuaucagcuuuuggaugugcuccaacggaucucuccagugccgcauuuguaucuga

SEQ ID NO: 194159 - RNA, 1701 nt, Artificial Sequence
  derived and/or modified sequence opt5 from hemagglutinin__InfluenzaA__AHL80784
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggaaucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucugccgaucaacagagccucuaccagaacgcugacgccuacgucuucgugggaacauccagauauagcaagaaauuuaagccugagaucgcuauucggccgaaagugcgcgaucaggaggggagaaugaauuacuauuggacccuggucgaacccggagacaagaucacguucgaggccacaggcaaccugguugugccucgguacgcguuugccauggaacgcaacgcugggucuggaauuaucaucuccgauacccccgugcaugacugcaauacaaccugucaaaccccuaaaggcgccauuaacacaagccuccccuuccagaauauccacccgauuacgaucggcaagugcccuaaguaugucaaaucuaccaagcugagacuugcuacagggcugcggaacgugcccagcauucagucccgcggacucuuuggcgccaucgccggguucaucgagggaggcuggaccgggaugguugacggaugguacggcuaucaucaccagaaugaacaaggcucuggguacgcugcggaucugaaaagcacacagaacgccauugacaagaucaccaauaaagugaacuccgucauugagaagaugaauacgcaguuuacagcugugggaaaggaguucaaccaccuugagaaaagaaucgagaaucugaacaagaaaguugaugacggcuuccucgauauuuggaccuacaaugccgaacugcuggugcuccuggagaacgaacggacccuugacuaucaugauagcaaugucaagaaccuguacgagaaagugcgcucucagcucaagaacaaugccaaggagaucgggaacggauguuuugaguucuaucacaaaugcgacaauacauguauggaauccgucaagaacggcaccuacgauuauccuaaauacagcgaagaggcuaagcugaauagagaagagaucgacggggugaaacuugagucuacacggauuuaucaaauccuggccauuuacuccacgguugcgagcucccucgugcuggucgugucucugggcgcuaucagcuuuuggaugugcuccaacggaucucuccagugccgcauuuguaucuga

SEQ ID NO: 194160 - RNA, 1701 nt, Artificial Sequence; identical to SEQ ID NO: 186857
  derived and/or modified sequence opt5 from hemagglutinin__InfluenzaA__AHL80795

SEQ ID NO: 194161 - RNA, 1701 nt, Artificial Sequence
  derived and/or modified sequence opt5 from hemagglutinin__InfluenzaA__AHL80817
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaacugcaauaucgccggguggauucugggaaacccugagugugaaucucucagcacagccuccucuuggagcuacaucguggaggccuccucuagcgacaaugggaccugcuauccgggcgauuuuauugacuacgaagaacugcgggagcagcuuuccagcgucucuuccuucgaacgcuuugagaucuuccccaaaacgagcucuuggccuaaccacgauuccaauaagggagugaccgcugccuguccccaugcgggcgccaagagcuuuuauaaaaaccugaucuggcucguuaagaaaggcaauucuuacccuaagcuguccaaaagcuauauuaacgacaaggggaaggaagugcuuguccuguggggaauccaccaccccuccacaucugcugaucaacagagccucuaccagaaugccgacgcuuacguguucgugggcaccuccagauauagcaaaaaguuuaaaccugagauugccauccggccgaagguccgcgaucaggaggggagaaugaacuacuauuggacacugguugaacccggagacaaaauuaccuucgaggcgacgggcaaccugguggugccucgguacgccuuugcuauggaacgcaaugccgggucuggaaucauuaucuccgauacacccguccaugacugcaacaccacaugucaaaccccuaagggcgcuaucaauaccagccuccccuuccagaacauucacccgaucacaauuggcaaaugcccuaaguaugugaagucuacgaaacugagacuugccaccgggcugcggaauguucccagcauccagucccgcggacucuuuggcgccauugcuggguucaucgagggaggcuggacagggaugguggacggaugguacggcuaucaucaccagaacgaacaaggcucuggguacgcggccgaucuuaagagcacccagaaugcuaucgacaaaauuacaaacaaggucaauuccgugaucgagaaaaugaacacccaguuuacggccguuggaaaggaguucaaucaccuugaaaagagaauugagaaccugaauaaaaagguggaugacggcuuccucgauaucuggacauacaacgccgaacugcugguccuccuggagaaugaacggacccuugacuaucaugauagcaacgugaaaaaccuguacgagaagguccgcucucagcucaaaaauaacgcuaaggagauugggaauggauguuuugaguucuaucacaagugcgacaacaccuguauggaguccgugaaaaauggcacauacgauuauccuaaguacagcgaagaggccaaacugaacagagaagagaucgacgggguuaagcuggagucuacccggaucuaucaaauucuggcgaucuacuccacaguggcuagcucccucguccuggugguuucucugggcgccauuagcuuuuggaugugcuccaauggaucucuccagugccgcaucuguauuuga

SEQ ID NO: 194162 - RNA, 1701 nt, Artificial Sequence; identical to SEQ ID NO: 194161
  derived and/or modified sequence opt5 from hemagglutinin__InfluenzaA__AHL80828

SEQ ID NO: 194163 - RNA, 1701 nt, Artificial Sequence
  derived and/or modified sequence opt5 from hemagglutinin__InfluenzaA__AHL80839
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggaaucacagccgcuuguccccaugccggcgcgaaaucuuuuuauaagaaucugauuuggcucgugaaaaagggcaacagcuacccuaaacuguccagaagcuauaucaaugacaaggggaaggaaguucuugugcuguggggcauucaccaccccuccaccucugccgaucaacagagccucuaccagaacgcugacgccuacgucuucgugggaacaucccgguauagcaaaaaguuuaaaccugagaucgcuauucgcccgaaggugagagaucaggaggggcggaugaauuacuauuggacccuggucgaacccggagacaaaaucacguucgaggccacaggcaaccugguugugccucgcuacgcguuugccauggaaagaaacgcugggucuggaauuaucaucuccgauacccccgugcaugacugcaauacaaccugucaaaccccuaagggcgccauuaacacaagccuccccuuccagaauauccacccgauuacgaucggcaaaugcccuaaguaugucaagucuaccaaacugcggcuugcuacagggcugcgcaacgugcccagcauucaguccagaggacucuuuggcgccaucgccggguucaucgagggaggcuggaccgggaugguugacggaugguacggcuaucaucaccagaaugaacaaggcucuggguacgcugcggaucuuaagagcacacagaacgccauugacaaaaucaccaauaaggugaacuccgucauugagaaaaugaauacgcaguuuacagcugugggaaaggaguucaaccaccuugaaaagcggaucgagaaucugaacaaaaagguugaugacggcuuccucgauauuuggaccuacaaugccgaacugcuggugcuccuggagaacgaacgcacccuugacuaucaugauagcaaugucaaaaaccuguacgagaaggugagaucucagcucaaaaacaaugccaaggagaucgggaacggauguuuugaguucuaucacaagugcgacaauacauguauggaguccgucaaaaacggcaccuacgauuauccuaaguacagcgaagaggcuaaacugaaucgggaagagaucgacggggugaagcuggagucuacacgcauuuaucaaauccuggccauuuacuccacgguugcgagcucccucgugcuggucgugucucugggcgcuaucagcuuuuggaugugcuccaacggaucucuccagugcagaauuuguaucuga

SEQ ID NO: 194164 - RNA, 1701 nt, Artificial Sequence
  derived and/or modified sequence opt5 from hemagglutinin__InfluenzaA__AHL80861
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacaagauuaccaauaaagucaacuccgugaucgagaagaugaauacgcaguuuacagcuguuggaaaggaguucaaccaccuugagaaaagaauuggcaaucugaacaagaaaguggaugacggguuccucgauaucuggaccuacaaugccgagcugcugguccuccuggaaaacgagcggacccuugacuaucaugauagcaaugugaagaaccuguacgaaaaaguccgcucucagcucaagaacaaugccaaggagauuggaaacggcuguuuugaguucuaucacaaaugcgacaauacauguauggaauccgugaagaacgggaccuacgauuauccuaaauacagcgaggaagcuaagcugaauagagaggaaaucgacggcguuaaacuugagucuacacggaucuaucaaauucuggccaucuacuccacgguggcgagcucccucguccuggugguuucucugggagcuauuagcuuuuggaugugcuccaacggcucucuccagugccgcaucuguauuuga

SEQ ID NO: 194165 - RNA, 1701 nt, Artificial Sequence
  derived and/or modified sequence opt5 from hemagglutinin__InfluenzaA__AHL80872
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccaacgccgaucaacagucucucuaccagaaugcugacgccuacguguucgugggcacaagcagauauuccaagaaauuuaagccugagauugcuauccggccgaaaguccgcgaucaggaggggagaaugaacuacuauuggacccugguugaacccggagacaagauuacguucgaggccacaggcaaccugguggugccucgguacgcguuugccauggaacgcaaugcugggagcggaaucauuaucucugauacccccguccaugacugcaacacaaccugucaaaccccuaaaggcgccaucaauacaucccuccccuuccagaacauucacccgaucacgauuggcaagugcccuaaguaugugaaaagcaccaagcugagacuugcuacagggcugcggaauguucccucuauccagagccgcggacucuuuggcgccauugccggguucaucgagggaggcuggaccgggaugguggacggaugguacggcuaucaucaccagaacgaacaaggcuccggguacgcugcggaucugaaaucuacacagaaugccaucgacaagauuaccaacaaagucaauagcgugaucgagaagaugaacacgcaguuuacagcuguuggaaaggaguucaaucaccuugagaaaagaauugagaaccugaauaagaaaguggaugacggcuuccucgauaucuggaccuacaacgccgaacugcugguccuccuggagaaugaacggacccuugacuaucaugauuccaacgugaagaaccuguacgagaaaguccgcagccagcucaagaauaacgccaaggagauugggaauggauguuuugaguucuaucacaaaugcgacaacacauguauggaaucugugaagaauggcaccuacgauuauccuaaauacuccgaagaggcuaagcugaacagagaagagaucgacgggguuaaacuugagagcacacggaucuaucaaauucuggccaucuacucuacgguggcguccagccucguccuggugguuucccugggcgcuauuucuuuuuggaugugcagcaauggaucccuccagugccgcaucuguauuuga

SEQ ID NO: 194166 - RNA, 1701 nt, Artificial Sequence; identical to SEQ ID NO: 186857
  derived and/or modified sequence opt5 from hemagglutinin__InfluenzaA__AHL80883

SEQ ID NO: 194167 - RNA, 1701 nt, Artificial Sequence; identical to SEQ ID NO: 186857
  derived and/or modified sequence opt5 from hemagglutinin__InfluenzaA__AHL80894

SEQ ID NO: 194168 - RNA, 1701 nt, Artificial Sequence; identical to SEQ ID NO: 186857
  derived and/or modified sequence opt5 from hemagglutinin__InfluenzaA__AHL80905

SEQ ID NO: 194169 - RNA, 1701 nt, Artificial Sequence; identical to SEQ ID NO: 189478
  derived and/or modified sequence opt5 from hemagglutinin__InfluenzaA__AHL80916

SEQ ID NO: 194170 - RNA, 1701 nt, Artificial Sequence; identical to SEQ ID NO: 189879
  derived and/or modified sequence opt5 from hemagglutinin__InfluenzaA__AHL80927

SEQ ID NO: 194171 - RNA, 1701 nt, Artificial Sequence; identical to SEQ ID NO: 189879
  derived and/or modified sequence opt5 from hemagglutinin__InfluenzaA__AHL80946

SEQ ID NO: 194172 - RNA, 1701 nt, Artificial Sequence
  derived and/or modified sequence opt5 from hemagglutinin__InfluenzaA__AHL80958
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaucagcucuuggccuaaccacgacuccaauaagggagugaccgccgcuuguccccaugccggcgcgaaaucuuuuuauaagaaccugauuuggcucguuaaaaagggcaauagcuacccuaaacuguccaagagcuauaucaacgauaaggggaaagaagugcuuguccuguggggcauucaccaccccuccacaaccgccgaccaacagucucucuaccagaaugcugaugccuacguguucgugggaacaagcagauauuccaagaaauuuaagccugagaucgcuauucggccgaaaguccgcgaccaggaggggagaaugaacuacuauuggacccugguugaacccggagauaagaucacguucgaggccacaggcaaccugguggugccucgguacgcguuugccauggaacgcaaugcugggagcggaauuaucaucucugacaccuccguccaugauugcaacacaaccugucaaacccccaaaggcgccauuaauacaagccucccuuuccagaacauccaccccauuacgaucggcaagugcccgaaguaugugaaaucuaccaagcugagacuugcuacagggcugcggaauguuccuagcauucagucccgcggacucuuuggcgccaucgccggguucaucgagggaggcuggaccgggaugguggacggaugguacggcuaucaucaccagaacgaacaaggcucuggguacgcugcggaccugaaaagcacacagaaugccauugauaagaucaccaacaaagucaauuccgugauugagaagaugaacacgcaguuuacagcuguuggaaaggaguucaaucaccuugagaaaagaaucgagaaccugaauaagaaaguggacgauggcuuccucgacauuuggaccuacaacgccgaacugcugguccuccuggagaaugaacggacccuugauuaucaugacagcaacgugaagaaccuguacgagaaaguccgcaaucagcucaagaacaaugccaaggagaucgggaacggauguuuugaguucuaucacaaaugcgauaauacauguauggaaucugugaagaacggcaccuacgacuaucccaaauacuccgaagaggcuaagcugaauagagaagagaucgaugggguuaaacuugagagcacacggauuuaucaaauccuggccauuuacucuacgguggcguccagccucguccuggugguuucccugggcgcuaucucuuuuuggaugugcagcaacggaucccuccagugccgcauuuguaucuga

SEQ ID NO: 194173 - RNA, 1701 nt, Artificial Sequence
  derived and/or modified sequence opt5 from hemagglutinin__InfluenzaA__AHL81001
augaagaccaucauugcccugagcuacauccucugccugauuuucgcucagaaacuucccggcaacgacaauuccacagccacgcugugucucgggcaccaugcggugccuaacggaaccaucgucaagacaauuaccaaugaucaaaucgagguuacaaacgcuaccgaacuggugcagucuagcuccacaggcgagaucugcaauucuccgcaccagauucuugacggggaaaacuguacccugaucgaugcccuccugggagacccccagugcgauggcuuucaaaauaaaaagugggaccuguucguggagagaagcaaagcccauuccaacuguuauccuuacgauguccccgacuaugcuucucuccggagccugguggccuccagcgggacgcuugaauuuaauaacgagucuuucaauuggaccggaguuacacagaacggcaccuccagcgcuugcauucgcagaucuaauaacuccuuuuucagccggcugaauuggcucacacaccugaacuuuaaguacccugcccuuaacgugaccaugcccaauaacgagcaguucgauaagcuguauaucuggggcguccaucacccugggacggacaaagaucagauuuuucucuacgcgcaagccgcuggacgcaucacagugucuaccaagagaucccagcaggccguuauuccgaauaucggcagccggccccgcgugagaaacaucccuucccgggucucuauuuauuggacaaucgugaaacccggggacauucugcugaucaauagcaccggaaaccucauugcuccucgcggcuacuucaagaucagauccgggaaaagcucuaucaugcgguccgaugcccccauuggaaaguguaauagcgcgugcaucaccccgaacggcucuauuccuaaugacaagcccuuucagaacgugaaucgcaucacauacggcgccuguccuagauaugucaaacaaaacacgcugaaacuugcuaccgggaugcggaauguucccgaaaaacagacacgcggaauuuucggcgccaucgcuggguuuaucgagaacggaugggaaggcaugguggacgggugguacggauucagacaccagaauagcgagggccggggccaagccgccgaucugaaguccacccaggcugcgauugaccagaucaacgggaaacucaacagacugauuggaaagacaaaugagaaauuccaucagaucgaaaaggaguuuucugaaguggagggccgcauucaagaucuugaaaaguaugucgaggacaccaaaaucgaucuguggagcuacaacgccgagcuccugguggcucuggaaaaucagcacacgauugaccucacagauuccgagaugaacaagcuguucgaaaagaccaagaaacagcuucgggagaaugccgaagacauggggaacggaugcuuuaagaucuaucauaagugugauaaugccugcaucggcagcauuagaaacgggaccuacgaccacgauguuuaucgcgacgaggcucugaauaaccgguuccagaucaaaggcguggagcucaagucuggauacaaagacuggauucuguggaucuccuuugccauuagcugcuuccuucugugugucgcgcuccugggcuuuaucaugugggcuugccaaaaggggaauaucagauguaacauuugcaucuga

SEQ ID NO: 194174 - RNA, 1701 nt, Artificial Sequence; identical to SEQ ID NO: 189879
  derived and/or modified sequence opt5 from hemagglutinin__InfluenzaA__AHL81013

SEQ ID NO: 194175 - RNA, 1701 nt, Artificial Sequence; identical to SEQ ID NO: 189879
  derived and/or modified sequence opt5 from hemagglutinin__InfluenzaA__AHL81025

SEQ ID NO: 194176 - RNA, 1701 nt, Artificial Sequence; identical to SEQ ID NO: 189879
  derived and/or modified sequence opt5 from hemagglutinin__InfluenzaA__AHL81037

SEQ ID NO: 194177 - RNA, 1701 nt, Artificial Sequence; identical to SEQ ID NO: 189879
  derived and/or modified sequence opt5 from hemagglutinin__InfluenzaA__AHL81049

SEQ ID NO: 194178 - RNA, 1701 nt, Artificial Sequence; identical to SEQ ID NO: 194172
  derived and/or modified sequence opt5 from hemagglutinin__InfluenzaA__AHL81061

SEQ ID NO: 194179 - RNA, 1701 nt, Artificial Sequence; identical to SEQ ID NO: 194172
  derived and/or modified sequence opt5 from hemagglutinin__InfluenzaA__AHL81072

SEQ ID NO: 194180 - RNA, 1701 nt, Artificial Sequence; identical to SEQ ID NO: 191385
  derived and/or modified sequence opt5 from hemagglutinin__InfluenzaA__AHL81083

SEQ ID NO: 194181 - RNA, 1701 nt, Artificial Sequence; identical to SEQ ID NO: 189879
  derived and/or modified sequence opt5 from hemagglutinin__InfluenzaA__AHL81095

SEQ ID NO: 194182 - RNA, 1701 nt, Artificial Sequence
  derived and/or modified sequence opt5 from hemagglutinin__InfluenzaA__AHL81118
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccaacagcuggccuaaucacgacucuaacaagggagugacagccgcuuguccccaugccggcgcgaaauccuuuuauaagaaucugaucuggcucguuaaaaagggcaacagcuacccuaaacugucuaaguccuauauuaaugauaaggggaaagaagugcuuguccuguggggaauccaccaccccagcaccacagccgaccaacagucccucuaccagaacgcugaugccuacguguucgugggcaccucuagauauagcaagaaauuuaagccugagauugcuauccggccgaaaguccgcgaccaggaggggagaaugaacuacuauuggacgcugguugaacccggagauaagauuacauucgaggccaccggcaaucugguggugccucgguacgcguuugccauggaacgcaacgcuggguccggaaucauuaucagcgacacacccguccaugauugcaauaccaccugucaaacaccuaaaggcgccaucaacacgucucuccccuuccagaauauucacccgaucaccauuggcaagugcccuaaguaugugaaauccacaaagcugagacuugcuaccgggcugcggaacguucccagcauccagucucgcggacucuuuggcgccauugccggguucaucgagggaggcuggacagggaugguggacggaugguacggcuaucaucaccagaaugaacaaggcagcggguacgcugcggaccugaaauccacccagaacgccaucgauaagauuacgaauaaagucaacucugugaucgagaagaugaauacacaguuuaccgcuguuggaaaggaguucaaccaccuugagaaaagaauugagaaucugaacaagaaaguggacgauggcuuccucgacaucuggaccuacaaugccgaacugcugguccuccuggagaacgaacggacacuugauuaucaugacagcaacgugaagaaucuguacgagaaaguccgcaaccagcucaagaauaacgccaaggagauugggaauggauguuuugaguucuaucacaaaugcgauaacaccuguauggaauccgugaagaauggcacauacgacuauccuaaauacagcgaagaggcuaagcugaacagagaagagaucgaugggguuaaacuugagucuacgcggaucuaucaaauucuggccaucuacuccaccguggcgagcucucucguccuggugguuucccugggcgcuauuagcuuuuggaugugcuccaauggaucucuccagugccgcaucuguauuuga

SEQ ID NO: 194183 - RNA, 1701 nt, Artificial Sequence; identical to SEQ ID NO: 189879
  derived and/or modified sequence opt5 from hemagglutinin__InfluenzaA__AHL81129

SEQ ID NO: 194184 - RNA, 1701 nt, Artificial Sequence; identical to SEQ ID NO: 189879
  derived and/or modified sequence opt5 from hemagglutinin__InfluenzaA__AHL81141

SEQ ID NO: 194185 - RNA, 1701 nt, Artificial Sequence; identical to SEQ ID NO: 189879
  derived and/or modified sequence opt5 from hemagglutinin__InfluenzaA__AHL81153

SEQ ID NO: 194186 - RNA, 1701 nt, Artificial Sequence
  derived and/or modified sequence opt5 from hemagglutinin__InfluenzaA__AHL81165
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccgccggcgagaucugcgacucuccgcaccagauccuugauggggaaaauuguacacugauugacgcccuccugggagauccccagugcgacggcuuucaaaacaaaaagugggaucuguucgucgagagaagccgggcuuauuccaauuguuacccuuaugacgugcccgauuacgccucucuccgcagccugguugcuuccagcgggacccuugaauuuaacaaugagucuuucaacuggacgggagugacccagaauggcacauccagcgccugcaucagacggucuaacaauuccuuuuucagccgccugaacuggcucacccaucugaauuuuaaauauccugcgcuuaacgucacaaugcccaacaaugagcaguucgacaagcuguacauuuggggcgugcaccauccugggaccgauaaggaccagaucuuucucuaugcccaggcuucuggaagaauuacgguuuccacaaaacggagccagcaggccgugaucccgaacauuggcucccgccccagaguccggaauaucccuucucgcaucagcauuuacuggaccaucgugaagcccggggauauucugcugaucaacuccacaggaaaucucauugcuccuagaggcuacuucaaaauccggagcgggaagucuuccaucaugcgcagcgacgcccccauuggaaaauguaacucugaaugcaucaccccgaauggcagcauuccuaacgacaagcccuuucagaaugugaacagaaucaccuauggcgcguguccucgguacgucaagcaauccacacugaaacuugccacggggaugcgcaauguucccgagaagcagaccagaggaauuuucggcgcuaucgccggguuuaucgaaaacggaugggagggcaugauggaugggugguauggauuccggcaccaaaauucugagggcagaggccaagcugccgaccugaaaagcacacaggccgcuauugaucagaucaacgggaagcucaaucgccugauuggaaaaaccaacgaaaaguuccaccagaucgagaaagaauuuuccgagguggaaggccggauucaagaccuugagaaguacguggaggauacaaagaucgaccuguggagcuauaacgcggaacuccuggucgcccuggagaaucagcauaccauugaucucacggacucugaaaugaacaaacuguucgagaagaccaaaaagcagcuuagagaaaaugcugaggauauggggaacggaugcuuuaaaaucuaccacaagugugacaaugccugcaucggcuccauucgcaacgggacauaugaucaugacguguaccgggacgaggcccugaauaacagauuccagaucaagggcguugaacucaaaagcggauacaaggauuggauucuguggaucucuuuugcuauuuccugcuuccuucuguguguggcccuccugggcuuuaucaugugggcgugccaaaaagggaauauccgcuguaacauuugcaucuga

SEQ ID NO: 194187 - RNA, 1701 nt, Artificial Sequence; identical to SEQ ID NO: 194186
  derived and/or modified sequence opt5 from hemagglutinin__InfluenzaA__AHL81177

SEQ ID NO: 194188 - RNA, 1701 nt, Artificial Sequence; identical to SEQ ID NO: 194173
  derived and/or modified sequence opt5 from hemagglutinin__InfluenzaA__AHL81189

SEQ ID NO: 194189 - RNA, 1701 nt, Artificial Sequence
  derived and/or modified sequence opt5 from hemagglutinin__InfluenzaA__AHL81212
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaagaaugagucuuucaacuggaccggagugacacagaauggcaccuccagcgcuugcauccgcagaucuaacaauuccuuuuucagccggcugaacuggcucacacaccugaauuuuaaguacccugcccuuaacgucaccaugcccaacaaugagcaguucgauaaacuguauauuuggggcgugcaucacccugggacggacaaggaucagaucuuucucuacgcgcaagccgcuggacgcauuacaguuucuaccaaaagaucccagcaggccgugaucccgaacauuggcagccggccccgcgucagaaauaucccuucccgggugucuaucuauuggacaauugugaagcccggggacauccugcugauuaacagcaccggaaaucucaucgcuccucgcggcuacuucaaaauuagauccggaaagagcucuaucaugcgguccgaugcccccaucgggaaguguaacagcgcgugcauuaccccgaauggcucuaucccuaacgacaaacccuuucagaaugucaaccgcauuacauacggcgccuguccuagauauguuaagcaaaauacgcugaaacuugcuaccgggaugcggaacgugcccgaaaagcagacacgcggaaucuucggcgccauugcuggguuuaucgagaauggaugggaaggcaugguggacgggugguacggauucagacaccagaacagcgagggccggggccaagccgccgaucugaaauccacccaggcugcgaucgaccagauuaaugggaagcucaacagacugaucggaaaaacaaacgagaaguuccaucagauugaaaaggaguuuucugaagucgagggccgcauccaagaucuugaaaaauauguggaggacaccaagauugaucuguggagcuacaaugccgagcuccugguugcucuggaaaaccagcacacgaucgaccucacagauuccgagaugaauaaacuguucgaaaagaccaaaaagcagcuucgggagaacgccgaagacauggggaauggaugcuuuaagauuuaucauaaaugugauaacgccugcaucggcagcaucagaaaugggaccuacgaccacgauguguaucgcgacgaggcucugaacaaucgguuccagauuaagggcgucgagcucaaaucuggauacaaggacuggauccuguggauuuccuuugccaucagcugcuuccuucuguguguggcgcuccugggcuuuauuaugugggcuugccaaaaagggaacaucagauguaauaucugcauuuga

SEQ ID NO: 194190 - RNA, 1701 nt, Artificial Sequence
  derived and/or modified sequence opt5 from hemagglutinin__InfluenzaA__AHL81224
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccacagccgaucaacagucccucuaccagaacgcugacaccuacguguucguggggacgucuagauauagcaagaaauuuaagccugagauugccauccggccgaaaguccgcgaucaggagggaagaaugaauuacuauuggacacugguugaacccggcgacaagauuaccuucgaggcuacagggaaccugguggugccucgguacgccuuugcgauggaacgcaccgccggauccggcaucauuaucagcgauacccccguccaugacugcaacacaacgugucaaaccccuaaaggcgcuaucaauacaucucuccccuuccagaacauucacccgaucaccauugggaagugcccuaaguaugugaaauccacaaagcugagacuugccaccggacugcggaauguucccagcauccagucucgcggccucuuuggggcuauugccggauucaucgagggcggguggacgggaaugguggacggcugguacggcuaucaucaccagaacgaacaagggagcggauacgccgcugaucugaaauccacacagaaugcgaucgacaagauuaccaacaaagucaauucugugaucgagaagaugaacacccaguuuacagccguuggcaaggaguucaaucaccuugagaaaagaauugagaaccugaauaagaaaguggaugacggguuccucgauaucuggaccuacaacgcugaacugcugguccuccuggagaaugaacggacacuugacuaucaugauagcaacgugaagaaucuguacgagaaaguccgcaaccagcucaagaacaaugccaaggagauuggaaacggcuguuuugaguucuaucacaaaugcgacaauacguguauggaauccgugaagaacgggaccuacgauuauccuaaauacagcgaagaggccaagcugaauagagaagagaucgacggcguuaaacuugagucuacacggaucuaucaaauucuggcuaucuacuccaccguggccagcucucucguccuggugguuucccugggagcgauuagcuuuuggaugugcuccaacggcucucuccagugccgcaucuguauuuga

SEQ ID NO: 194191 - RNA, 1701 nt, Artificial Sequence; identical to SEQ ID NO: 189879
  derived and/or modified sequence opt5 from hemagglutinin__InfluenzaA__AHL81235

SEQ ID NO: 194192 - RNA, 1701 nt, Artificial Sequence; identical to SEQ ID NO: 189879
  derived and/or modified sequence opt5 from hemagglutinin__InfluenzaA__AHL81247

SEQ ID NO: 194193 - RNA, 1701 nt, Artificial Sequence; identical to SEQ ID NO: 189879
  derived and/or modified sequence opt5 from hemagglutinin__InfluenzaA__AHL81259

SEQ ID NO: 194194 - RNA, 1701 nt, Artificial Sequence; identical to SEQ ID NO: 189879
  derived and/or modified sequence opt5 from hemagglutinin__InfluenzaA__AHL81271

SEQ ID NO: 194195 - RNA, 1701 nt, Artificial Sequence; identical to SEQ ID NO: 189879
  derived and/or modified sequence opt5 from hemagglutinin__InfluenzaA__AHL81283

SEQ ID NO: 194196 - RNA, 1701 nt, Artificial Sequence; identical to SEQ ID NO: 189879
  derived and/or modified sequence opt5 from hemagglutinin__InfluenzaA__AHL81295

SEQ ID NO: 194197 - RNA, 1701 nt, Artificial Sequence; identical to SEQ ID NO: 194172
  derived and/or modified sequence opt5 from hemagglutinin__InfluenzaA__AHL81307

SEQ ID NO: 194198 - RNA, 1701 nt, Artificial Sequence; identical to SEQ ID NO: 189891
  derived and/or modified sequence opt5 from hemagglutinin__InfluenzaA__AHL81329

SEQ ID NO: 194199 - RNA, 1701 nt, Artificial Sequence
  derived and/or modified sequence opt5 from hemagglutinin__InfluenzaA__AHL81340
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacaggacggcaccuccagcgcuugcauccgcggcucuaaaaauuccuuuuucagcagacugaacuggcucacacaucugaauuuuaaauauccugcccuuaacgucaccaugcccaauaacgagcaguucgauaagcuguacauuuggggagugcaccauccugggacggacaaagaucagaucuuucucuaugcgcaagccucuggccggauuacaguuuccaccaagcgcagccagcaggcugccaucccgaacauuggguccagaccccgggugcgcaauaucccuucuagaaucagcauuuacuggacaaucgucaaacccggagacauucugcugaucaacuccaccggcaaucucauugcuccucggggguacuucaagauccgcagcggaaagucuuccaucaugagaagcgacgcccccauuggcaaauguaacucugagugcaucaccccgaauggcagcauuccuaacgauaagcccuuucagaaugugaaccggaucacauauggggcguguccucgcuacgugaaacaaaauacgcugaaacuugccaccggaaugagaaacguccccgaaaagcagacacggggcauuuucggggcuaucgccggauuuaucgagaauggcugggaagggaugguugacggaugguauggcuuccgccaccagaacuccgagggcagagggcaagcugccgaucugaagucuacccaggccgcuauugaccagaucaauggaaaacucaaccggcugauuggcaagacaaaugagaaguuccaccagaucgaaaaagaguuuagcgaaguggaggggcgcauucaagaucuugaaaaguacguggaggacaccaaaaucgaucugugguccuauaacgcggagcuccuggucgcccuggaaaaccagcauacgauugaccucacagauagcgagaugaauaagcuguucgaaaagaccaagaagcagcuuagagagaacgcugaagacaugggaaauggcugcuuuaaaaucuaccacaagugugauaacgccugcaucgggucuauucggaauggcaccuauaaccaugacguguacagagacgaggcccugaauaaacgcuuccagaucaagggaauugagcucaaauccggcuacaaggauuggauccuguggauuagcuuugcuaucucuugcuuccuucuguguguugcccuccugggguuuaucaugugggcgugccaaaagggaaacauucgguguaauaucugcauuuga

SEQ ID NO: 194200 - RNA, 1701 nt, Artificial Sequence; identical to SEQ ID NO: 189879
  derived and/or modified sequence opt5 from hemagglutinin__InfluenzaA__AHL81352

SEQ ID NO: 194201 - RNA, 1701 nt, Artificial Sequence
  derived and/or modified sequence opt5 from hemagglutinin__InfluenzaA__AHL81364
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcgccugcuauccgggggauuuuauuaauuacgaagaacugcgggagcagcuuuccagcgucucuuccuucgaacgcuuugagaucuuccccaagacgaacagcuggccuaaucacgacucuaacaagggagugaccgcugccuguccccaugcgggcgccaaauccuuuuauaagaaucugaucuggcucguuaaaaagggcaacagcuacccuaaacugucuaaguccuauauuaaugauaaggggaaagaagugcuuguccuguggggaauccaccaccccagcacaaccgcugaccaacagucccucuaccagaacgccgaugcuuacguguucgugggcacaucuagauauagcaagaaauuuaagccugagauugccauccggccgaaaguccgcgaccaggaggggagaaugaacuacuauuggacccugguugaacccggagauaagauuacguucgaggcgacaggcaaucugguggugccucgguacgccuuugcuauggaacgcaacgccggguccggaaucauuaucagcgacacccccguccaugauugcaauacaaccugucaaaccccuaaaggcgcuaucaacacaucucuccccuuccagaauauucacccgaucacgauuggcaagugcccuaaguaugugaaauccaccaagcugagacuugccacagggcugcggaacguucccagcauccagucucgcggacucuuuggcgccauugcuggguucaucgagggaggcuggaccgggaugguggacggaugguacggcuaucaucaccagaaugaacaaggcagcggguacgcggccgaccugaaauccacacagaacgcuaucgauaagauuaccaauaaagucaacucugugaucgagaagaugaauacgcaguuuacagccguuggaaaggaguucaaccaccuugagaaaagaauugagaaucugaacaagaaaguggacgauggcuuccucgacaucuggaccuacaaugccgaacugcugguccuccuggagaacgaacggacccuugauuaucaugacagcaacgugaagaaucuguacgagaaaguccgcaaccagcucaagaauaacgcuaaggagauugggaauggauguuuugaguucuaucacaaaugcgauaacacauguauggaauccgugaagaauggcaccuacgacuauccuaaauacagcgaagaggccaagcugaacagagaagagaucgaugggguuaaacuugagucuacacggaucuaucaaauucuggcgaucuacuccacgguggcuagcucucucguccuggugguuucccugggcgccauuagcuuuuggaugugcuccaauggaucucuccagugccgcaucuguauuuga

SEQ ID NO: 194202 - RNA, 1701 nt, Artificial Sequence
  derived and/or modified sequence opt5 from hemagglutinin__InfluenzaA__AHL81386
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccaacagcuggccuaaucacgacucuaacaagggagugacagccgcuuguccccaugccggcguuaaauccuuuuauaagaaucugaucuggcucgugaaaaagggcaacagcuacccuaaacugucuaaguccuauauuaaugauaaggggaaagaaguccuugugcuguggggaauccaccaccccagcaccacagcggaccaacagucccucuaccagaacgccgaugcuuacguguucgucggcaccucuagauauagcaagaaauuuaagccugagauugccauccggccgaaaguucgcgaccaggaggggagaaugaacuacuauuggacgcugguggaacccggagauaagauuacauucgaggcuaccggcaaucugguggucccucgguacgccuuugcgauggaacgcaacgccggguccggaaucauuaucagcgacacacccgugcaugauugcaauaccaccugucaaacaccuaaaggcgcuaucaacacgucucuccccuuccagaauauucacccgaucaccauuggcaagugcccuaaguauguuaaauccacaaagcugagacuugccaccgggcugcggaacgugcccagcauccagucucgcggacucuuuggcgcuauugccggguucaucgagggaggcuggacagggauggucgacggaugguacggcuaucaucaccagaaugaacaaggcagcggguacgccgcugaccugaaauccacccagaacgcgaucgauaagauuacgaauaaagugaacucuguuaucgagaagaugaauacacaguuuaccgccgugggaaaggaguucaaccaccuugagaaaagaauugagaaucugaacaagaaagucgacgauggcuuccucgacaucuggaccuacaaugcugaacugcuggugcuccuggagaacgaacggacacuugauuaucaugacagcaacgucaagaaucuguacgagaaagugcgcaaccagcucaagaauaacgccaaggagauugggaauggauguuuugaguucuaucacaaaugcgauaacaccuguauggaauccguuaagaauggcacauacgacuauccuaaauacagcgaagaggccaagcugaacagagaagagaucgauggggugaaacuugagucuacgcggaucuaucaaauucuggcuaucuacuccaccgucgccagcucucucgugcugguugugucccugggcgcgauuagcuuuuggaugugcuccaauggaucucuccagugccgcaucuguauuuga

SEQ ID NO: 194203 - RNA, 1701 nt, Artificial Sequence; identical to SEQ ID NO: 189879
  derived and/or modified sequence opt5 from hemagglutinin__InfluenzaA__AHL81397

SEQ ID NO: 194204 - RNA, 1701 nt, Artificial Sequence; identical to SEQ ID NO: 194189
  derived and/or modified sequence opt5 from hemagglutinin__InfluenzaA__AHL81409

SEQ ID NO: 194205 - RNA, 1701 nt, Artificial Sequence; identical to SEQ ID NO: 194159
  derived and/or modified sequence opt5 from hemagglutinin__InfluenzaA__AHL81419

SEQ ID NO: 194206 - RNA, 1701 nt, Artificial Sequence; identical to SEQ ID NO: 186857
  derived and/or modified sequence opt5 from hemagglutinin__InfluenzaA__AHL81430

SEQ ID NO: 194207 - RNA, 1701 nt, Artificial Sequence; identical to SEQ ID NO: 183654
  derived and/or modified sequence opt5 from hemagglutinin__InfluenzaA__AHL88951

SEQ ID NO: 194208 - RNA, 1701 nt, Artificial Sequence; identical to SEQ ID NO: 183654
  derived and/or modified sequence opt5 from hemagglutinin__InfluenzaA__AHL89030

SEQ ID NO: 194209 - RNA, 1701 nt, Artificial Sequence
  derived and/or modified sequence opt5 from hemagglutinin__InfluenzaA__AHL89042
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagaacuucaauuggaccggagugacacagaacggcaccucuuccgcuugcaagcgcagaagcaauaacagcuuuuucucccggcugaauuggcucacacaucugaaguuuaaauauccugcccuuaacgucaccaugcccaacaaugagaaguucgacaaacuguacaucuggggcgugcaccauccugggacggauaacgaccagauuuuucucuaugcgcaggccagcggacgcaucacaguuucuaccaagagaucccaacagacagugauuccgaauaucggcagccggccccgcgucagaaacauuccuucccggaucucuaucuacuggaccauugugaaacccggggauauccugcugauuaauagcaccggaaaccucaucgcuccucgcggcuacuucaagauuagauccgggaagucuucuaucaugcgguccgacgcccccaucggaaaauguaauagcgaaugcauuacaccgaacggcucuaucccuaaugacaagcccuuucagaacgugaaucgcauuacguauggcgcuuguccuagauacgucaaacagaacacccugaaacuugccacagggaugcggaauguucccgagaagcaaacccgcggaaucuucggcgcgauugccggguuuaucgaaaacggaugggagggcaugguggaugggugguauggauucagacaccagaauagcgagggcaucggccaggcugccgaccugaaguccacacaagcugccauuaaccagaucaacgggaaacucaaucggcugauuggaaagaccaacgaaaaguuccaccagaucgagaaagaauuuucugagguggaaggccgcauucaggaucuugagaaguacgucgaggacacgaaaaucgaucuguggagcuauaaugccgaacuccugguggcucuggagaaccaacauacaauugaccucaccgauuccgaaaugaauaagcuguucgagagaaccaaaaagcagcuucgggaaaacgcggaggacauggggaauggaugcuuuaagaucuaccacaaaugugauaacgccugcaucggcagcauuagaaaugggacauaugaccaugauguuuaccgcgacgaggcucugaacaaucgguuccagaucaagggcguggaacucaaaucuggauacaaggacuggauucuguggaucuccuuugccauuagcugcuuccuucugugugucgcccucgugggcuuuaucaugugggcuugccagaaagggaacaucagauguaauauuugcaucuga

SEQ ID NO: 194210 - RNA, 1701 nt, Artificial Sequence
  derived and/or modified sequence opt5 from hemagglutinin__InfluenzaA__AHL89054
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuuuucucuaugcgcaggccucuggccgcaucacaguuuccaccaagagaagccaacagacagugauuccgaacaucgggucccggccccgcgucagaaauauuccuucucggaucagcaucuacuggaccauugugaaacccggagauauccugcugauuaacuccaccggcaaucucaucgcuccucgcggguacuucaagauuagaagcggaaagucuuccaucaugcggagcgacgcccccaucggcaaauguaacucugagugcauuacaccgaauggcagcaucccuaacgacaagcccuuucagaaugugaaccgcauuacguauggggcuuguccuagauacgucaaacagaauacccugaaacuugccacaggaaugcggaacguucccgaaaagcaaacccgcggcaucuucggggcgauugccggauuuaucgagaauggcugggaagggaugguggauggaugguauggcuucagacaccagaacuccgagggcaucgggcaggcugccgaccugaagucuacacaagcugccauuaaucagaucaacggaaaacucaaccggcugauuggcaagaccaaugagaaguuccaccagaucgaaaaagaguuuagcgaaguggaggggcgcauucaggaucuugaaaaguacgucgaggacacgaaaaucgaucugugguccuauaacgccgagcuccugguggcucuggaaaaucaacauacaauugaccucaccgauagcgagaugaacaagcuguucgaaagaaccaaaaagcagcuucgggagaaugcggaagacaugggaaacggcugcuuuaagaucuaccacaaaugugauaaugccugcaucgggucuauuagaaacggcacauaugaccaugauguuuaccgcgacgaggcucugaauaaccgguuccagaucaagggaguggagcucaaauccggcuacaaggacuggauucuguggaucagcuuugccaugucuugcuuccuucugugugucgcccuccugggguuuauuaugugggcuugccagaaaggaaauaucagauguaacaucugcauuuga

SEQ ID NO: 194211 - RNA, 1701 nt, Artificial Sequence; identical to SEQ ID NO: 184605
  derived and/or modified sequence opt5 from hemagglutinin__InfluenzaA__AHL89066

SEQ ID NO: 194212 - RNA, 1701 nt, Artificial Sequence
  derived and/or modified sequence opt5 from hemagglutinin__InfluenzaA__AHL89078
augaagaccaucauugcccugagcuacauccucugccugguguucgcucagaaacuucccggcgacgauaacuccacagccacgcugugucucgggcaccaugcggucccuaauggaaccguugugaagacaauuaccaacgaccaaaucgaggugacaaaugcuaccgaacugguccagucuagcuccacaggcgggauuugcgauucuccgcaccagauccuugacggagagaacuguacccugaucgaugcccuccugggcgacccccagugcgauggguuucaaaauaaaaagugggaccuguucguggaaagaagcaaagccuauuccaacuguuacccuuaugauguucccgacuacgcuucucuccggagccugguggccuccagcggaacgcuugaguuuaauaacgaaucuuucaauuggaccggcgucacacagaacggcaccuccagcgcuugcaagcgcagaucuaauaacuccuuuuucagccggcugaauuggcucacacaucugaaguuuaaauauccugcccuuaacgugaccaugcccaauaacgagaaguucgauaaacuguacauuuggggaguucaccauccugggacggacaacgaucagaucuuucucuaugcgcaggccucuggccgcauuacaguguccaccaagagaagccaacagacagucaucccgaauauugggucccggccccgcgugagaaacaucccuucucggauuagcaucuacuggaccaucgugaaacccggagacauucugcugaucaauuccaccggcaaccucauugcuccucgcggguacuucaagaucagaagcggaaagucuuccauuaugcggagcgacgcccccaucggcaaauguaauucugagugcaucacaccgaacggcagcauuccuaaugauaagcccuuucagaacgucaaucgcaucacguauggggcuuguccuagauacguuaaacagaacacccugaaacuugccacaggaaugcggaaugugcccgaaaagcaaacccgcggcauuuucggggcgaucgccggauuuauugagaacggcugggaagggaugguggacggaugguauggcuucagacaccaaaauuccgagggcaucgggcaggcugccgaucugaagucuacacaggcugccaucaaccagauuaauggaaaacucaaccggcugaucggcaagaccaacgagaaguuccaccagauugaaaaagaguuuagcgaagucgaggggagaauccaggaccuugaaaaguacguggaggauacgaaaauugaccugugguccuauaaugccgagcuccugguugcucuggaaaaccaacauacaaucgaucucaccgacagcgagaugaauaagcuguucgaacgcaccaaaaagcagcuucgggagaacgcggaagauaugggaaauggcugcuuuaagauuuaccacaaaugugacaacgccugcaucgggucuaucagaaauggcacauaugaucaugacguguaccgcgacgaggcucugaacaaucgguuccagauuaagggagucgagcucaaauccggcuacaaggauuggauccuguggauuagcuuugccaucucuugcuuccuucuguguguggcccuccugggguuuauuaugugggcuugccagaaaggaaacaucagauguaauaucugcauuuga

SEQ ID NO: 194213 - RNA, 1701 nt, Artificial Sequence
  derived and/or modified sequence opt5 from hemagglutinin__InfluenzaA__AHL89090
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccguaucagauccuugauggagagaauuguacccugauugacgcccuccugggcgauccccagugcgacggguuucaaaacaaaaagugggaucuguucgucgaaagaagcaaagccuacuccaauuguuauccuuacgacgugcccgauuaugcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaccugaaguuuaaauacccugcccuuaaugucaccaugcccaacaacgagaaguucgacaaacuguauaucuggggagugcaucacccugggacggauaaugaccagauuuuucucuacgcgcaggccucuggccgcaucacaguuuccaccaagagaagccaacagacagugauuccgaacaucgggucccggccccgcgucagaaauauuccuucucggaucagcaucuacuggaccauugugaaacccggagauauccugcugauuaacuccaccggcaaucucaucgcuccucgcggguauuucaagauuagaagcggaaagucuuccaucaugcggagcgacgcccccaucggcaaauguaacucugagugcauuacaccgaauggcagcaucccuaacgacaagcccuuucagaaugugaaccgcauuacguacggggcuuguccuagauaugucaaacagaauacccugaaacuugccacaggaaugcggaacguucccgaaaagcaaacccgcggcaucuucggggcgauugccggauuuaucgagaauggcugggaagggaugguggauggaugguacggcuucagacaucagaacuccgagggcaucgggcaggcugccgaccugaagucuacacaagcugccauuaaucagaucaacggaaaacucaaccggcugauuggcaagaccaaugagaaguuccaccagaucgaaaaagaguuuagcgaaguggaggggcgcauucaggaucuugaaaaguaugucgaggacacgaaaaucgaucugugguccuacaacgccgagcuccugguggcucuggaaaaucaacacacaauugaccucaccgauagcgagaugaacaagcuguucgaaagaaccaaaaagcagcuucgggagaaugcggaagacaugggaaacggcugcuuuaagaucuaucauaaaugugauaaugccugcaucgggucuauuagaaacggcacauacgaccacgauguuuaccgcgacgaggcucugaauaaccgguuccagaucaagggaguggagcucaaauccggcuauaaggacuggauucuguggaucagcuuugccauuucuugcuuccuucugugugucgcccuccugggguuuaucaugugggcuugccagaaaggaaauaucagauguaacauuugcaucuga

SEQ ID NO: 194214 - RNA, 1701 nt, Artificial Sequence; identical to SEQ ID NO: 183654
  derived and/or modified sequence opt5 from hemagglutinin__InfluenzaA__AHL89102

SEQ ID NO: 194215 - RNA, 1701 nt, Artificial Sequence; identical to SEQ ID NO: 183654
  derived and/or modified sequence opt5 from hemagglutinin__InfluenzaA__AHL89114

SEQ ID NO: 194216 - RNA, 1701 nt, Artificial Sequence
  derived and/or modified sequence opt5 from hemagglutinin__InfluenzaA__AHL89126
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaaacuucaauuggaccggcgugacacagaacggcaccucuuccgcuugcaagcgcagaagcaauaacuccuuuuucucucggcugaauuggcucacacaucugaaguuuaaauauccugcccuuaacgucaccaugcccaacaaugagaaguucgacaaacuguacaucuggggagugcaccauccugggacggauaacgaccagauuuuucucuaugcgcaggccagcggccgcaucacaguuucuaccaagagaucccaacagacagugauuccgaauaucgggagccggccccgcgucagaaacauuccuucccggaucucuaucuacuggaccauugugaaacccggagauauccugcugauuaauagcaccggcaaccucaucgcuccucgcggguacuucaagauuagauccggaaagagcucuaucaugcgguccgacgcccccaucggcaaauguaauagcgagugcauuacaccgaacggcucuaucccuaaugacaagcccuuucagaacgugaaucgcauuacguauggggcuuguccuagauacgucaaacagaacacccugaaacuugccacaggaaugcggaauguucccgaaaagcaaacccgcggcaucuucggggcgauugccggauuuaucgagaacggcugggaagggaugguggauggaugguauggcuucagacaccagaauagcgagggcaucgggcaggcugccgaccugaaguccacacaagcugccauuaaccagaucaacggaaaacucaaucggcugauuggcaagaccaacgagaaguuccaccagaucgaaaaagaguuuucugaaguggaggggcgcauucaggaucuugaaaaguacgucgaggacacgaaaaucgaucuguggagcuauaaugccgagcuccugguggcucuggaaaaccaacauacaauugaccucaccgauuccgagaugaauaagcuguucgaaagaaccaaaaagcagcuucgggagaacgcggaagacaugggaaauggcugcuuuaagaucuaccacaaaugugauaacgccugcaucgggagcauuagaaauggcacauaugaccaugauguuuaccgcgacgaggcucugaacaaucgguuccagaucaagggaguggagcucaaaucuggcuacaaggacuggauucuguggaucuccuuugccauuagcugcuuccuucugugugucgcccuccugggguuuaucaugugggcuugccagaaaggaaacaucagauguaauauuugcaucuga

SEQ ID NO: 194217 - RNA, 1701 nt, Artificial Sequence
  derived and/or modified sequence opt5 from hemagglutinin__InfluenzaA__AHL89138
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggcgugcaccauccugggacggauaaugaccagauuuuucucuaugcgcagucuuccggacgcaucacaguuagcaccaagagaucccaacagacagugauuccgaacaucggcucucggccccgcgucagaaauauuccuagccggaucuccaucuacuggaccauugugaaacccggggauauccugcugauuaacagcaccggaaaucucaucgccccucgcggcuacuucaagauuagaucugggaaguccagcaucaugcggucugacgcucccaucggaaaauguaacagcgaaugcauuacaccgaauggcuccaucccuaacgacaagcccuuucagaaugugaaccgcauuacguauggcgccuguccuagauacgucaaacagaauacccugaagcuggcuacagggaugcggaacguucccgagaaacaaacccgcggaaucuucggcgccauugcgggguuuaucgaaaauggaugggagggcaugguggaugggugguauggauucagacaccagaacucugagggcaucggccaggccgcugaccuuaagagcacacaagccgcuauuaaucagaucaacgggaaacucaaccggcugauuggaaagaccaaugaaaaguuccaccagaucgagaaagaauuuuccgagguggaaggccgcauucaggaucuugagaaguacgucgaggacacgaaaaucgaucuguggagcuauaacgccgaacuccugguggcccuggagaaucaacauacaauugaccucaccgauucugaaaugaacaagcuguucgagagaaccaaaaagcagcuucgggaaaaugcugaggacauggggaacggaugcuuuaagaucuaccacaaaugugauaaugcgugcaucggcuccauuagaaacgggacauaugaccaugauguuuaccgcgacgaggcccugaauaaccgguuccagaucaagggcguggaacucaaaagcggauacaaggacuggauucuguggaucucuuuugcuauuuccugcuuccuucugugugucgcccuccugggcuuuaucaugugggccugccagaaagggaauaucagauguaacauuugcaucuga

SEQ ID NO: 194218 - RNA, 1701 nt, Artificial Sequence
  derived and/or modified sequence opt5 from hemagglutinin__InfluenzaA__AHL89150
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuuuucucuaugcgcaggccucuggccgcaucacaguuuccaccaagagaagccaacagacagugauuccgaacaucgggucccggccccgcgucagaaauauuccuucucggaucagcaucuacuggaccauugugaaacccggagauauccugcugauuaacuccaccggcaaucucaucgcuccucgcggguacuucaagauuagaagcggaaagucuuccaucaugcggagcgacgcccccaucggcaaauguaacucugagugcauuacaccgaauggcagcaucccuaacgacaagcccuuucagaaugugaaccgcauuacguauggggcuuguccuagauacgucaaacagaauacccugaaacuugccacaggaaugcggaacguucccgaaaagcaaacccgcggcaucuucggggcgauugccggauuuaucgagaauggcugggaagggaugguggauggaugguauggcuucagacaccagaacuccgagggcaucgggcaggcugccgaccugaagucuacacaagcugccauuaaucagaucaacggaaaacucaaccggcugauuggcaagaccaaugagaaguuccaccagaucgaaaaagaguuuagcgaaguggaggggcgcauucaggaucuugaaaaguacgucgaggacacgaaaaucgaucugugguccuauaacgccgagcuccugguggcucuggaaaaucaacauacaauugaccucaccgauagcgagaugaacaagcuguucgaaagaaccaaaaagcagcuucgggagaaugcggaagacaugggaaacggcugcuuuaagaucuaccacaaaugugauaaugccugcaucgggucuauuagaaacggcacauaugaccaugauguuuaccgcgacgaggcucugaauaaccgguuccagaucaagggaguggagcucaaauccggcuacaaggacuggauucuguggaucagcuuugccauuucuugcuuccuucugugugucgcccuccugguguuuaucaugugggcuugccagaaagggaauaucagauguaacauuugcaucuga

SEQ ID NO: 194219 - RNA, 1701 nt, Artificial Sequence
  derived and/or modified sequence opt5 from hemagglutinin__InfluenzaA__AHL89162
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuuuucucuaugcgcaggccucuggccgcaucacaguuuccaccaagagaagccaacagacagugauuccgaacaucgggucccggccccgcgucagaaauauuccuucucggaucagcaucuacuggaccauugugaaacccggagauauccugcugauuaacuccaccggcaaucucaucgcuccucgcggguacuucaagauuagaagcggaaagucuuccaucaugcggagcgacgcccccaucggcaaauguaacucugagugcauuacaccgaauggcagcaucccuaacgacaagcccuuucagaaugugaaccgcauuacguauggggcuuguccuagauacgucaaacagaauacccugaaacuugccacaggaaugcggaacguucccgaaaagcaaacccgcggcaucuucggggcgauugccggauuuaucgagaauggcugggaagggaugguggauggaugguauggcuucagacaccagaacuccgagggcacagggcaggcugccgaccugaagucuacccaagcugccacgaaucagaucaacggaaaacucaaccggcugauuggcaagacaaaugagaaguuccaccagaucgaaaaagaguuuagcgaaguggaggggcgcauucaggaucuugaaaaguacgucgaggacaccaaaaucgaucugugguccuauaacgccgagcuccugguggcucuggaaaaucaacauaccauugaccucacagauagcgagaugaacaagcuguucgaaagaaccaaaaagcagcuucgggagaaugcggaagacaugggaaacggcugcuuuaagaucuaccacaaaugugauaaugccugcauugggucuaucagaaacggcacauaugaccaugauguuuaccgcgacgaggcucugaauaaccgguuccagaucaagggaguggagcucaaauccggcuacaaggacuggauucuguggaucagcuuugccauuucuugcuuccuucugugugucgcccuccugggguuuaucaugugggcuugccagaaaggaaauauuagauguaacaucugcaucuga

SEQ ID NO: 194220 - RNA, 1701 nt, Artificial Sequence
  derived and/or modified sequence opt5 from hemagglutinin__InfluenzaA__AHL89174
augaagaccaucauugcccugagcuacacacucugccugguguucgcucagaaacuucccggcaacgacaauuccacggccacccugugucucgggcaccaugcggucccuaacggaacaaucguuaagaccauuacaaaugaucaaaucgaggugaccaacgcuacagaacuggugcagucuagcuccaccggcgggauuugcgacucuccgcaccagauccuugauggagagaauuguacgcugaucgacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacccuugaguuuaacaaugaaucuuucaacuggacaggcgugacccagaauggcacauccagcgcuugcaagcgcagaucuaacaauuccuuuuucagccggcugaacuggcucacccaucugaaguuuaaauauccugcccuuaaugucacgaugcccaacaacgagaaguucgacaaacuguacauuuggggagugcaccauccugggacagauaaugaccagaucuuucucuaugcgcaggccucuggccgcauuaccguuuccacaaagagaagccaacagaccgugaucccgaacauugggucccggccccgcgucagaaauaucccuucucggauuagcaucuacuggaccaucgugaaacccggagauauucugcugaucaacuccacaggcaaucucauugcuccucgcggguacuucaagaucagaagcggaaagucuuccauuaugcggagcgacgcccccaucggcaaauguaacucugagugcaucacgccgaauggcagcauuccuaacgacaagcccuuucagaaugugaaccgcaucaccuauggggcuuguccuagauacgucaaacagaauacacugaaacuugccaccggaaugcggaacguucccgaaaaacaaacacgcggcauuuucggggcgaucgccggauuuauugagaauggcugggaagggaugguggauggaugguauggcuucagacaccagaacuccgagggcaucgggcaggcugccgaccugaagucuacccaagcugccaucaaucagauuaacggaaaacucaaccggcugaucggcaagacgaaugagaaguuccaccagauugaaaaagaguuuagcgaaguggaggggagaauccaggaucuugaaaaguacgucgaggacacaaaaauugaucugugguccuauaacgccgagcuccugguggcucuggaaaaucaacauaccaucgaccucaccgauagcgagaugaacaagcuguucgaacgcacaaagaagcagcuucgggagaaugcggaagacaugggaaacggcugcuuuaagauuuaccacaaaugugauaaugccugcaucgggucuaucagaaacggcaccuaugaccaugauguuuaccgcgacgaggcucugaauaaccgguuccagauuaagggaguggagcucaaauccggcuacaaggacuggauccuguggauuagcuuugccaucucuugcuuccuucugugugucgcccuccugggguuuauuaugugggcuugccagaaaggaaauaucagauguaacaucugcauuuga

SEQ ID NO: 194221 - RNA, 1701 nt, Artificial Sequence
  derived and/or modified sequence opt5 from hemagglutinin__InfluenzaA__AHL89210
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggcgugcaccauccugggacggauaaugaccagauuuuucucuaugcgcaggccucuggacgcaucacaguuuccaccaagagaagccaacagacagugauuccgaacaucggcucccggccccgcgucagaaauauuccuucucggaucagcaucuacuggaccauugugaaacccggggauauccugcugauuaacuccaccggaaaucucaucgcuccucgcggcuacuucaagauuagaagcgggaagucuuccaucaugcggagcgacgcccccaucggaaaauguaacucugaaugcauuacaccgaauggcagcaucccuaacgacaagcccuuucagaaugugaaccgcauuacguauggcgcuuguccuagauacgucaaacagaauacccugaaacuugccacagggaugcggaacguucccgagaagcaaacccgcggaaucuucggcgcgauugccggguuuaucgaaaauggaugggagggcaugguggaugggugguauggauucagacaccagaacuccgagggcaucggccaggcugccgaccugaagucuacacaagcugccauuaaucagaucaacgggaaacucaaccggcugauuggaaagaccaaugaaaaguuccaccagaucgagaaagaauuuagcgagguggaaggccgcauucaggaucuugagaaguacgucgaggacacgaaaaucgaucugugguccuauaacgccgaacuccugguggcucuggagaaucaacauacaauugaccucaccgauagcgaaaugaacaagcuguucgagagaaccaaaaagcagcuucgggaaaaugcggaggacauggggaacggaugcuuuaagaucuaccacaaaugugauaaugccugcaucggcucuauuagaaacgggacauaugaccaugauguuuaccgcgacgaggcucugaauaaccgguuccagaucaagggcguggaacucaaauccggauacaaggacuggauucuguggaucagcuuugccauuucuugcuuccuucugugugucgcccuccugggcuuuaucaugugggcuugccagaaagggaauaucagauguaacauuugcaucuga

SEQ ID NO: 194222 - RNA, 1701 nt, Artificial Sequence; identical to SEQ ID NO: 194221
  derived and/or modified sequence opt5 from hemagglutinin__InfluenzaA__AHL89222

SEQ ID NO: 194223 - RNA, 1701 nt, Artificial Sequence
  derived and/or modified sequence opt5 from hemagglutinin__InfluenzaA__AHL89234
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggcgugcaccauccugggacggauaaugaccagauuuuucucuaugcgcaggccucuggacgcaucacaguuuccaccaagagaagccaacagacagugauuccgaacaucggcucccggccccgcgucagaaauauuccuucucggaucagcaucuacuggaccauugugaaacccggggauauccugcugauuaacuccaccggaaaucucaucgcuccucgcggcuacuucaagauuagaagcgggaagucuuccaucaugcggagcgacgcccccaucggaaaauguaacucugaaugcauuacaccgaauggcagcaucccuaacgacaagcccuuucagaaugugaaccgcauuacguauggcgcuuguccuagauacgucaaacagaauacccugaaacuugccacagggaugcggaacguucccgagaagcaaacccgcggaaucuucggcgcgauugccggguuuaucgaaaauggaugggagggcaugguggaugggugguauggauucagacaccagaacuccgagggcaugggccaggcugccgaccugaagucuacacaagcugccaucaaucagauuaacgggaaacucaaccggcugaucggaaagaccaaugaaaaguuccaccagauugagaaagaauuuagcgagguggaaggcagaauccaggaucuugagaaguacgucgaggacacgaaaauugaucugugguccuauaacgccgaacuccugguggcucuggagaaucaacauacaaucgaccucaccgauagcgaaaugaacaagcuguucgagcgcaccaaaaagcagcuucgggaaaaugcggaggacauggggaacggaugcuuuaagauuuaccacaaaugugauaaugccugcaucggcucuaucagaaacgggacauaugaccaugauguuuaccgcgacgaggcucugaauaaccgguuccagauuaagggcguggaacucaaauccggauacaaggacuggauccuguggauuagcuuugccaucucuugcuuccuucugugugucgcccuccugggcuuuauuaugugggcuugccagaaagggaauaucagauguaacaucugcauuuga

SEQ ID NO: 194224 - RNA, 1701 nt, Artificial Sequence
  derived and/or modified sequence opt5 from hemagglutinin__InfluenzaA__AHL89246
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggcgugcaccauccugggacggauaaugaccagauuuuucucuaugcgcaggccucuggacgcaucacaguuuccaccaagagaagccaacagacagugauuccgaacaucggcucccggccccgcgucagaaauauuccuucucggaucagcaucuacuggaccauugugaaacccggggauauccugcugauuaacuccaccggaaaucucaucgcuccucgcggcuacuucaagauuagaagcgggaagucuuccaucaugcggagcgacgcccccaucggaaaauguaacucugaaugcauuacaccgaauggcagcaucccuaacgacaagcccuuucagaaugugaaccgcauuacguauggcgcuuguccuagauacgucaaacagaauacccugaaacuugccacagggaugcggaacguucccgagaagcaaacccgcggaaucuucggcgcgauugccggguuuaucgaaaauggaugggagggcaugguggaugggugguauggauucagacaccagaacuccgagggcaucggccaggcugccgaccugaagucuacacaagcugccauuaaucagaucaacgggaaacucaaccggcugauuggaaagaccaaugaaaaguuccaccagaucgagaaagaauuuagcgagguggaaggccgcauucaggaucuugagaaguacgucgaggacacgaaaaucgaucugugguccuauaacgccgaacuccugguggcucuggagaaucaacauacaauugaccucaccgauagcgaaaugaacaagcuguucgagagaaccaaaaagcagcuucgggaaaaugcggaggacauggggaacggaugcuuuaagaucuaccacaaauguggcaaugccugcaucgggucuauuagaaacggcacauaugaucaugacguuuaccgcgaugaggcucugaauaaccgguuccagaucaagggaguggaacucaaauccggcuacaaggacuggauucuguggaucagcuuugccauuucuugcuuccuucugugugucgcccuccugggguuuaucaugugggcuugccagaaaggaaauaucagauguaacauuugcaucuga

SEQ ID NO: 194225 - RNA, 1701 nt, Artificial Sequence
  derived and/or modified sequence opt5 from hemagglutinin__InfluenzaA__AHL89258
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcaagcgcagaucuaacaauuccuuuuucagccggcugaacuggcucacacaucugaaguuuaaauaucaggcccuuaaugucaccaugccuaacaacgagaaguucgacaaacuguacaucuggggcgugcaccaucccgggacggauaaugaccagauuuuucucuaugcgcaagccucuggacgcaucacaguuuccaccaagagaagccagcagacagugauuccuaacaucggcucccggccgcgcgucagaaauauucccucucggaucagcaucuacuggaccauugugaaaccuggggauauccugcugauuaacuccaccggaaaucucaucgcuccccgcggcuacuucaagauuagaagcgggaagucuuccaucaugcggagcgacgccccuaucggaaaauguaacucugaaugcauuacacccaauggcagcaucccgaacgacaagccuuuucagaaugugaaccgcauuacguauggcgcuugucccagauacgucaaacaaaauacccugaaacuugccacagggaugcggaacguuccugagaagcagacccgcggaaucuucggcgcgauugccggguuuaucgaaaauggaugggagggcaugguggaugggugguauggauucagacaccagaacuccgagggcaucggccaagcugccgaccugaagucuacacaggcugccauuaaucagaucaacgggaaacucaaccggcugauuggaaagaccaaugaaaaguuccaccagaucgagaaagaauuuagcgagguggaaggccgcauucaagaucuugagaaguacgucgaggacacgaaaaucgaucugugguccuauaacgccgaacuccugguggcucuggagaaucagcauacaauugaccucaccgauagcgaaaugaacaagcuguucgagagaaccaaaaagcagcuucgggaaaaugcggaggacauggggaacggaugcuuuaagaucuaccacaaaugugauaaugccugcaucggcucuauuagaaacgggacauaugaccaugauguuuaccgcgacgaggcucugaauaaccgguuccagaucaagggcguggaacucaaauccggauacaaggacuggauucuguggaucagcuuugccauuucuugcuuccuucugugugucgugcuccugggcuuuaucaugugggccugccaaaaagggaauaucagauguaacauuugcaucuga

SEQ ID NO: 194226 - RNA, 1701 nt, Artificial Sequence; identical to SEQ ID NO: 194221
  derived and/or modified sequence opt5 from hemagglutinin__InfluenzaA__AHL89270

SEQ ID NO: 194227 - RNA, 1701 nt, Artificial Sequence; identical to SEQ ID NO: 194221
  derived and/or modified sequence opt5 from hemagglutinin__InfluenzaA__AHL89282

SEQ ID NO: 194228 - RNA, 1701 nt, Artificial Sequence; identical to SEQ ID NO: 194221
  derived and/or modified sequence opt5 from hemagglutinin__InfluenzaA__AHL89294

SEQ ID NO: 194229 - RNA, 1701 nt, Artificial Sequence; identical to SEQ ID NO: 194221
  derived and/or modified sequence opt5 from hemagglutinin__InfluenzaA__AHL89306

SEQ ID NO: 194230 - RNA, 1701 nt, Artificial Sequence; identical to SEQ ID NO: 184605
  derived and/or modified sequence opt5 from hemagglutinin__InfluenzaA__AHL89318

SEQ ID NO: 194231 - RNA, 1701 nt, Artificial Sequence
  derived and/or modified sequence opt5 from hemagglutinin__InfluenzaA__AHL89330
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcaagcgcagaucuaacaauuccuuuuucagccggcugaacuggcucacacaucugaaauuuaaguauccugcccuuaaugucaccaugcccaacaacgagaaauucgacaagcuguacaucuggggcgugcaccauccugggacggauaaugaccagauuuuucucuaugcgcaggccucuggacgcaucacaguuuccaccaaaagaagccaacagacagugauuccgaacaucggcucccggccccgcgucagaaauauuccuucucggaucagcaucuacuggaccauugugaagcccggggauauccugcugauuaacuccaccggaaaucucaucgcuccucgcggcuacuucaagauuagaagcgggaaaucuuccaucaugcggagcgacgcccccaucggaaaguguaacucugagugcauuacaccgaauggcagcaucccuaacgacaaacccuuucagaaugugaaccgcauuacguauggcgcuuguccuagauacgucaagcagaauacccugaaacuugccacagggaugcggaacguucccgaaaagcaaacccgcggaaucuucggcgcgauugccggguuuaucgagaauggaugggaaggcaugguggaugggugguauggauucagacaccagaacuccgagggcaucggccaggcugccgaccugaaaucuacacaagcugccauuaaucagaucaacgggaagcucaaccggcugauuggaaagaccaaugagaaauuccaccagaucgaaaaggaguuuagcgaaguggagggccgcauucaggaucuugaaaaauacgucgaggacacgaagaucgaucugugguccuauaacgccgagcuccugguggcucuggaaaaucaacauacaauugaccucaccgauagcgagaugaacaaacuguucgaaagaaccaagaagcagcuucgggagaaugcggaagacauggggaacggaugcuuuaaaaucuaccacaagugugauaaugccugcaucggcucuauuagaaacgggacauaugaccaugauguuuaccgcgacgaggcucugaauaaccgguuccagaucaaaggcguggagcucaaguccggauacaaagacuggauucuguggaucagcuuugccauuucuugcuuccuucugugugucgcccuccugggcuuuaucaugugggcuugccagaaggggaauaucagauguaacauuugcaucuga

SEQ ID NO: 194232 - RNA, 1701 nt, Artificial Sequence; identical to SEQ ID NO: 183654
  derived and/or modified sequence opt5 from hemagglutinin__InfluenzaA__AHL89342

SEQ ID NO: 194233 - RNA, 1701 nt, Artificial Sequence; identical to SEQ ID NO: 184585
  derived and/or modified sequence opt5 from hemagglutinin__InfluenzaA__AHL89354

SEQ ID NO: 194234 - RNA, 1701 nt, Artificial Sequence
  derived and/or modified sequence opt5 from hemagglutinin__InfluenzaA__AHL89366
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggcgugcaccauccugggacggauaaugaccagauuuuucucuaugcgcaggccucuggacgcaucacaguuuccaccaagagaagccaacagacagugauuccgaacaucggcucccggccccgcgucagaaauauuccuucucggaucagcaucuacuggaccauugugaaacccggggauauccugcugauuaacuccaccggaaaucucaucgcuccucgcggcuacuucaagauuagaagcgggaagucuuccaucaugaaaagcgacgcccccaucggaaaguguaacucugaaugcauuacaccgaauggcagcaucccuaacgacaaacccuuucagaaugugaaccggauuacguauggcgcuuguccucgcuacgucaagcagaauacccugaaacuugccacagggaugagaaacguucccgagaagcaaacccggggaaucuucggcgcgauugccggguuuaucgaaaauggaugggagggcaugguggaugggugguauggauuccgccaccagaacuccgagggcaucggccaggcugccgaccugaaaucuacacaagcugccauuaaucagaucaacgggaagcucaacagacugauuggaaagaccaaugaaaaauuccaccagaucgagaaggaauuuagcgagguggaaggccggauucaggaucuugagaaauacgucgaggacacgaagaucgaucugugguccuauaacgccgaacuccugguggcucuggagaaucaacauacaauugaccucaccgauagcgaaaugaacaaacuguucgagagaaccaagaagcagcuucgcgaaaaugcggaggacauggggaacggaugcuuuaaaaucuaccacaagugugauaaugccugcaucggcucuauucggaacgggacauaugaccaugauguuuacagagacgaggcucugaauaaccgcuuccagaucaaaggcauugaacucaaguccggauacaaagacuggauccuguggauuagcuuugccaucucuugcuuccuucugugugugguccuccugggcuuuaucaugugggccugccagaaggggaauauucgguguaacaucugcauuuga

SEQ ID NO: 194235 - RNA, 1701 nt, Artificial Sequence; identical to SEQ ID NO: 194221
  derived and/or modified sequence opt5 from hemagglutinin__InfluenzaA__AHL89378

SEQ ID NO: 194236 - RNA, 1701 nt, Artificial Sequence; identical to SEQ ID NO: 184852
  derived and/or modified sequence opt5 from hemagglutinin__InfluenzaA__AHL89390

SEQ ID NO: 194237 - RNA, 1701 nt, Artificial Sequence; identical to SEQ ID NO: 194221
  derived and/or modified sequence opt5 from hemagglutinin__InfluenzaA__AHL89402

SEQ ID NO: 194238 - RNA, 1701 nt, Artificial Sequence; identical to SEQ ID NO: 184605
  derived and/or modified sequence opt5 from hemagglutinin__InfluenzaA__AHL89414

SEQ ID NO: 194239 - RNA, 1701 nt, Artificial Sequence
  derived and/or modified sequence opt5 from hemagglutinin__InfluenzaA__AHL89426
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggcgugcaccauccugggacggauaaugaccagauuuuucucuaugcgcaggccucuggacgcaucacaguuuccaccaagagaagccaacagacagugauuccgaacaucggcucccggccccgcgucagaaauauuccuucucggaucagcaucuacuggaccauugugaaacccggggauauccuguucauuaacuccaccggaaaucugaucgcuccucgcggcuacuuuaagauuagaagcgggaagucuuccaucaugcggagcgacgcccccaucggaaaauguaacucugaaugcauuacaccgaauggcagcaucccuaacgacaagcccuuccagaaugugaaccgcauuacguauggcgcuuguccuagauacgucaaacagaauacccucaagcuggccacagggaugcggaacguucccgagaaacaaacccgcggaaucuuuggcgcgauugccggguucaucgaaaauggaugggagggcaugguggaugggugguauggauucagacaccagaacuccgagggcaucggccaggcugccgaccuuaagucuacacaagcugccauuaaucagaucaacgggaaacugaaccggcucauuggaaagaccaaugaaaaguuucaccagaucgagaaagaguucagcgaaguggaaggccgcauucaggaucuggagaaguacgucgaggacacgaaaaucgaucuuugguccuauaacgccgaacugcucguggcucuggagaaucaacauacaauugaccugaccgauagcgaaaugaacaagcucuuugagagaaccaaaaagcagcugcgggaaaaugcggaggacauggggaacggaugcuucaagaucuaccacaaaugugauaaugccugcaucggcucuauuagaaacgggacauaugaccaugauguuuaccgcgacgaggcucuuaauaaccgguuucagaucaagggcguggaacugaaauccggauacaaggacuggauucucuggaucagcuucgccauuucuugcuuucugcuuugugucgugcugcucggcuucaucaugugggccugccagaaagggaauaucagauguaacauuugcaucuga

SEQ ID NO: 194240 - RNA, 1701 nt, Artificial Sequence; identical to SEQ ID NO: 194221
  derived and/or modified sequence opt5 from hemagglutinin__InfluenzaA__AHL89438

SEQ ID NO: 194241 - RNA, 1701 nt, Artificial Sequence; identical to SEQ ID NO: 194221
  derived and/or modified sequence opt5 from hemagglutinin__InfluenzaA__AHL89450

SEQ ID NO: 194242 - RNA, 1701 nt, Artificial Sequence; identical to SEQ ID NO: 194221
  derived and/or modified sequence opt5 from hemagglutinin__InfluenzaA__AHL89462

SEQ ID NO: 194243 - RNA, 1701 nt, Artificial Sequence; identical to SEQ ID NO: 194221
  derived and/or modified sequence opt5 from hemagglutinin__InfluenzaA__AHL89474

SEQ ID NO: 194244 - RNA, 1701 nt, Artificial Sequence; identical to SEQ ID NO: 184852
  derived and/or modified sequence opt5 from hemagglutinin__InfluenzaA__AHL89486

SEQ ID NO: 194245 - RNA, 1701 nt, Artificial Sequence; identical to SEQ ID NO: 184605
  derived and/or modified sequence opt5 from hemagglutinin__InfluenzaA__AHL89498

SEQ ID NO: 194246 - RNA, 1701 nt, Artificial Sequence; identical to SEQ ID NO: 184605
  derived and/or modified sequence opt5 from hemagglutinin__InfluenzaA__AHL89510

SEQ ID NO: 194247 - RNA, 1701 nt, Artificial Sequence; identical to SEQ ID NO: 184605
  derived and/or modified sequence opt5 from hemagglutinin__InfluenzaA__AHL89522

SEQ ID NO: 194248 - RNA, 1701 nt, Artificial Sequence
  derived and/or modified sequence opt5 from hemagglutinin__InfluenzaA__AHL89534
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggcgugcaccauccugggacggauaaugaccagauuuuucucuaugcgcaggccucuggacgcaucacaguuuccaccaagagaagccaacagacagugauuccgaacaucggcucccggccccgcgucagaaauauuccuucucggaucagcaucuacuggaccauugugaaacccggggauauccugcugauuaacuccaccggaaaucucaucgcuccucgcggcuacuucaagauuagaagcgggaagucuuccaucaugcggagcgacgcccccaucggaaaauguaacucugaaugcauuacaccgaauggcagcaucccuaacgacaagcccuuucagaaugugaaccgcauuacguauggcgcuuguccuagauacgucaaacagaauacccugaaacuugccacagggaugcggaacguucccgagaagcaaacccgcggaaucuucggcgcgauugccggguuuaucgaaaauggaugggagggcaugguggaugggugguauggauucagacaccagaacuccgagggcaucggccaggcugccgaccugaagucuacacaagcugccauuaaucagaucaacgggaaacucaaccggcugauuggaaagaccaaugaaaaguuccaccagaucgagaaagaauuuagcgagguggaaggccgcauucaggaucuugagaaguacgucgaggacacgaaaaucgaucugugguccuauaacgccgaacuccugguggcucuggagaaucaacauacaauugaccucaccgauagcgaaaugaacaagcuguucgagagaaccaaaaagcagcuucgggaaaaugcggaggacauggggaacggaugcuuuaagaucuaccacaaaugugauaaugccugcaucggcucuauuagaaacgggacauaugaccaugauguuuaccgcgacgaggcucugaauaaccgguuccagaucaagggcauugaacucaaauccggauacaaggacuggauccuguggauuagcuuugccaucucuugcuuccuucugugugugguccuccugggcuuuaucaugugggccugccagaaagggaauauuagauguaacaucugcauuuga

SEQ ID NO: 194249 - RNA, 1698 nt, Artificial Sequence
  derived and/or modified sequence opt5 from hemagglutinin__InfluenzaA__AHL89546
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaagcgcuuauguguccgucguuucuagccauuacucccggcgcuucacccccgagauugccaaaagaccuaaggugcgggaccaggaagggcgcaucaacuauuacuggacgcuucuggagcccggagauacaauuaucuuugaggcgaauggcaaccucauugccccuagauucgcuuuugcccugagccggggguucggaucuggcaucauuaccuccaaugcucccauggacgaaugugaugccaagugccagacaccgcaaggcgcgaucaacagcucucuuccuuuucagaaugugcaccccgucaccaucggggaguguccuaaauaugugcgcagcgccaagcugagaaugguuaccggacuccggaacauucccuccauccagucucgcggccuguucggggcuauugccggauuuaucgaaggcggguggacaggaaugguggacggcugguacggcuaucaucaccagaaugagcaagggagcggauacgcugccgaucagaaauccacgcagaacgccauuaauggcaucaccaacaaggucaauagcgugaucgaaaagaugaacacacaguucaccgcuguugggaaagaguucaauaaacuggagagacggauggaaaaccucaauaagaagguggacgauggauuucuggacauuuggacauacaacgcggagcuucugguccuccuggaaaacgagcgcacccuugacuuccacgauucuaaugugaaaaaccuguaugaaaaggucaaaucccaacucaagaauaacgccaaagagaucggcaaugggugcuuugaguucuaccauaaguguaacgacgaaugcauggagagcgugaagaauggcacguaugauuaccccaaauauucugaagaguccaagcugaacagagagcggauugacggaguuaaacuggaaagcaugggcguguaccagauccucgcuauuuauuccacagucgccucuagccuggugcuucugguuucccucggggccaucucuuuuuggaugugcagcaauggaucccugcaguguagaaucugcauuuga

SEQ ID NO: 194250 - RNA, 1698 nt, Artificial Sequence; identical to SEQ ID NO: 184938
  derived and/or modified sequence opt5 from hemagglutinin__InfluenzaA__AHL89558

SEQ ID NO: 194251 - RNA, 1698 nt, Artificial Sequence; identical to SEQ ID NO: 184938
  derived and/or modified sequence opt5 from hemagglutinin__InfluenzaA__AHL89570

SEQ ID NO: 194252 - RNA, 1698 nt, Artificial Sequence; identical to SEQ ID NO: 184954
  derived and/or modified sequence opt5 from hemagglutinin__InfluenzaA__AHL89582

SEQ ID NO: 194253 - RNA, 1698 nt, Artificial Sequence; identical to SEQ ID NO: 184954
  derived and/or modified sequence opt5 from hemagglutinin__InfluenzaA__AHL89594

SEQ ID NO: 194254 - RNA, 1698 nt, Artificial Sequence; identical to SEQ ID NO: 184954
  derived and/or modified sequence opt5 from hemagglutinin__InfluenzaA__AHL89606

SEQ ID NO: 194255 - RNA, 1698 nt, Artificial Sequence; identical to SEQ ID NO: 184938
  derived and/or modified sequence opt5 from hemagglutinin__InfluenzaA__AHL89618

SEQ ID NO: 194256 - RNA, 1698 nt, Artificial Sequence; identical to SEQ ID NO: 184954
  derived and/or modified sequence opt5 from hemagglutinin__InfluenzaA__AHL89630

SEQ ID NO: 194257 - RNA, 1698 nt, Artificial Sequence
  derived and/or modified sequence opt5 from hemagglutinin__InfluenzaA__AHL89642
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauaaccacaaugggaaacuuugccugcucaagggaaucgcgccccugcagcugggcaacuguucuguugcuggguggauucucggaaauccugagugcgaacugcuuaucagcaaagaguccuggucuuacauuguggaaaccccgaaccccgagaauggcacguguuauccuggguacuuugccgacuaugaggaacugagagagcaacucagcuccgucucuagcuucgaacgguuugagaucuuccccaaggaguccagcuggccuaaccauaccgugacaggaguuucugccuccugcagccacaauggcaagucuuccuuuuaccgcaaccugcuuuggcugaccggcaaaaaugggcucuaucccaaccugagcaagucuuacgcuaauaacaaagaaaaggaggugcugguccucuggggagugcaucacccuccgaacaucggcgaucagagagcccuguaccacacagaaaaugcuuauguguccgucguuagcucccauuacucucggcgcuucacccccgagauugccaaaagaccuaaggugcgggaccaggaagggcgcaucaacuauuacuggacgcuucuggagcccggagauacaauuaucuuugaggcgaauggcaaccucauugccccuagauucgcuuuugcccugagccggggguucggauccggcaucauuaccagcaaugcucccaugggcgaaugugacgccaagugccagacaccgcaaggggcgaucaacucuucccuuccuuuucagaaugugcaccccgucaccaucggagaguguccuaaauaugugcgcagcgccaagcugagaaugguuaccggccuccggaacauucccucuauccagagccgcgggcuguucggagcuauugccggcuuuaucgaagggggauggacaggcaugguggauggcugguacggguaucaucaccagaaugagcaaggauccggcuacgcugccgaccagaaaucuacgcagaacgccauuaaugggaucaccaacaaggucaauagcgugaucgaaaagaugaacacacaguucaccgcuguuggaaaagaguucaauaaacuggagagacggauggaaaaccucaacaagaagguggaugacggcuuucuggauauuuggacauacaaugcggagcuucugguccuccuggaaaacgagcgcacccuugacuuccacgacuccaaugugaaaaaccuguaugaaaaggucaaaagccaacucaagaauaacgccaaagagaucgggaauggcugcuuugaguucuaccauaaguguaacgaugaaugcauggagucugugaagaauggaacguaugacuaccccaaauauuccgaagagagcaagcugaacagagagaaaauugauggcguuaagcuggaaucuauggggguguaccagauccucgcuauuuauuccacagucgccagcucccuggugcuucugguuucucucggagccaucagcuuuuggaugugcuccaauggcucucugcagugucggaucugcauuuga

SEQ ID NO: 194258 - RNA, 1698 nt, Artificial Sequence; identical to SEQ ID NO: 184969
  derived and/or modified sequence opt5 from hemagglutinin__InfluenzaA__AHL89654

SEQ ID NO: 194259 - RNA, 1698 nt, Artificial Sequence
  derived and/or modified sequence opt5 from hemagglutinin__InfluenzaA__AHL89666
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauaaccacaaugggaaacuuugccugcucaagggaaucgcgccccugcagcugggcaacuguucuguugcuggguggauucucggaaauccugagugcgaacugcuuaucagcaaagaguccuggucuuacauuguggaaaccccgaaccccgagaauggcacguguuauccuggguacuuugccgacuaugaggaacugagagagcaacucagcuccgucucuagcuucgaacgguuugagaucuuccccaaggaguccagcuggccuaaccauaccgugacaggaguuucugccuccugcagccacaauggcaagucuuccuuuuaccgcaaccugcuuuggcugaccggcaaaaaugggcucuaucccaaccugagcaagucuuacgcuaauaacaaagaaaaggaggugcugguccucuggggagugcaucacccuccgaacaucggcgaucagagagcccuguaccacacagaaaaugcuuauguguccgucguuagcucccauuacucucggcgcuucacccccgagauugccaaaagaccuaaggugcgggaccaggaagggcgcaucaacuauuacuggacgcuucuggagcccggagauacaauuaucuuugaggcgaauggcaaccucauugccccuagauucgcuuuugcccugagccggggguucggauccggcaucauuaccagcaaugcucccaugggcgaaugugacgccaagugccagacaccgcaaggggcgaucaacucuucccuuccuuuucagaaugugcaccccgucaccaucggagaguguccuaaauaugugcgcagcgccaagcugagaaugguuaccggccuccggaacauucccucuauccagagccgcgggcuguucggagcuauugccggcuuuaucgaagggggauggacaggcaugguggauggcugguacggguaucaucaccagaaugagcaaggauccggcuacgcugccgaccagaaaucuacgcagaacgccauuaaugggaucaccaacaaggucaauagcgugaucgaaaagaugaacacacaguucaccgcuguuggaaaagaguucaauaaacuggagagacggauggaaaaccucaacaagaagguggaugacggcuuucuggauauuuggacauacaaugcggagcuucugguccuccuggaaaacgagcgcacccuugacuuccacgacuccaaugugaaaaaccuguaugaaaaggucaaaagccaacucaagaauaacgccgaggagaucgggaauggcugcuuugaguucuaccauaaauguaacgaugaaugcauggaaucugugaagaauggaacguaugacuaccccaaguauuccgaggagagcaaacugaacagagaaaagauugauggcguuaaacuggagucuauggggguguaccagauccucgcuauuuauuccacagucgccagcucccuggugcuucugguuucucucggagccaucagcuuuuggaugugcuccaauggcucucugcagugucggaucugcauuuga

SEQ ID NO: 194260 - RNA, 1698 nt, Artificial Sequence
  derived and/or modified sequence opt5 from hemagglutinin__InfluenzaA__AHL89678
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucuggagcccggagauacaauuaucuuugaggcgaacggcaaucucauugccccuagauucgcuuuugcccugucccggggguucggaagcggcaucauuaccucuaacgcucccaugggcgaaugugacgccaagugccagacaccgcaaggggcgaucaauuccagccuuccuuuucagaacgugcaccccgucaccaucggagaguguccuaaauaugugcgcucugccaagcugagaaugguuaccggccuccggaauauucccagcauccagucccgcgggcuguucggagcuauugccggcuuuaucgaagggggauggacaggcaugguggauggcugguacggguaucaucaccagaacgagcaaggaucuggcuacgcugccgaccagaaaagcacgcagaaugccauuaacgggaucaccaauaaggucaacuccgugaucgaaaagaugaauacacaguucaccgcuguuggaaaagaguucaacaaacuggagagacggauggaaaaucucaacaagaagguggaugacggcuuucuggauauuuggacauacaacgcggagcuucugguccuccuggaaaaugagcgcacccuugacuuccacgacagcaacgugaaaaaucuguaugaaaaggucaaaucucaacucaagaacaaugccaaagagaucgggaacggcugcuuugaguucuaccauaaguguaaugaugaaugcauggaguccgugaagaacggaacguaugacuaccccaaauauagcgaagagucuaagcugaaucggaaaaagauugauggcguuaaacuggaguccauggggguguaccagauccucgcuauuuauagcacagucgccuccucucuggugcuucugguuagccucggagccaucuccuuuuggaugugcucuaacggcagccugcaguguagaaucugcauuuga

SEQ ID NO: 194261 - RNA, 1698 nt, Artificial Sequence
  derived and/or modified sequence opt5 from hemagglutinin__InfluenzaA__AHL89690
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaagccggaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcaaauccagcuuuuauaagaaccugcuuuggcugacaggcaaaaaugggcucuaccccaaccugucuaaguccuaugcuaauaacaaagaaaaggaggugcugguccucuggggagugcaccacccuccgaauaucggcgaccagaaggcccuguaccauaccgaaaacgcuuacgugagcgucguuuccucucacuauagccgcaaauucacacccgagauugccaagagaccuaaagugcgggaucaggaagggcgcaucaacuacuauuggacccuucuggagcccggagacacgauuaucuuugaggcgaauggcaaccucauugccccuagauacgcuuucgcccugucccggggguuuggaagcggcaucauuaauucuaacgcucccauggauaagugugacgccaaaugccagacaccgcaaggcgcgaucaauuccagccuuccuuuccagaacgugcaucccgucaccaucggggaauguccuaaguaugugcgcucugccaaacugagaaugguuacaggacuccggaauauucccagcauccagucccgcggccuguuuggggcuauugccggauucaucgagggcggguggaccggaaugguggauggcugguacggcuaucaccaccagaacgaacaagggucuggauacgcugccgaccaaaagagcacccagaaugccauuaacggcaucacaaauaaggucaacuccgugaucgagaaaaugaauacgcaguuuaccgcuguugggaaggaguucaacaaacuggaaagacggauggagaaucucaacaagaaaguggaugacggauucauugacaucuggacauacaacgcggaacugcuuguccugcucgagaaugaacgcacccuggauuuucaugacagcaacgugaagaaucuuuaugagaaggucaaaucucagcugaagaacaaugccaaagaaauuggcaacgggugcuucgaguuuuaccacaaguguaaugaugagugcauggaauccgugaaaaacggcacauaugacuaccccaaguauagcgaggaaucuaagcucaauagagagaaaaucgauggaguuaagcuggaguccaugggcguguaccagauucuggcuaucuauagcaccgucgccuccucucucgugcugcuuguuagccugggggccaucuccuucuggaugugcucuaacggaagccuccagugucggauuugcaucuga

SEQ ID NO: 194262 - RNA, 1698 nt, Artificial Sequence; identical to SEQ ID NO: 184969
  derived and/or modified sequence opt5 from hemagglutinin__InfluenzaA__AHL89702

SEQ ID NO: 194263 - RNA, 1698 nt, Artificial Sequence; identical to SEQ ID NO: 184938
  derived and/or modified sequence opt5 from hemagglutinin__InfluenzaA__AHL89714

SEQ ID NO: 194264 - RNA, 1698 nt, Artificial Sequence
  derived and/or modified sequence opt5 from hemagglutinin__InfluenzaA__AHL89726
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagaaagcccuguaccacacagaaaacgcuuaugugagcgucguuuccucucauuacagcagacgguucacccccgagauugccaagcgcccuaaggugagagaccaggaagggcggaucaauuauuacuggacgcuucuggagcccggagauacaauuaucuuugaggcgaacggcaaucucauugccccucgcuucgcuuuugcccuguccagaggguucggaagcggcaucauuaccucuaacgcucccauggacgaaugugaugccaaaugccagacaccgcaaggcgcgaucaauuccagccuuccuuuucagaacgugcaccccgucaccaucggggaguguccuaaguaugugcggucuaccaaacugcgcaugguuacaggacucagaaauauucccagcauccagucccggggccuguucggggccauugcuggauuuaucgaaggcggguggacgggaaugguggacggcugguacggcuaucaucaccagaacgagcaagggucuggauacgccgcugaucaaaagagcacccagaaugccauuaacggcaucacaaauaaagucaacuccgugaucgaaaagaugaauacccaguucacagccguugggaaagaguucaacaagcuggagcgcagaauggaaaaucucaacaagaaaguggacgauggauuucuggacauuuggaccuacaacgcugagcuucugguccuccuggaaaaugagcggacgcuugacuuccacgauagcaacgugaagaaucuguaugaaaaagucaagucucagcucaaaaacaaugcgaaggagaucggcaacgggugcuuugaguucuaccauaaguguaaugacgaaugcauggaguccgugaaaaacggcacauaugauuaccccaaguauagcgaagagucuaaacugaaucgcgagaagauugacggaguuaaacuggaauccaugggcguguaccagauccucgccauuuauagcaccgucgcuuccucucuggugcuucugguuagccucggggccaucuccuuuuggaugugcucuaacggaagccugcaguguagaaucugcauuuga

SEQ ID NO: 194265 - RNA, 1698 nt, Artificial Sequence
  derived and/or modified sequence opt5 from hemagglutinin__InfluenzaA__AHL89750
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucuggagcccggagauacaauuaucuuugaggcgaacggcaaucucauugccccuagauucgcuuuugcccugucccggggguucggaagcggcaucauuaccucuaacgcucccauggacggcugugaugccaagugccagacaccgcaaggggcgaucaauuccagccuuccuuuucagaacgugcaccccgucaccaucggagaauguccuaaauaugugcgcucuaccaagcugagaaugguuacaggccuccggaauauucccagcauccagucccgcgggcuguucggagccauugcuggcuuuaucgaagggggauggacgggcaugguggacggcugguacggguaucaucaccagaacgaacaaggaucuggcuacgccgcugaucagaaaagcacccagaaugccauuaacgggaucacaaauaaggucaacuccgugaucgagaaaaugaauacccaguucacagccguuggaaaggaguucaacaaacuggagagacggauggagaaucucaacaagaagguggacgauggcuuucuggacauuuggaccuacaacgcugaacuucugguccuccuggagaaugaacgcacgcuugacuuccacgauagcaacgugaaaaaucuguaugagaaggucaaaucucaacucaagaacaaugcgaaagaaaucgggaacggcugcuuugaguucuaccauaaguguaaugacgagugcauggaauccgugaagaacggaacauaugauuaccccaaauauagcgaggaaucuaagcugaauagagagaaaauugacggcguuaagcuggaguccauggggguguaccagauccucgccauuuauagcaccgucgcuuccucucuggugcuucugguuagccucggagccaucuccuuuuggaugugcucuaacggcagccugcagugucggaucugcauuuga

SEQ ID NO: 194266 - RNA, 1698 nt, Artificial Sequence; identical to SEQ ID NO: 184934
  derived and/or modified sequence opt5 from hemagglutinin__InfluenzaA__AHL89762

SEQ ID NO: 194267 - RNA, 1698 nt, Artificial Sequence; identical to SEQ ID NO: 184980
  derived and/or modified sequence opt5 from hemagglutinin__InfluenzaA__AHL89774

SEQ ID NO: 194268 - RNA, 1698 nt, Artificial Sequence; identical to SEQ ID NO: 184969
  derived and/or modified sequence opt5 from hemagglutinin__InfluenzaA__AHL89786

SEQ ID NO: 194269 - RNA, 1698 nt, Artificial Sequence
  derived and/or modified sequence opt5 from hemagglutinin__InfluenzaA__AHL89798
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauagacacaacgggaaacuuugccugcucaagggaaucgcgccccugcagcugggcaauuguucuguugcuggguggauucucggaaacccugagugcgaacugcuuaucagcaaagaguccuggucuuacauuguggaaaccccgaaucccgagaacggcacguguuauccuggguacuuugccgacuaugaggaacugcgggagcaacucagcuccgucucuagcuucgaacgcuuugagaucuuccccaaggaguccagcuggccuaaucauaccgugacaggaguuucugccuccugcagccacaacggcaagucuuccuuuuacagaaaucugcuuuggcugaccggcaaaaacgggcucuaucccaaucugagccggucuuacgcuaacaauaaggaaaaagaggugcugguccucuggggagugcaucacccuccguccaucggcgaucagcgcgcccuguaccacacagaaaacgcuuaugugagcgucguuuccucucauuacagcagacgguucacccccgagauugccaagcgcccuaaagugagagaccaggaagggcggaucaacuauuacuggacgcuucuggagcccggagauacaauuaucuuugaggcgaauggcaaccucauugccccucgcuucgcuuuugcccuguccagaggguucggaagcggcaucauuaccucuaaugcucccauggacgaaugugaugccaagugccagacaccgcaaggcgcgaucaacuccagccuuccuuuucagaaugugcaccccgucaccaucggggaguguccuaaguaugugcggucugccaaacugcgcaugguuaccggacucagaaacauucccagcauccagucccggggccuguucggggcuauugccggauuuaucgaaggcggguggacaggaaugguggacggcugguacggcuaucaucaccagaaugagcaagggucuggauacgcugccgaucaaaagagcacgcagaacgccauuaauggcaucaccaacaaagucaauuccgugaucgaaaagaugaacacacaguucaccgcuguugggaaagaguucaauaagcuggagcgcagaauggaaaaccucaauaaaaagguggacgauggauuucuggacauuuggacauacaacgcggagcuucugguccuccuggaaaacgagcggacccuugacuuccacgauagcaaugugaagaaccuguaugaaaaagucaagucucagcucaaaaauaacgccaaggagaucggcaaugggugcuuugaguucuaccauaaauguaacgacgaaugcauggaguccgugaagaauggcacguaugauuaccccaaguauagcgaagagucuaaacugaacagagagaagauugacggaguuaaacuggaauccaugggcguguaccagauccucgcuauuuauagcacagucgccuccucucuggugcuucugguuagccucggggccaucuccuuuuggaugugcucuaauggaagccugcagugucgcaucugcauuuga

SEQ ID NO: 194270 - RNA, 1698 nt, Artificial Sequence
  derived and/or modified sequence opt5 from hemagglutinin__InfluenzaA__AHL89810
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucuggagcccggagauacaauuaucuuugaggcgaacggcaaucucauugccccuagauucgcuuuugcccugucccggggguucggaagcggcaucauuaccucuaacgcucccaugggcgaaugugacgccgagugccagacaccgcaaggggcgaucaauuccagccuuccuuuucagaacgugcaccccgucaccaucggagaauguccuaaguaugugcgcucugccaaacugagaaugguuaccggccuccggaauauucccagcauccagucccgcgggcuguucggagcuauugccggcuuuaucgaagggggauggacaggcaugguggauggcugguacggguaucaucaccagaacgaacaaggaucuggcuacgcugccgaccaaaagagcacgcagaaugccauuaacgggaucaccaauaaagucaacuccgugaucgagaagaugaauacacaguucaccgcuguuggaaaagaguucaacaagcuggaaagacggauggagaaucucaacaaaaagguggaugacggcuuucuggauauuuggacauacaacgcggaacuucugguccuccuggagaaugaacgcacccuugacuuccacgacagcaacgugaagaaucuguaugagaaagucaagucucagcucaaaaacaaugccaaggagaucgggaacggcugcuuugaguucuaccauaaauguaaugaugagugcauggaauccgugaagaacggaacguaugacuaccccaaguauagcgaggagucuaaacugaauagagaaaagauugauggcguuaaacuggaguccauggggguguaccagauccucgcuauuuauagcacagucgccuccucucuggugcuucugguuagccucggagccaucuccuuuuggaugugcucuaacggcagccugcagugucggaucugcauuuga

SEQ ID NO: 194271 - RNA, 1698 nt, Artificial Sequence
  derived and/or modified sequence opt5 from hemagglutinin__InfluenzaA__AHL89822
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauagacacaacgggaaacuuugccugcucaagggaaucgcgccccugcagcugggcaauuguucuguugcuggguggauucucggaaacccugagugcgaacugcuuaucagcaaagaguccuggucuuacauuguggaaaccccgaaucccgagaacggcacguguuauccuggguacuuugccgacuaugaggaacugcgggagcaacucagcuccgucucuagcuucgaacgcuuugagaucuuccccaaggaguccagcuggccuaaucauaccgugacaggaguuucugccuccugcagccacaacggcaagucuuccuuuuacagaaaucugcuuuggcugaccggcaaaaacgggcucuaucccaaucugagcaagucuuacgcuaacaauaaagaaaaggaggugcugguccucuggggagugcaucacccuccgaacaucggcgaucagcgggcccuguaccacacagaaaacgcuuauguguccgucguuagcucccauuacucucgcagauucacccccgagauugccaaacggccuaaggugcgcgaccaggaagggagaaucaauuauuacuggacgcuucuggagcccggagauacaauuaucuuugaggcgaacggcaaucucauugccccucgguucgcuuuugcccugagccgcggguucggauccggcaucauuaccagcaacgcucccauggacgaaugugaugccaagugccagacaccgcaaggcgcgaucaauucuucccuuccuuuucagaacgugcaccccgucaccaucggggaguguccuaaauaugugagaagcgccaagcugcggaugguuaccggacuccgcaauauucccucuauccagagcagaggccuguucggggcuauugccggauuuaucgaaggcggguggacaggaaugguggacggcugguacggcuaucaucaccagaacgagcaaggguccggauacgcugccgaucagaaaucuacgcagaaugccauuaacggcaucaccaauaaggucaacagcgugaucgaaaagaugaauacacaguucaccgcuguugggaaagaguucaacaaacuggagcggcgcauggaaaaucucaacaagaagguggacgauggauuucuggacauuuggacauacaacgcggagcuucugguccuccuggaaaaugagagaacccuugacuuccacgauuccaacgugaaaaaucuguaugaaaaggucaaaagccaacucaagaacaaugccaaagagaucggcaacgggugcuuugaguucuaccauaaguguaaugacgaaugcauggagucugugaagaacggcacguaugauuaccccaaauauuccgaagagagcaagcugaaucgggagaaaauugacggaguuaagcuggaaucuaugggcguguaccagauccucgcuauuuauuccacagucgccagcucccuggugcuucugguuucucucggggccaucagcuuuuggaugugcuccaacggaucucugcaguguagaaucugcauuuga

SEQ ID NO: 194272 - RNA, 1698 nt, Artificial Sequence
  derived and/or modified sequence opt5 from hemagglutinin__InfluenzaA__AHL89834
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccugggaauuuugccgacuacgaggaacugagagagcaacucuccucugucagcuccuucgaacgguuugagaucuuccccaaggagagcucuuggccuaaccauaccgugacaggaguuuccgccagcugcucucacaauggcaaguccagcuuuuaucgcaaccugcuuuggcugaccggcaaaaaugggcucuaccccaaccugucuaaguccuaugcuaauaacaaagaaaaggaggugcugguccucuggggagugcaucacccuccgaacaucggcgaucagagagcccuguaccacacagaaaaugcuuacgugagcgucguuuccucucauuauagccggcgcuucacccccgagauugccaaaagaccuaaggugcgggaccaggaagggcgcaucaacuacuauuggacgcuucuggagcccggagauacaauuaucuuugaggcgaauggcaaccucauugccccuagauucgcuuuugcccugucccggggguucggaagcggcaucauuaccucuaaugcucccauggacgaaugugaugccaagugccagacaccgcaaggcgcgaucaacuccagccuuccuuuucagaaugugcaccccgucaccaucggggaguguccuaaauacgugcgcucugccaagcugagaaugguuaccggacuccggaacauucccagcauccagucccgcggccuguucggggcuauugccggauuuaucgaaggcggguggacaggaaugguggacggcugguauggcuaccaucaccagaaugagcaagggucuggauaugcugccgaucagaaaagcacgcagaacgccauuaauggcaucaccaacaaggucaauuccgugaucgaaaagaugaacacacaguucaccgcuguugggaaagaguucaauaaacuggagagacggauggaaaaccucaacaagaagguggacgauggauuucuggacauuuggacauacaaugcggagcuucugguccuccuggaaaacgagcgcacccuugacuuccacgauagcaaugugaaaaaccuguacgaaaaggucaaaucucaacucaagaauaacgccaaagagaucggcgacgggugcuuugaguucuaucauaaguguaaugaugaaugcauggaguccgugaagaacggcacguacgacuaucccaaauacagcgaagagucuaagcugaauagagagaaaauugauggaguuaagcuggaauccaugggcguguaucagauccucgcuauuuacagcacagucgccuccucucuggugcuucugguuagccucggggccaucuccuuuuggaugugcucuaacggaagccugcagugucggaucugcauuuga

SEQ ID NO: 194273 - RNA, 1698 nt, Artificial Sequence; identical to SEQ ID NO: 184980
  derived and/or modified sequence opt5 from hemagglutinin__InfluenzaA__AHL89846

SEQ ID NO: 194274 - RNA, 1701 nt, Artificial Sequence; identical to SEQ ID NO: 184952
  derived and/or modified sequence opt5 from hemagglutinin__InfluenzaA__AHL89858

SEQ ID NO: 194275 - RNA, 1701 nt, Artificial Sequence; identical to SEQ ID NO: 184952
  derived and/or modified sequence opt5 from hemagglutinin__InfluenzaA__AHL89870

SEQ ID NO: 194276 - RNA, 1701 nt, Artificial Sequence
  derived and/or modified sequence opt5 from hemagglutinin__InfluenzaA__AHL89882
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcgggucugacaacuccuuuuucagcagacugaauuggcucacacaucugaaguuuaaauauccugcccuuaacgucaccaugcccaauaacgagaaguucgauaaacuguacaucuggggagugcaccauccuggcacggacaacgaucagauuuuucucuaugcgcaggccucugggcggaucacaguuuccaccaagcgcagccaacagacagugauuccgaauaucggauccagaccccggguccgcaacauuccuucuagaaucagcaucuacuggaccauugugaaacccggcgacauccugcugauuaauuccaccgggaaccucaucgcuccucggggauacuucaagauucgcagcggcaagucuuccaucaugagaagcgacgcccccaucggcaaauguaauucugagugcauuacaccgaacgggagcaucccuaaugauaagcccuuucagaacgugaaucggauuacguauggagcuuguccucgcuacgucaaacagaacacccugaaacuugccacaggcaugagaaauguucccgaaaagcaaacccgggggaucuucggagcgauugccggcuuuaucgagaacgggugggaaggaaugguggacggcugguauggcuuccgccaccaaaauuccgaggggaucggacaggcugccgaucugaagucuacacaggcugccauuaaccagaucaauggcaaacucaacagacugauugggaagaccaacgagaaguuccaccagaucgaaaaagaguuuagcgaaguggagggacggauucaggaccuugaaaaguacgucgaggauacgaaaaucgaccugugguccuauaaugccgagcuccugguggcucuggaaaaccaacauacaauugaucucaccgacagcgagaugaauaagcuguucgaaagaaccaaaaagcagcuucgcgagaacgcggaagauaugggcaaugggugcuuuaagaucuaccacaaaugugacaacgccugcaucggcucuauucggaauggaacauaugaucaugacguuuacagagacgaggcucugaacaaucgcuuccagaucaagggcguggagcucaaauccggguacaaggauuggauucuguggaucagcuuugccauuucuugcuuccuucugugugucgcccuccugggauuuaucaugugggcuugccagaaaggcaacauccgguguaauauuugcaucuga

SEQ ID NO: 194277 - RNA, 1701 nt, Artificial Sequence; identical to SEQ ID NO: 184952
  derived and/or modified sequence opt5 from hemagglutinin__InfluenzaA__AHL89894

SEQ ID NO: 194278 - RNA, 1701 nt, Artificial Sequence
  derived and/or modified sequence opt5 from hemagglutinin__InfluenzaA__AHL89906
augaagaccaucauugcccugagcuacauccucugccugguguaugcucagaaacuucccggcauugacaacuccacagccacgcugugucucgggcaccaugcggucccuaauggaaccaucguuaagacaauuaccaacgaucaaaucgaggugacaaaugcuaccgaacuggugcagucuagcuccacaggcgagaucugcgacucuccgcaccagauucuugauggggaaaacuguacccugaucgacgcccuccugggagauccccagugcgacggcuuccaaaauaaaaagugggaucuguuugucgagagaagcaaagccuacuccaacuguuauccuuacgacgugcccgauuaugcuucucuccggagccugguugccuccagcgggacgcuugaguucaauaacgaaucuuuuaauugggcuggagugacccagaacggcacauccagcgccugcaagcgcggcucuaauaacuccuucuuuagcagacugaauuggcucacccauucuaaguucaaauacccugcgcugaacgucacaaugcccaauaacgaggaauuugacaaacuuuauauuuggggagugcaccauccugggaccgauaacgaccagaucuuccuguacgcccaggcuuccggccggauuacgguuagcacaaaacgcucccaacagaccgugaucccgaauauugggucuagaccccggguccgcaacaucccuagcagaaucuccauuuacuggacaaucgugaagcccggagauauucuccugaucaauagcaccggcaaccugauugccccucggggguauuuuaaaauccgcucuggaaaguccagcaucaugagaucugacgcucccauuggcaaguguaauagcgagugcaucaccccgaacggcuccauuccuaaugacaaacccuuccagaacgugaaucggaucacauacggggccuguccucgcuaugucagacagaacacgcucaagcuggcgaccggaaugcggaauguucccgaaaaacaaacacgcggcauuuuuggggccaucgcuggauucaucgagaacggcugggaggggaugguggauggaugguacggcuuuagacaccagaauagcgaaggcauugggcaggccgcugaccuuaagagcacccaagccgccaucgaucagauuaacggaaaacugaaucggcucaucggcaagacaaacgagaaauuccaccagauugaaaaggaguucuccgaaguggaggggagaauccaggaccuggagaaguaugucgaagauaccaaaauugaccuuuggagcuacaacgcugagcugcucguggcgcuggaaaaucaacauacgaucgaucugacagacucugagaugaacaagcucuuugaaaagaccaagaaacagcugcgcgagaaugccgaggauaugggaaacggcugcuucaagaucuaucacaagugugacaaugcuugcauuggguccauccggaacggcaccuacgaucaugacguuuacagagacgaagcccuuaauaaccgcuuucagauuaaaggaguggagcugaagucuggcuauaaagauuggauccucuggauuucuuucgccaucuccugcuuucugcuuugugucgcucugcucggguucaucaugugggccugccagaagggaaauauucgguguaacaucugcauuuga

SEQ ID NO: 194279 - RNA, 1701 nt, Artificial Sequence
  derived and/or modified sequence opt5 from hemagglutinin__InfluenzaA__AHL89918
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgacaagcuguacauuuggggcgugcaccauccugggacggauaaugaccagacauuucucuaugcgcaggccucuggacgcaucaccguuuccacaaaaagaagccaacagaccgugauuccgaacaucggcucccggccccgcgucagaaauauuccuucucggaucagcaucuacuggaccauugugaagcccggggauauccugcugauuaacuccacaggaaaucucaucgcuccucgcggcuacuucaaaauucagagcgggaagucuuccaucaugagaagcgacgcccccaucggaaaguguaacucugaaugcauuacgccgaauggcagcaucccuaacgacaaacccuuucagaaugugaaccggauuaccuauggcgcuuguccucgcuacgucaagcaaaauacacugaaacuugccaccgggaugagaaacguucccgagaagcagacacggggaaucuucggcgcgauugccggguuuaucgaaaauggaugggagggcaugguggaugggugguauggauuccgccaccagaacuccgagggcaucggccaagcugccgaccugaaaucuacccaggcugccauugaucagaucaaugggaagcucaacagacugauuggaaaaacgaacgaaaaguuccaccagaucgagaaggaauuuagcgagguggaaggccggauucaagaccuugagaaauacgucgaggauacaaagaucgaccugugguccuauaaugccgaacuccugguggcucuggagaaccagcauaccauugaucucaccgacagcgaaaugaauaaacuguucgagaagaccaaaaagcagcuuagagaaaacgcggaggauauggggaauggaugcuuuaagaucuaccacaaaugugacaacgccugcaucggcucuauucgcaaugggacauaugaucaugacguuuaccgggacgaggcucugaacaauagauuccagaucaagggcguggaacucaaauccggauacaaggauuggauucuguggaucagcuuugccauuucuugcuuccuucugugugucgcccuccugggcuuuaucaugugggcuugccaaaaagggaacauccgcuguaauauuugcaucuga

SEQ ID NO: 194280 - RNA, 1701 nt, Artificial Sequence
  derived and/or modified sequence opt5 from hemagglutinin__InfluenzaA__AHL89930
augaagaccaucauugcccugagcuacauccucugccugguguucgcucagaaacuucccggcauugacaacuccacagccacgcugugucucgggcaccaugcggucccuaauggaaccaucguuaagacaauuaccaacgaucaaaucgaggugacaaaugcuaccgaacuggugcagucuagcuccacaggcgggaucugcgacucuccgcaccagauucuugauggagagaacuguacccugaucgacgcccuccugggcgauccccagugcgacggguuucaaaauaaaaagugggaucuguucgucgaaagaagcaaagccuauuccaacuguuacccuuaugacgugcccgauuacgcuucucuccggagccugguugccuccagcggaacgcuugaguuuaauaacgaaucuuucaauugggcuggcgugacccagaacggcacauccagcgccugcaagcgcgggucuaauaacuccuuuuucagcagacugaauuggcucacccauucuaaguuuaaauauccugcgcugaacgucacaaugcccaauaacgaggaguucgacaaacuuuacauuuggggagugcaccauccuggcaccgauaacgaccagaucuuucuguaugcccaggcuuccgggcggauuacgguuagcacaaagcgcucccaacagaccgugaucccgaauauuggaucuagaccccggguccgcaacaucccuagcagaaucuccauuuacuggacaaucgugaagcccggcgauauucuccugaucaauagcaccgggaaccugauugccccucggggauacuucaaaauccgcucuggcaaguccagcaucaugagaucugacgcucccauuagcaaguguaauuccgaaugcaucaccccgaacggcucuauuccuaaugacaaacccuuucagaacgugaaucggaucacauauggggccuguccucgcuacgucaagcagaacacgcucaaacuggcgaccggaaugagaaauguucccgagaagcaaacacggggcauuuucggggccaucgcuggauuuaucgaaaacggcugggaggggaugguggauggaugguauggcuuccgccaccagaauagcgagggcauggggcaggccgcugaccuuaaauccacccaagccgccauugaucagaucaacggaaagcugaauagacucauuggcaaaacaaacgaaaaguuccaccagaucgagaaggaauuuagcgagguggaagggcggauucaggaccuggagaaauacgucgaggauaccaagaucgaccuuuggucuuauaacgcugaacugcucguggcgcuggagaaucaacauacgauugaucugacagacuccgaaaugaacaaacucuucgagaagaccaaaaagcagcugagagaaaaugccgaggauaugggaaacggcugcuuuaagaucuaccacaaaugugacaaugcuugcaucgggagcauucgcaacggcaccuaugaucaugacguuuaccgggacgaggcccuuaauaacagauuccagaucaagggaguggaacugaaaucuggcuacaaggauuggauucucuggaucuccuuugccauuagcugcuuccugcuuugugucgcucugcucggguuuaucaugugggccugccagaaaggaaauauccgcuguaacauuugcaucuga

SEQ ID NO: 194281 - RNA, 1701 nt, Artificial Sequence; identical to SEQ ID NO: 184939
  derived and/or modified sequence opt5 from hemagglutinin__InfluenzaA__AHL89942

SEQ ID NO: 194282 - RNA, 1701 nt, Artificial Sequence
  derived and/or modified sequence opt5 from hemagglutinin__InfluenzaA__AHL89954
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgaucaugcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaccugaaguuuaaguacccugcccuuaaugucaccaugcccaacaacgagaaauucgacaagcuguauauuuggggcgugcaucacccugggacggauaaugaccagaucuuucucuacgcgcaggccucuggacgcauuacaguuuccaccaaaagaagccaacagacagugaucccgaacauuggcucccggccccgcgucagaaauaucccuucucggaucagcauuuauuggaccaucgugaagcccggggauauucugcugaucaacuccaccggaaaucucauugcuccucgcggcuacuucaaaaucagaagcgggaagucuuccaucaugcggagcgacgcccccauuggaaaguguaacucugaaugcaucacaccgaauggcagcauuccuaacgacaaacccuuucagaaugugaaccgcaucacguacggcgcuuguccuagauaugucaagcagaauacccugaaacuugccacagggaugcggaacguucccgagaagcaaacccgcggaauuuucggcgcgaucgccggguuuaucgaaaauggaugggagggcaugguggaugggugguacggauucagacaccagaacuccgagggcauuggccaggcugccgaccugaaaucuacacaagcugccaucgaucagauuaaugggaagcucaaccggcugaucggaaaaaccaacgaaaaguuccaucagauugagaaggaauuuagcgagguggaaggcagaauccaggaccuugagaaauaugucgaggauacgaagauugaccugugguccuacaaugccgaacuccugguggcucuggagaaccaacacacaaucgaucucaccgacagcgaaaugaauaaacuguucgagaagaccaaaaagcagcuucgcgaaaacgcggaggauauggggaauggaugcuuuaagaucuaucauaaaugugacaacgccugcauuggcucuauccggaaugggacauacgaucacgacguuuauagagacgaggcucugaacaaucgcuuccagauuaagggcguggaacucaaauccggauacaaggauuggauccuguggauuagcuuugccaucucuugcuuccuucugugugucgcccuccugggcuuuaucaugugggcuugccagaaagggaacauucgguguaauaucugcauuuga

SEQ ID NO: 194283 - RNA, 1701 nt, Artificial Sequence; identical to SEQ ID NO: 184952
  derived and/or modified sequence opt5 from hemagglutinin__InfluenzaA__AHL89966

SEQ ID NO: 194284 - RNA, 1701 nt, Artificial Sequence; identical to SEQ ID NO: 184952
  derived and/or modified sequence opt5 from hemagglutinin__InfluenzaA__AHL89978

SEQ ID NO: 194285 - RNA, 1701 nt, Artificial Sequence; identical to SEQ ID NO: 185011
  derived and/or modified sequence opt5 from hemagglutinin__InfluenzaA__AHL89990

SEQ ID NO: 194286 - RNA, 1701 nt, Artificial Sequence
  derived and/or modified sequence opt5 from hemagglutinin__InfluenzaA__AHL90002
augaagaccaucauugcccugagcuacauccucugccugguguucgcucagaaacuucccggcauugacaacuccacagccacgcugugucucgggcaccaugcggucccuaauggaaccaucguuaagacaauuaccaacgaucaaaucgaggugacaaaugcuaccgaacuggugcagucuagcuccacaggcgggaucugcgacucuccgcaccagauucuugauggagagaacuguacccugaucgacgcccuccugggcgauccccagugcgacggguuucaaaauaaaaagugggaucuguucgucgaaagaagcaaagccuauuccaacuguuacccuuaugacgugcccgauuacgcuucucuccggagccugguugccuccagcggaacgcuugaguuuaauaacgaaucuuucaauugggcuggcgugacccagaacggcacauccagcgccugcaagcgcgggucuaauaacuccuuuuucagcagacugaauuggcucacccauucuaaguuuaaauauccugcgcugaacgucacaaugcccaauaacgaggaguucgacaaacuuuacauuuggggagugcaccauccuggcaccgauaacgaccagaucuuucuguaugcccaggcuuccgggcggauuacgguuagcacaaagcgcucccaacagaccgugaucccgaauauuggaucuagaccccggguccgcaacaucccuagcagaaucuccauuuacuggacaaucgugaagcccggcgauauucuccugaucaauagcaccgggaaccugauugccccucggggauacuucaaaauccgcucuggcaaguccagcaucaugagaucugacgcucccauuggcaaguguaauagcgaaugcaucaccccgaacggguccauuccuaaugacaaacccuuucagaacgugaaucggaucacauauggagccuguccucgcuacgucaagcagaacacgcucaaacuggcgaccggcaugagaaauguucccgagaagcaaacacgggggauuuucggagccaucgcuggcuuuaucgaaaacgggugggagggaaugguggauggcugguauggcuuccgccaccaaaauucugaggggaugggacaggccgcugaccuuaaaagcacccaggccgccauugaucagaucaacggcaagcugaauagacucauugggaaaacaaacgaaaaguuccaccagaucgagaaggaauuuuccgagguggaaggacggauucaggaccuggagaaauacgucgaggauaccaagaucgaccuuuggagcuauaacgcugaacugcucguggcgcuggagaaucaacauacgauugaucugacagacucugaaaugaacaaacucuucgagaagaccaaaaagcagcugagagaaaaugccgaggauaugggcaacgggugcuuuaagaucuaccacaaaugugacaaugcuugcaucggcuccauucgcaacggaaccuaugaucaugacguuuaccgggacgaggcccuuaauaacagauuccagaucaagggcguggaacugaaaagcggguacaaggauuggauucucuggaucucuuuugccauuuccugcuuccugcuuugugucgcucugcucggauuuaucaugugggccugccagaaaggcaauauccgcuguaacauuugcaucuga

SEQ ID NO: 194287 - RNA, 1701 nt, Artificial Sequence
  derived and/or modified sequence opt5 from hemagglutinin__InfluenzaA__AHL90014
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaguggaggugacaaacgcuaccgaacugguccagucuagcuccacaggcgagauuugcgacucuccgcaccagauccuugauggggaaaauuguacccugaucgacgcccuccugggagauccccagugcgacggcuuucaaaacaaaaagugggaucuguucguggagagaagcaaagccuauuccaauuguuacccuuaugacguucccgauuacgcuucucuccggagccugguggccuccagcgggacgcuugaauuuaacaaugagucuuucaacuggaccggagucacacagaauggcaccuccagcgcuugcauucgcagaucuaacaauuccuuuuucagccggcugaacuggcucacacaucugaaguuuaaguauccugcccuuaaugugaccaugcccaacaacgagaaauucgacaagcuguacaucuggggcguucaccauccugggacggauaaugaccagauuuuucucuaugcgcaggccucuggacgcaucacaguguccaccaaaagaagccaacagacagucauuccgaacaucggcucccggccccgcgugagaaauauuccuucucggaucagcaucuacuggaccauugugaagcccggggauauccugcugauuaacuccaccggaaaucucaucgcuccucgcggcuacuucaaaauuagaagcgggaagucuuccaucaugcggagcgacgcccccaucggaaaguguaacucugaaugcauuacaccgaauggcagcaucccuaacgacaaacccuuucagaaugucaaccgcauuacguauggcgcuuguccuagauacguuaagcagaauacccugaaacuugccacagggaugcggaacgugcccgagaagcaaacccgcggaaucuucggcgcgauugccggguuuaucgaaaauggaugggagggcaugguggaugggugguauggauucagacaccagaacuccgagggcaucggccaggcugccgaccugaaaucuacacaagcugccauugaucagaucaaugggaagcucaaccggcugauuggaaaaaccaacgaaaaguuccaccagaucgagaaggaauuuagcgaggucgaaggccgcauucaggaccuugagaaauacguggaggauacgaagaucgaccugugguccuauaaugccgaacuccugguugcucuggagaaccaacauacaauugaucucaccgacagcgaaaugaauaaacuguucgagaagaccaaaaagcagcuuagagaaaacgcggaggauauggggaauggaugcuuuaagaucuaccacaaaugugacaacgccugcaucggcucuauucggaaugggacauaugaucaugacguguacagagacgaggcucugaacaaucgcuuccagaucaagggcgucgaacucaaauccggauacaaggauuggauucuguggaucagcuuugccauuucuugcuuccuucuguguguggcccuccugggcuuuaucaugugggcuugccagaaagggaacauccgguguaauauuugcaucuga

SEQ ID NO: 194288 - RNA, 1701 nt, Artificial Sequence; identical to SEQ ID NO: 194287
  derived and/or modified sequence opt5 from hemagglutinin__InfluenzaA__AHL90026

SEQ ID NO: 194289 - RNA, 1701 nt, Artificial Sequence
  derived and/or modified sequence opt5 from hemagglutinin__InfluenzaA__AHL90050
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgacaagcuguacauuuggggcgugcaccauccugggacggauaaugaccagaucuuucucuaugcgcaggccucuggacgcauuacaguuuccaccaaaagaagccaacagacagugaucccgaacauuggcucccggccccgcgucagaaauaucccuucucggaucagcauuuacuggaccaucgugaagcccggggauauucugcugaucaacuccaccggaaaucucauugcuccucgcggcuacuucaaaaucagaagcgggaagucuuccaucaugcggagcgacgcccccauuggaaaguguaacucugaaugcaucacaccgaauggcagcauuccuaacgacaaacccuuucagaaugugaaccgcaucacguauggcgcuuguccuagauacgucaagcagaauacccugaaacuugccacagggaugcggaacguucccgagaagcaaacccgcggaauuuucggcgcgaucgccggguuuaucgaaaauggaugggagggcaugguggaugggugguauggauucagacaccagaacuccgagggcauuggccaggcugccgaccugaaaucuacacaagcugccaucgaucagauuaaugggaagcucaaccggcugaucggaaaaaccaacgaaaaguuccaccagauugagaaggaauuuagcgagguggaaggcagaauccaggaccuugagaaauacgucgaggauacgaagauugaccugugguccuauaaugccgaacuccugguggcucuggagaaccaacauacaaucgaucucaccgacgcggaaaugaauaaacuguucgagaagaccaaaaagcagcuucgcgaaaacgccgaggauauggggaauggaugcuuuaagaucuaccacaaaugugacaacgcuugcauuggcagcauccggaaugggacauaugaucaugacguuuacagagacgaggcccugaacaaucgcuuccagauuaagggcguggaacucaaaucuggauacaaggauuggauccuguggauuuccuuugccaucagcugcuuccuucugugugucgcucuccugggcuuuaucaugugggccugccagaaagggaacauucgguguaauaucugcauuuga

SEQ ID NO: 194290 - RNA, 1701 nt, Artificial Sequence
  derived and/or modified sequence opt5 from hemagglutinin__InfluenzaA__AHL90062
augaagaccaucauugcccugagcuacauccucugccugguguucgcucagaaacuucccgagaacgacaauuccacagccacgcugugucucggccaccaugcggucccuaacgggaccauuguuaagacaaucaccaaugaucaaauugaagugacaaacgcuaccgagcuggugcagucuagcuccacaggagaaaucugcgacucuccgcaccagauccuugauggcgagaauuguacccugauugacgcccuccugggggauccccagugcgacggauuucaaaacaaaaagugggaucuguucgucgaaagaagcaaagccuauuccaauuguuacccuuaugacgugcccgauuacgcuucucuccggagccugguugccuccagcggcacgcuugaguuuaacaaugagucuuucaacuggaccggggugacacagaauggaaccuccagcgcuugcauccgcagaucuaacaauuccuuuuucagccggcugaacuggcucacacaucugaaguuuaaguauccugcccuuaaugucaccaugcccaacaacgaaaaauucgacaagcuguacauuuggggcgugcaccauccuggcacggauaaugaccagaucuuucucuaugcgcaggccucugggcgcauuacaguuuccaccaaaagaagccaacagacagugaucccgaacauuggaucccggccccgcgucagaaauaucccuucucggaucagcauuuacuggaccaucgugaagcccggcgauauucugcugaucaacuccaccgggaaucucauugcuccucgcggauacuucaaaaucagaagcggcaagucuuccaucaugcggagcgacgcccccauugggaaguguaacucugagugcaucacaccgaauggaagcauuccuaacuauaaacccuuucagaaugugaaccgcaucacguacggcgcuuguccuagauaugucaagcagaauacccugaaacuugccacaggcaugcggaacguucccgaaaagcaaacccgcgggauuuucggagcgaucgccggcuuuaucgagaaugggugggagggaaugguggacggcugguacggguucagacaccagaacuccgaaggaauuggccaggcugccgaucugaaaucuacacaagcugccaucgaccagauuaauggcaagcucaaccggcugaucgggaaaaccaacgagaaguuccaccagauugaaaaggaguuuagcgaaguggagggaagaauccaggaucuugagaaauaugucgaagacacgaagauugaucugugguccuacaaugccgagcuccugguggcucuggaaaaccaacauacaaucgaccucaccgauagcgagaugaauaaacuguucgaaaagaccaaaaagcagcuucgcgagaacgcggaggacaugggcaaugggugcuuuaagaucuaucacaaaugugauaacgccugcauuggaucuauccggaauggcacauacgaccaugauguuuacagagacgaagcucugaacaaucgcuuccagauuaaggggguggagcucaaauccggcuauaaggacuggauccuguggauuagcuuugccaucucuugcuuccuucugugugucgcccuccugggauuuaucaugugggcuugccagaaaggcaacauucgguguaauaucugcauuuga

SEQ ID NO: 194291 - RNA, 1701 nt, Artificial Sequence; identical to SEQ ID NO: 184952
  derived and/or modified sequence opt5 from hemagglutinin__InfluenzaA__AHL90074

SEQ ID NO: 194292 - RNA, 1701 nt, Artificial Sequence
  derived and/or modified sequence opt5 from hemagglutinin__InfluenzaA__AHL90086
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagauauaacaauagcuuuuucucccggcugaacuggcucacacaucugaaguuuaaguacccugcccuuaaugucaccaugcccaacaacgagaaauucgacaagcuguauauuuggggcgugcaccauccugggacggauaaugaccagaucuuucucuacgcgcaggccagcggacgcauuacaguuucuaccaaaagaucccaacagacagugaucccgaacauuggcagccggccccgcgucagaaauaucccuucccggaucucuauuuacuggaccaucgugaagcccggggauauucugcugaucaacagcaccggaaaucucauugcuccucgcggcuauuucaaaaucagauccgggaagucuucuaucaugcgguccgacgcccccauuggaaaguguaacagcgaaugcaucacaccgaauggcucuauuccuaacgacaaacccuuucagaaugugaaccgcaucacguacggcgcuuguccuagauaugucaagcagaauacccugaaacuugccacagggaugcggaacguucccgagaagcaaacccgcggaauuuucggcgcgaucgccggguuuaucgaaaauggaugggagggcaugguggaugggugguacggauucagacaccagaacagcgagggcauuggccaggcugccgaccugaaauccacacaagcugccaucgaucagauuaaugggaagcucaaccggcugaucggaaaaaccaacgaaaaguuccaccagauugagaaggaauuuucugagguggaaggcagaauccaggaccuugagaaauaugucgaggauacgaagauugaccuguggagcuacaaugccgaacuccugguggcucuggagaaccaacauacaaucgaucucaccgacuccgaaaugaauaaacuguucgagaagaccaaaaagcagcuucgcgaaaacgcggaggauauggggaauggaugcuuuaagaucuaucacaaaugugacaacgccugcauuggcagcauccggaaugggacauacgaucaugacguuuacagagacgaggcucugaacaaucgcuuccagauuaagggcguggaacucaaaucuggauauaaggauuggauccuguggauuuccuuugccaucagcugcuuccuucugugugucgcccuccugggcuuuaucaugugggcuugccagaaagggaacauucgguguaauaucugcauuuga

SEQ ID NO: 194293 - RNA, 1701 nt, Artificial Sequence
  derived and/or modified sequence opt5 from hemagglutinin__InfluenzaA__AHL90098
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcgggucugacaacuccuuuuucagcagacugaauuggcucacacaucugaaguuuaaauauccugcccuuaacgucaccaugcccaauaacgagaaguucgauaaacuguacaucuggggagugcaccauccuggcacggacaacgaucagauuuuucucuaugcgcaggccucugggcggaucacaguuuccaccaagcgcagccaacagacagugauuccgaauaucggauccagaccccggguccgcaacauuccuucuagaaucagcaucuacuggaccauugugaaacccggcgacauccugcugauuaauuccaccgggaaccucaucgcuccucggggauacuucaagauucgcagcggcaagucuuccaucaugagaagcgacgcccccaucgauaaauguaauucugagugcauuacaccgaacggcagcaucccuaaugacaagcccuuucagaacgugaaucggauuacguauggggcuuguccucgcuacgucaaacagaacacccugaaacuugccacaggaaugagaaauguucccgaaaagcaaacccggggcaucuucggggcgauugccggauuuaucgagaacggcugggaagggaugguggauggaugguauggcuuccgccaccaaaauuccgagggcaucgggcaggcugccgaccugaagucuacacaggcugccauuaaccagaucaauggaaaacucaacagacugauuggcaagaccaacgagaaguuccaccagaucgaaaaagaguuuagcgaaguggaggggcggauucaggaucuugaaaaguacgucgaggacacgaaaaucgaucugugguccuauaaugccgagcuccugguggcucuggaaaaccaacauacaauugaccucaccgauagcgagaugaauaagcuguucgaaagaaccaaaaagcagcuucgcgagaacgcggaagacaugggaaauggcugcuuuaagaucuaccacaaaugugauaacgccugcaucgggucuauucggaauggcacauaugaccaugacguuuacagagaugaggcucugaacaaucgcuuccagaucaagggaguggagcucaaauccggcuacaaggacuggauucuguggaucagcuuugccauuucuugcuuccuucugugugucgcccuccugggguuuaucaugugggcuugccagaaaggaaacauccgguguaauauuugcaucuga

SEQ ID NO: 194294 - RNA, 1701 nt, Artificial Sequence
  derived and/or modified sequence opt5 from hemagglutinin__InfluenzaA__AHL90110
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgacaagcuguacauuuggggcgugcaccauccugggacggauaaugaccagaucuuucucuaugcgcaggccucuggacgcauuacaguuuccaccaaaagaagccaacagacagugaucccgaacauuggcucccggccccgcgucagaaauaucccuucucggaucagcauuuacuggaccaucgugaagcccggggauauucugcugaucaacuccaccggaaaucucauugcuccucgcggcuacuucaaaauccagagcgggaagucuuccgugaugagaagcgacgcccccaucggaaaguguaacucugaaugcauuacaccgaauggcagcaucccuaacgacaaacccuuucagaaugucaaccggauuacguauggcgcuuguccucgcuacguuaagcaaaauacccugaaacuugccacagggaugagaaacgugcccgagaagcagacccggggaaucuucggcgcgauugccggguuuaucgaaaauggaugggagggcaugguggaugggugguauggauuccgccaccagaacuccgagggcaucggccaagcugccgaccugaaaucuacacaggcugccauugaucagaucaaugggaagcucaacagacugauuggaaaaaccaacgaaaaguuccaccagaucgagaaggaauuuagcgaggucgaaggccggauucaagaccuugagaaauacguggaggauacgaagaucgaccugugguccuauaaugccgaacuccugguugcucuggagaaccagcauacaauugaucucaccgacagcgaaaugaauaaacuguucgagaagaccaaaaagcagcuuagagaaaacgcggaggauauggggaauggaugcuuuaagaucuaccacaaaugugacaacgccugcaucggcucuauucgcaaugggacauaugaucaugacguguaccgggacgaggcucugaacaauagauuccagaucaagggcgucgaacucaaauccggauacaaggauuggauucuguggaucagcuuugccauuucuugcuuccuucuguguguggcccuccugggcuuuaucaugugggcuugccaaaaagggaacauccgcuguaauauuugcaucuga

SEQ ID NO: 194295 - RNA, 1698 nt, Artificial Sequence; identical to SEQ ID NO: 187119
  derived and/or modified sequence opt5 from hemagglutinin__InfluenzaA__AHL90122

SEQ ID NO: 194296 - RNA, 1698 nt, Artificial Sequence; identical to SEQ ID NO: 185512
  derived and/or modified sequence opt5 from hemagglutinin__InfluenzaA__AHL90133

SEQ ID NO: 194297 - RNA, 1698 nt, Artificial Sequence; identical to SEQ ID NO: 187119
  derived and/or modified sequence opt5 from hemagglutinin__InfluenzaA__AHL90145

SEQ ID NO: 194298 - RNA, 1698 nt, Artificial Sequence
  derived and/or modified sequence opt5 from hemagglutinin__InfluenzaA__AHL90157
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaagcccuguaccauaccgagaaugcuuacgugagcgucguuuccucucacuauagcagaaaguucacacccgaaauugccaagcggccuaaagugcgcgaucaggaggggagaaucaacuacuauuggacccuucuggagcccggagacacgauuaucuuugaagcgaauggcaaccucauugccccucgguacgcuuucgcccugucccgcggguuuggaagcggcaucauuaauucuaacgcucccauggauaagugugacgccaaaugccagacaccgcaaggcgcgaucaauuccagccuuccuuuccagaacgugcaucccgucaccaucggggaguguccuaaguaugugagaucugccaaacugcggaugguuacaggacuccgcaauauucccagcauccaguccagaggccuguuuggggcuauugccggauucaucgaaggcggguggaccggaaugguggauggcugguacggcuaucaccaccagaacgagcaagggucuggauacgcugccgaccaaaagagcacccagaaugccauuaacggcaucacaaauaaagucaacuccgugaucgaaaagaugaauacgcaguuuaccgcuguugggaaggaguucaacaaacuggagcggcgcauggaaaaccucaauaagaaaguggaugacggauucauugauaucuggacauacaacgcggagcugcuuguccugcucgaaaaugagagaacccuggacuuucaugacagcaacgugaagaaucuuuaugaaaaagucaagauucagcugaagaacaaugccaaagagaucggcaacgggugcuucgaguuuuaccacaaguguaaugaugaaugcauggagucugugaaaaacggcacauaugacuaccccaaguauuccgaagagagcaaacucaaucgggagaagauugauggaguuaagcuggaaucuaugggcguguaccagauccuggcuaucuauuccaccauugccagcucccucguccugcuugugucucugggggccaucagcuucuggaugugcuccaacggaucucuccagugucgcauuugcaucuga

SEQ ID NO: 194299 - RNA, 1698 nt, Artificial Sequence; identical to SEQ ID NO: 187119
  derived and/or modified sequence opt5 from hemagglutinin__InfluenzaA__AHL90169

SEQ ID NO: 194300 - RNA, 1698 nt, Artificial Sequence
  derived and/or modified sequence opt5 from hemagglutinin__InfluenzaA__AHL90181
augaaggugaaacugcucguccugcuuugcaccuucgccgcuacauacgccgacacgaucuguauuggcuaucacgcgaacaauagcaccgauacaguugacaccgugcuggagaagaacgugacagucacccauuccgugaaucuccuggaaaacucucacaaugggaaacuuugccugcucaagggaaucgcuccccugcagcugggcaacuguagcguugccggguggauucucggaaauccugagugcgaacugcuuaucuccaaagagucuuggagcuacauuguggaaaagccgaaccccaagaauggcacauguuauccugggcauuuugccgauuacgaggagcugagagaacaacucuccucugucagcuccuucgagcgguuugaaaucuuccccaaagagagcucuuggccuaaccacaccgugacgggaguuuccgcuagcugcucucauaauggcgaguccagcuuuuaucgcaaccugcuuuggcugaccggcaagaaugggcucuaccccaaccugucuaaauccuaugccaauaacaaggaaaaagaggugcugguccucuggggagugcaccacccuccgaacaucggcgaccagaaggcucuguaccauacagaaaaugccuacgugagcgucguuuccucucacuauagcagaaaguucacccccgagauugcgaaacggccuaaggugcgcgaucaggaagggagaaucaacuacuauuggacacuucuggagcccggagacaccauuaucuuugaggccaauggcaaccucauugcuccucgguacgccuucgcucugucccgcggguuuggaagcggcaucauuaauucuaacgcccccauggauaaaugugacgcgaagugccagacgccgcaaggcgccaucaauuccagccuuccuuuccagaacgugcaucccgucacaaucggggaauguccuaaauaugugagaucugcuaagcugcggaugguuaccggacuccgcaauauucccagcauccaguccagaggccuguuuggggccauugcuggauucaucgagggcggguggacaggaaugguggauggcugguacggcuaucaccaccagaacgaacaagggucuggauacgccgccgaccagaaaagcacccagaaugcuauuaacggcaucaccaauaaggucaacuccgugaucgagaagaugaauacacaguuuacggcgguugggaaagaguucaacaagcuggaacggcgcauggagaaccucaauaaaaagguggaugacggauucauugauaucuggaccuacaacgccgaacugcuuguccugcucgagaaugaaagaacacuggacuuucaugacagcaacgugaaaaaucuuuaugagaaggucaagucucaacugaaaaacaaugcuaaggaaauuggcaacgggugcuucgaguuuuaccacaaauguaaugaugagugcauggaauccgugaagaacggcaccuaugacuaccccaaauauagcgaggaaucuaagcucaaucgggagaagaucgauggaguuaaacuggaguccaugggcguguaccagauucuggccaucuauagcacagucgccuccucucucgugcugcuuguuagccugggggcuaucuccuucuggaugugcucuaacggaagccuccagugucgcauuugcaucuga

SEQ ID NO: 194301 - RNA, 1698 nt, Artificial Sequence; identical to SEQ ID NO: 186194
  derived and/or modified sequence opt5 from hemagglutinin__InfluenzaA__AHL90217

SEQ ID NO: 194302 - RNA, 1698 nt, Artificial Sequence; identical to SEQ ID NO: 186194
  derived and/or modified sequence opt5 from hemagglutinin__InfluenzaA__AHL90229

SEQ ID NO: 194303 - RNA, 1698 nt, Artificial Sequence
  derived and/or modified sequence opt5 from hemagglutinin__InfluenzaA__AHL90241
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucccgaaagaguccuggucuuacauuguggaaaagcccaacccugagaauggcaccuguuaucccgggcauuuugccgauuacgaggaacugagagagcaacucagcuccgucucuagcuucgaacgguuugagaucuucccuaaggaguccagcuggcccaaccacacggugaccggaguuucugccuccugcagccauaauggcgaaucuuccuuuuaucgcaaccugcuuuggcugacaggcaaaaaugggcucuacccuaaccugagcaagucuuaugcuaauaacaaagagaaggaagugcugguccucuggggagugcaccacccgcccaacaucggcgaccagaaagcccuguaccauaccgagaaugcuuacguguccgucguuagcucccacuauucuagaaaguucacaccugaaauugccaagcggcccaaagugcgcgaucaggaggggagaaucaacuacuauuggacccuucuggagccuggagacacgauuaucuuugaagcgaauggcaaccucauugcuccccgguacgccuucgcccugagccgcggguuuggauccggcaucauuaauagcaacgcuccgauggauaagugugacgccaaaugccagacaccucaaggcgcgaucaauucuucccuucccuuccagaacgugcauccugucaccaucggggagugucccaaguaugugagaagcgccaaacugcggaugguuacaggacuccgcaauauucccucuauccagagcagaggccuguuuggggcuauugccggauucaucgaaggcggguggaccggaaugguggauggcugguacggcuaucaccaccagaacgagcaaggguccggauacgcugccgaccagaagucuacccagaaugccauuaacggcaucacaaauaaagucaacagcgugaucgaaaagaugaauacgcaguuuaccgcuguugggaaggaguucaacaaacuggagcggcgcauggaaaaccucaauaagaaaguggaugacggauucauugauaucuggacauacaacgcggagcugcuuguccugcucgaaaaugagagaacccuggacuuucaugacuccaacgugaagaaucuuuaugaaaaagucaagagccaacugaagaacaaugccaaagagauuggcaacgggugcuucgaguuuuaccacaaguguaaugaugaaugcauggagucugugaaaaacggcacauaugacuacccuaaguauuccgaagagagcaaacucaaucgggagaagaucgauggaguuaagcuggaaucuaugggcguguaccagauucuggcuaucuauuccaccgucgccagcucccucgugcugcuuguuucucugggggccaucagcuucuggaugugcuccaacggaucucuccagugucgcauuugcaucuga

SEQ ID NO: 194304 - RNA, 1698 nt, Artificial Sequence
  derived and/or modified sequence opt5 from hemagglutinin__InfluenzaA__AHL90253
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaagggaagcucuuggccuaaccacacggugaccggcguuuccgccagcugcucucauaauggcgaguccagcuuuuaucgcaaccugcuuuggcugacagggaaaaauggacucuaccccaaccugucuaaguccuaugcuaauaacaaagaaaaggaggugcugguccucuggggcgugcaccacccuccgaacaucggggaccagaaaacccuguaccauacagaaaaugccuacgugagcgucguuuccucucacuauagcagaaaguucacccccgagauugcuaagcggccuaaagugcgcgaucaggaaggaagaaucaacuacuauuggacgcuucuggagcccggcgacacaauuaucuuugaggccaaugggaaccucauugcgccucgguacgccuucgcucugucccgcggauuuggcagcggcaucauuaauucuaacgcccccauggauaagugugacgcuaaaugccagaccccgcaaggggccaucaauuccagccuuccuuuccagaacgugcaucccgucacaaucggagaauguccuaaguaugugagaucugcgaaacugcggaugguuaccggccuccgcaauauucccagcauccaguccagagggcuguuuggagccauugcuggcuucaucgaagggggauggaccggcaugguggauggcugguacggguaucaccaccagaacgaacaaggaucuggcuacgccgcugaccaaaagagcacacagaaugccauuaacgggaucacgaauaaagucaacuccgugaucgagaagaugaauacccaguuuacagccguuggaaaggaguucaacaaacuggagcggcgcauggagaaccucaauaagaaaguggaugacggcuucauugauaucuggaccuacaacgcugaacugcuuguccugcucgagaaugaaagaacacuggacuuucaugacagcaacgugaagaaucuuuaugagaaagucaagucucagcugaagaacaaugcgaaagaaauugggaacggcugcuucgaguuuuaccacaaguguaaugaugagugcauggaauccgugaaaaacggaaccuaugacuaccccaaguauagcgagguuucuaaacucaaucgggaaaagaucgauggcgugaagcuggaguccaugggggucuaccagauucuggccaucuauagcacgguggcuuccucucucguucugcuugugagccugggagccaucuccuucuggaugugcucuaacggcagccuccagugucgcauuugcaucuga

SEQ ID NO: 194305 - RNA, 1698 nt, Artificial Sequence; identical to SEQ ID NO: 185512
  derived and/or modified sequence opt5 from hemagglutinin__InfluenzaA__AHL90265

SEQ ID NO: 194306 - RNA, 1698 nt, Artificial Sequence
  derived and/or modified sequence opt5 from hemagglutinin__InfluenzaA__AHL90277
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucguggaccagaaaacccuguaccauacagagaaugccuacgucagcguuguguccucucacuauagcagaaaguucacccccgaaauugcuaagcggccuaaagugcgcgaucaggagggcagaaucaacuacuauuggacgcuucuggagcccggggacacaauuaucuuugaagccaauggaaaccucauugcgccucgguacgccuucgcucugucccgcggcuuugggagcggaaucauuaauucuaacgcccccauggauaagugugacgcuaaaugccagaccccgcaaggcgccaucaauuccagccuuccuuuccagaacguccaucccgugacaaucggcgaguguccuaaguauguuagaucugcgaaacugcggauggugaccgggcuccgcaauauucccagcauccaguccagaggacuguuuggcgccauugcuggguucaucgaaggaggcuggaccgggauggucgauggaugguacggcuaucaccaccagaacgagcaaggcucuggguacgccgcugaccaaaagagcacacagaaugccauuaacggaaucacgaauaaagugaacuccguuaucgaaaagaugaauacccaguuuacagccgugggcaaggaguucaacaaacuggagcggcgcauggaaaaccucaauaagaaagucgaugacggguucauugauaucuggaccuacaacgcugagcugcuugugcugcucgaaaaugagagaacacuggacuuucaugacagcaacgucaagaaucuuuaugaaaaagugaagucucagcugaagaacaaugcgaaagagauuggaaacggcugcuucgaguuuuaccacaaguguaaugaugaaugcauggaguccguuaaaaacgggaccuaugacuaccccaaguauagcgaagagucuaaacucaaucgggagaagaucgauggcgugaagcuggaauccaugggagucuaccagauucuggccaucuauagcacgguggcuuccucucucguucugcuugugagccugggcgccaucuccuucuggaugugcucuaacgggagccuccagugucgcauuugcaucuga

SEQ ID NO: 194307 - RNA, 1698 nt, Artificial Sequence
  derived and/or modified sequence opt5 from hemagglutinin__InfluenzaA__AHL90289
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaagcccuguaccauaccgagaaugcuuacgugagcgucguuuccucucacuauagcagaaaguucacacccgaaauugccaagcggccuaaagugcgcgaucaggaggggagaaucaacuacuauuggacccuucuggagccccgggacacgauuaucuuugaagcgaauggaaaccucauugccccucgcuacgcuuucgcccuguccagaggcuuugggagcggaaucauuaauucuaacgcucccauggauaagugugacgccaaaugccagacaccgcaaggcgcgaucaauuccagccuuccuuuccagaacgugcaucccgucaccaucggcgaguguccuaaguaugugcggucugccaaacugcgcaugguuacagggcucagaaauauucccagcauccagucccggggacuguuuggcgcuauugccggguucaucgaaggaggcuggaccgggaugguggauggaugguacggcuaucaccaccagaacgagcaaggcucuggguacgcugccgaccaaaagagcacccagaaugccauuaacggaaucacaaauaaagucaacuccgugaucgaaaagaugaauacgcaguuuaccgcuguuggcaaggaguucaacaaacuggagcgcagaauggaaaaccucaauaagaaaguggaugacggguucauugauaucuggacauacaacgcggagcugcuuguccugcucgaaaaugagcggacccuggacuuucaugacagcaacgugaagaaucuuuaugaaaaagucaagucucagcugaagaacaaugccaaagagauuggaaacggcugcuucgaguuuuaccacaaguguaaugaugaaugcauggaguccgugaaaaacgggacauaugacuaccccaaguauagcgaagagucuaaacucaaucgcgagaagaucgauggcguuaagcuggaauccaugggaguguaccagauucuggcuaucuauagcaccgucgccuccucucucgugcugcuuguuagccugggcgccaucuccuucuggaugugcucuaacgggagccuccaguguagaauuugcaucuga

SEQ ID NO: 194308 - RNA, 1698 nt, Artificial Sequence; identical to SEQ ID NO: 194307
  derived and/or modified sequence opt5 from hemagglutinin__InfluenzaA__AHL90301

SEQ ID NO: 194309 - RNA, 1698 nt, Artificial Sequence
  derived and/or modified sequence opt5 from hemagglutinin__InfluenzaA__AHL90325
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaagcccuguaccauaccgagaaugcuuacgugagcgucguuuccucucacuauagcagaaaguucacacccgaaauugccaagcggccuaaagugcgcgaucaggaggggagaaucaacuacuauuggacccuucuggagcccggagacacgauuaucuuugaagcgaauggcaaccucauugccccucgguacgcuuucgcccugucccgcggguuuggaagcggcaucauuaauucuaacgcucccauggauaagugugacgccaaaugccagacaccgcaaggcgcgaucaauuccagccuuccuuuccagaacgugcaucccgucaccaucggggaguguccuaaguaugugagaucugccaaacugcggaugguuacaggacuccgcaauauucccagcauccaguccagaggccuguuuggggcuauugccggauucaucgaaggcggguggaccggaaugguggauggcugguacggcuaucaccaccagaacgagcaagggucuggauacgcugccgaccaaaagagcacccagaaugccauuaacggcaucacaaauaaagucaacuccgugaucgaaaagaugaauacgcaguuuaccgcuguugggaaggaguucaacaaacuggagcggcgcauggaaaaccucaauaagaaaguggaugacggauucauugauaucuggacauacaacgcggagcugcuuguccugcucgaaaaugagagaacccuggacuuucaugacagcaacgugaagaaucuuuaugaaaaagucaagucucagcugaagaacaaugccaaagagaugggcaacgggugcuucgaguuuuaccacaaguguaaugaugaaugcauggaguccgugaaaaacggcacauaugacuaccccaaguauagcgaagagucuaaacucaaucgggagaagauugauggaguuaagcuggaauccaugggcguguaccagauccuggcuauuuauagcaccgucgccuccucucucgugcugcuuguuagccugggggccaucuccuucuggaugugcucuaacggaagccuccagugucgcaucugcauuuga

SEQ ID NO: 194310 - RNA, 1698 nt, Artificial Sequence; identical to SEQ ID NO: 194309
  derived and/or modified sequence opt5 from hemagglutinin__InfluenzaA__AHL90337

SEQ ID NO: 194311 - RNA, 1698 nt, Artificial Sequence; identical to SEQ ID NO: 185512
  derived and/or modified sequence opt5 from hemagglutinin__InfluenzaA__AHL90349

SEQ ID NO: 194312 - RNA, 1698 nt, Artificial Sequence; identical to SEQ ID NO: 185512
  derived and/or modified sequence opt5 from hemagglutinin__InfluenzaA__AHL90361

SEQ ID NO: 194313 - RNA, 1698 nt, Artificial Sequence; identical to SEQ ID NO: 194306
  derived and/or modified sequence opt5 from hemagglutinin__InfluenzaA__AHL90373

SEQ ID NO: 194314 - RNA, 1701 nt, Artificial Sequence
  derived and/or modified sequence opt5 from hemagglutinin__InfluenzaA__AHL90385
augaagaccaucauugcccugagcuacauccagugccucguguucgcucaaaaauuucccggcaacgacaauuccacagccacgcugugucuugggcaccaugcggucccuaacggaaccauuguuaagacaaucaccaaugaucagauugaggugacaaacgcuaccgaacuggugcagucuagcuccacaggcgagaucugcgacucuccgcaccagauccucgauggggaaaauuguacccugauugacgcccuucugggagauccccaaugcgacggcuuccagaacaaaaauugggaucucuuugucgagagaagcaaggccuauuccaacuguuacccuuaugacgugcccgauuacgcuucucugcggagccugguugccuccagcgggacgcucgaguucaauaacgaaucuuuuaauuggaccggagugacacagaacggcaccuccagcgcuugcauccgcagaucuaauaacuccuucuuuagccggcugaauuggcuuacacauucuaaauucaaguauccugcccugaacgucaccaugcccaacaaugagaacuuugacaagcucuacauuuggggcgugcaccauccugggacggauaaugaccagaucuuccuguaugcgcaagccuccggacgcauuacaguuagcaccaaaagaucccagcagacagugaucccgaacauuggcucucggccccgcgucagaaauaucccuagccggaucuccauuuacuggaccaucgugaagcccggggauauucuucugaucaacagcaccggaaaucucauugcuccucgcggcuacuuuaaaaucagaucugggaaguccagcaucaugcggucugacgcccccauuggaaaauguaacagcgaaugcaucacaccgaauggcuccauuccuaacgacaagcccuuccagaaugugaaccgcaucacguauggcgcuuguccuagauacgucaagcaaaauacccugaaacuggccacagggaugcggaacguucccgagaagcagacccgcggaauuuuuggcgcgaucgccggguucaucgaaaauggaugggagggcaugguggaugggugguauggauucagacaccagaacucugagggcauuggccaagcugccgaccucaaaagcacacaggcugccaucgaucagauuaacgggaagcugaaucggcuuaucggaagaaccaacgaaaaauuucaccagauugagaaggaguucuccgaaguggaaggccgcauccaagaccuggagaaauacgucgaggauacgaagauugaccucuggagcuauaaugccgaacugcuuguggcucuggagaaccagcauacaaucgaucucaccgacucugaaaugaauaagcuguuugagaaaaccaagaaacagcugcgggaaaacgcggaggauauggggaauggaugcuucaagaucuaccacaaaugugacaacgccugcauuggcuccaucagaaaugggacauaugaucaugacguuuaccgcgacgaggcucucaacaaucgguuucagauuaagggcguggaacuuaagagcggauacaaagauuggauccuguggauuucuuucgccaucuccugcuuucugcucuguaucgcccugcuuggcuucauuaugugggcuugccaaaaggggaacaucagauguaauauuugcaucuga

SEQ ID NO: 194315 - RNA, 1701 nt, Artificial Sequence
  derived and/or modified sequence opt5 from hemagglutinin__InfluenzaA__AHL90397
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggccccgcgucagaaauaucccuucucggaucagcauuuacuggaccaucgugaaacccggggauauucugcugaucaacuccaccggaaaucucauugcuccucgcggcuacuucaagaucagaagcgggaaaucuuccaucaugcggagcgacgcccccauuggaaaguguucuagcgaaugcaucacaccgaacggcuccauuccuaaugacaagcccuuucagaacgugaaucgcaucacguauggcgcuuguccuagauacgucaaacaaaacacccugaagcuggccacagggaugcggaauguucccgagaaacagacccgcggaauuuucggcgcgaucgccggguuuaucgaaaacggaugggagggcaugguggaugggugguauggauucagacaccaaaauucugagggccggggccaggcugccgaccuuaagagcacacaggcugccauugaucagaucaacgggaaacucaauagacugauuggaaagaccaacgaaaaauuccaccagaucgagaaggaauuuuccgagguggaaggccgcauucaagaccuugagaaguacgucgaggauacgaaaaucgaccuguggagcuauaacgccgaacuccugguggcucuggagaaucagcauacaauugaucucaccgacucugaaaugaacaagcuguucgagaaaaccaagaaacagcuucgggaaaaugcggaggauauggggaacggaugcuuuaagaucuaccacaagugugacaaugccugcaucggcuccauuagaaacgggacauaugaucaugacguuuaccgcgacgaggcucugaauaaccgguuccagaucaaaggcguggaacucaagagcggauacaaagauuggauucuguggaucucuuuugccauuuccugcuuccuucugugugucgcccuccugggcuuuaucaugugggcuugccaaaaggggaauaucagauguaacauuugcaucuga

SEQ ID NO: 194316 - RNA, 1701 nt, Artificial Sequence; identical to SEQ ID NO: 185458
  derived and/or modified sequence opt5 from hemagglutinin__InfluenzaA__AHL90410

SEQ ID NO: 194317 - RNA, 1701 nt, Artificial Sequence
  derived and/or modified sequence opt5 from hemagglutinin__InfluenzaA__AHL90422
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacauucuaaguuuaaguauccugcccugaaugucaccaugcccaacaacgaggaguucgacaaacuuuacauuuggggcgugcaccauccugggacggauaaugaccagaucuuucuguaugcgcaggccuccggacgcauuacaguuagcaccaagagaucccaacagacagugaucccgaacauuggcucucggccccgcgucagaaauaucccuagccggaucuccauuuacuggaccaucgugaaacccggggauauucuccugaucaacagcaccggaaaucugauugcuccucgcggcuacuucaagaucagaucugggaaauccagcaucaugcggucugacgcccccauuggaaaguguaacagcgaaugcaucacaccgaauggcuccauuccuaacgacaagcccuuucagaaugugaaccgcaucacguauggcgcuuguccuagauacgucaaacagaauacccucaagcuggccacagggaugcggaacguucccgaaaaacaaacccgcggaauuuucggcgcgaucgccggguuuaucgagaauggaugggagggcaugguggaugggugguauggauucagacaccagaacucugaaggcauuggccaggcugccgaccuuaagagcacacaagcugccaucgaucagauuaaugggaaacugaaccggcucaucggaaagaccaacgagaaauuccaccagauugaaaaggaguuuuccgaaguggagggcagaauccaggaccuggagaaguacgucgaagauacgaaaauugaccuuuggagcuauaaugccgagcugcucguggcucuggaaaaccaacauacaaucgaucugaccgacucugagauguccaaacucuucgaaaagaccaagaaacagcugcgcgagaaugcggaggauauggggaacggaugcuuuaagaucuaccacaagugugacaauacaugcauuggcagcauccggaacgggaccuaugaucauaauguuuacagagacgaagcccuuaacaaucgcuuccagauuaaaggcguggagcugaagucuggauacaaagacuggauccucuggauuuccuuugcuaucagcugcuuccugcuuugugucgcccugcucggcuuuaucaugugggccugccagaaggggaacauucgguguaauaucugcauuuga

SEQ ID NO: 194318 - RNA, 1701 nt, Artificial Sequence; identical to SEQ ID NO: 185458
  derived and/or modified sequence opt5 from hemagglutinin__InfluenzaA__AHL90434

SEQ ID NO: 194319 - RNA, 1701 nt, Artificial Sequence; identical to SEQ ID NO: 185458
  derived and/or modified sequence opt5 from hemagglutinin__InfluenzaA__AHL90446

SEQ ID NO: 194320 - RNA, 1701 nt, Artificial Sequence
  derived and/or modified sequence opt5 from hemagglutinin__InfluenzaA__AHL90458
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauugugcccugauugacgcccuccugggagauccccagugcgacggcuuucaaaacaaaaagugggaucuguucgucgagagaagcaaggcuuauuccaauuguuacccuuaugacgugcccgauuacgccucucuccggagccugguugcuuccagcgggacccuugaauuuaacaaugagucuuucaacuggacgggagugacccagaauggcacauccagcgccugcauccgcagaucuaacaauuccuuuuucagccggcugaacuggcucacccaucugaaguuuaaguauccugcgcuuaaugucacaaugcccaacaacgagcaguucgacaaacuguacauuuggggcgugcaccauccugggaccgauaaugaccagaucuuucucuaugcccaggcuucuggacgcauuacgguuuccacaaagagaagccaacagaccgugaucccgaacauuggcucccggccccgcgucagaaauaucccuucucggaucagcauuuacuggacaaucgugaaacccggggauauucugcugaucaacuccaccggaaaucucauugccccucgcggcuacuucaagaucagaagcgggaaaucuuccaucaugcggagcgacgcucccauuggaaaguguaacucugaaugcaucaccccgaauggcagcauuccuaacgacaagcccuuucagaaugugaaccgcaucacauauggcgccuguccuagauacgucaaacaaaauacgcugaaacuugcgaccgggaugcggaacguucccgagaaacagacacgcggaauuuucggcgccaucgcuggguuuaucgaaaauggaugggagggcaugguggaugggugguauggauucagacaccagaacuccgagggccggggccaagccgcugaccugaagucuacccaggccgccauugaucagaucaaugggaaacucaacagacugauuggaaagacaaacgaaaaauuccaccagaucgagaaggaauuuagcgagguggaaggccgcauucaagaccuugagaaguacgucgaggauaccaaaaucgaccugugguccuauaaugcugaacuccugguggcgcuggagaaccagcauacgauugaucucacagacagcgaaaugaauaagcuguucgagaaaaccaagaaacagcuucgggaaaacgccgaggauauggggaauggaugcuuuaagaucuaccacaagugugacaacgcuugcaucggcucuauuagaaaugggaccuaugaucaugacguuuaccgcgacgaggcccugaacaaucgguuccagaucaaaggcguggaacucaaguccggauacaaagauuggauucuguggaucagcuuugccauuucuugcuuccuucugugugucgcucuccugggcuuuaucaugugggccugccaaaaggggaacaucagauguaauauuugcaucuga

SEQ ID NO: 194321 - RNA, 1701 nt, Artificial Sequence; identical to SEQ ID NO: 185458
  derived and/or modified sequence opt5 from hemagglutinin__InfluenzaA__AHL90470

SEQ ID NO: 194322 - RNA, 1701 nt, Artificial Sequence; identical to SEQ ID NO: 185458
  derived and/or modified sequence opt5 from hemagglutinin__InfluenzaA__AHL90482

SEQ ID NO: 194323 - RNA, 1701 nt, Artificial Sequence; identical to SEQ ID NO: 185561
  derived and/or modified sequence opt5 from hemagglutinin__InfluenzaA__AHL90494

SEQ ID NO: 194324 - RNA, 1701 nt, Artificial Sequence; identical to SEQ ID NO: 185561
  derived and/or modified sequence opt5 from hemagglutinin__InfluenzaA__AHL90506

SEQ ID NO: 194325 - RNA, 1701 nt, Artificial Sequence
  derived and/or modified sequence opt5 from hemagglutinin__InfluenzaA__AHL90518
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaagaacgagucuuucaauuggaccggagugacacagaacggcaccuccagcgcuugcauccgcagaucuaauaacuccuuuuucagccggcugaauuggcucacacaucugaaguuuaaauauccugcccuuaacgucaccaugcccaauaaggagaaauucgacaagcuguacauuuggggcgugcaccauccugggacggauaacgaccagaucuuucucuaugcgcaggccucuggacgcauuacaguuuccaccaaaagaagccaacagacagugaucccgaacauuggcucccggccccgcgucagaaauaucccuucucggaucagcauuuacuggaccaucgugaagcccggggauauucugcugaucaacuccaccggaaaucucauugcuccucgcggcuacuucaagaucagaagcgggaaaucuuccaucaugcggagcgacgcccccauuggaaaguguaacucugaaugcaucacaccgaauggcagcauuccuaacgacaaacccuuucagaaugugaaccgcaucacguauggcgcuuguccuagauacgucaagcagaauacccugaaacuugccacagggaugcggaacguucccgagaagcaaacccgcggaauuuucggcgcgaucgccggguuuaucgaaaauggaugggagggcaugguggaugggugguauggauucagacaccagaacuccgagggcacaggccaggcugccgaccugaaaucuacccaagcugccauugaucagaucaaugggaagcucaaccggcugauuggaaagacgaaugaaaaauuccaccagaucgagaaggaauuuagcgagguggaaggccgcauucaggaccuugagaaauacgucgaggauacaaagaucgaccugugguccuauaacgccgaacuccugguggcucuggagaaccaacauaccauugaucucaccgacagcgaaaugaauaaacuguucgagaagacaaagaaacagcuuagagaaaacgcggaggauauggggaauggaugcuuuaagaucuaccacaaaugugacaacgccugcaucggcucuauucggaaugggaccuaugaucaugacguuuacagagacgaggcucugaacaaucgcuuccagaucaagggcguggaacucaaauccggauacaaggauuggauucuguggaucagcuuugccauuucuugcuuccuucugugugucgcccuccugggcuuuaucaugugggcuugccagaaggggaacauccgguguaauauuugcaucuga

SEQ ID NO: 194326 - RNA, 1701 nt, Artificial Sequence; identical to SEQ ID NO: 186237
  derived and/or modified sequence opt5 from hemagglutinin__InfluenzaA__AHL90530

SEQ ID NO: 194327 - RNA, 1701 nt, Artificial Sequence; identical to SEQ ID NO: 185458
  derived and/or modified sequence opt5 from hemagglutinin__InfluenzaA__AHL90542

SEQ ID NO: 194328 - RNA, 1701 nt, Artificial Sequence; identical to SEQ ID NO: 185458
  derived and/or modified sequence opt5 from hemagglutinin__InfluenzaA__AHL90554

SEQ ID NO: 194329 - RNA, 1701 nt, Artificial Sequence; identical to SEQ ID NO: 185458
  derived and/or modified sequence opt5 from hemagglutinin__InfluenzaA__AHL90566

SEQ ID NO: 194330 - RNA, 1701 nt, Artificial Sequence; identical to SEQ ID NO: 185458
  derived and/or modified sequence opt5 from hemagglutinin__InfluenzaA__AHL90578

SEQ ID NO: 194331 - RNA, 1701 nt, Artificial Sequence; identical to SEQ ID NO: 185561
  derived and/or modified sequence opt5 from hemagglutinin__InfluenzaA__AHL90590

SEQ ID NO: 194332 - RNA, 1701 nt, Artificial Sequence; identical to SEQ ID NO: 185458
  derived and/or modified sequence opt5 from hemagglutinin__InfluenzaA__AHL90602

SEQ ID NO: 194333 - RNA, 1701 nt, Artificial Sequence; identical to SEQ ID NO: 185458
  derived and/or modified sequence opt5 from hemagglutinin__InfluenzaA__AHL90614

SEQ ID NO: 194334 - RNA, 1701 nt, Artificial Sequence
  derived and/or modified sequence opt5 from hemagglutinin__InfluenzaA__AHL90638
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggccccgcgucagaaauaucccuucucggaucagcauuuacuggaccaucgugaaacccggggauauucugcugaucaacuccaccggaaaucucauugcuccucgcggcuacuucaagaucagaagccggaaaucuuccaucaugcgcagcgacgcccccauugggaaguguaacucugaaugcaucacaccgaauggaagcauuccuaacgacaagcccuuucagaaugugaacagaaucacguauggcgcuuguccucgguacgucaaacaaaauacccugaaacuugccacaggcaugcgcaacguucccgagaagcagaccagagggauuuucggagcgaucgccggcuuuaucgaaaaugggugggagggaaugguggauggcugguauggguuccggcaccagaacuccgagggaagaggccaagcugccgaccugaagucuacacaggcugccauugaucagaucaauggcaaacucaaccgccugauugggaagaccaacgaaaaauuccaccagaucgagaaggaauuuagcgagguggaaggacggauucaagaccuugagaaguacgucgaggauacgaaaaucgaccugugguccuauaaugccgaacuccugguggcucuggagaaccagcauacaauugaucucaccgacagcgaaaugaauaagcuguucgagaaaaccaagaaacagcuuagagaaaacgcggaggauaugggcaaugggugcuuuaagaucuaccacaagugugacaacgccugcaucggaucuauucgcaauggcacauaugaucaugacguuuaccgggacgaggcucugaacaauagauuccagaucaaagggguggaacucaaguccggcuacaaagauuggauucuguggaucagcuuugccauuucuugcuuccuucugugugucgcccuccugggauuuaucaugugggcuugccaaaagggcaacauccgcuguaauauuugcaucuga

SEQ ID NO: 194335 - RNA, 1701 nt, Artificial Sequence
  derived and/or modified sequence opt5 from hemagglutinin__InfluenzaA__AHL90650
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagacauuucucuaugcgcaagccucuggacgcaucaccguuuccacaaagagaagccagcagaccgugauuccgaacaucggcucccggccccgcgucagaaauauuccuucucggaucagcaucuacuggaccauugugaaacccggggauauccugcugauuaacuccacaggaaaucucaucgcuccucgcggcuacuucaagauuagaagcgggaaaucuuccaucaugcggagcgacgcccccaucggaaaguguaacucugaaugcauuacgccgaauggcagcaucccuaacgacaagcccuuucagaaugugaaccgcauuaccuauggcgcuuguccuagauacgucaaacaaaauacacugaaacuugccaccgggaugcggaacguucccgagaagcagacacgcggaaucuucggcgcgauugccggguuuaucgaaaauggaugggagggcaugguggaugggugguauggauucagacaccagaacuccgagggccggggccaagcugccgaccugaagucuacccaggcugccaucgaucagauuaaugggaaacucaacagacugaucggaaagacgaacgaaaaauuccaccagauugagaaggaauuuagcgagguggaaggccgcauccaagaccuugagaaguacgucgaggauacaaaaauugaccugugguccuauaaugccgaacuccugguggcucuggagaaccagcauaccaucgaucucaccgacagcgaaaugaauaagcuguucgagaaaacaaagaaacagcuucgggaaaacgcggaggauauggggaauggaugcuuuaagauuuaccacaagugugacaacgccugcaucggcucuaucagaaaugggaccuaugaucaugacguuuaccgcgacgaggcucugaacaaucgguuccagauuaaaggcguggaacucaaguccggauacaaagauuggauccuguggauuagcuuugccaucucuugcuuccuucugugugucgcccuccugggcuuuauuaugugggcuugccaaaaggggaacaucagauguaauaucugcauuuga

SEQ ID NO: 194336 - RNA, 1701 nt, Artificial Sequence; identical to SEQ ID NO: 185458
  derived and/or modified sequence opt5 from hemagglutinin__InfluenzaA__AHL90662

SEQ ID NO: 194337 - RNA, 1701 nt, Artificial Sequence
  derived and/or modified sequence opt5 from hemagglutinin__InfluenzaA__AHL90674
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgacaagcuguacauuuggggcgugcaccauccugggacggauaaugaccagaucuuucucuaugcgcaggccucuggacgcauuacaguuuccaccaaaagaagccaacagacagugaucccgaacauuggcucccggccccgcgucagaaauaucccuucucggaucagcauuuacuggaccaucgugaagcccggggauauucugcugaucaacuccaccggaaaucucauugcuccucgcggcuacuucaaaaucagaagcgggaagucuuccaucaugcggagcgacgcccccauuggaaaguguaacucugaaugcaucacaccgaauggcagcauuccuaacgacaaacccuuucagaaugugaaccgcaucacguauggcgcuuguccuagauacgucaagcagaauacccugaaacuugccacagggaugcggaacguucccgagaagcaaacccgcggaauuuucggcgcgaucgccggguuuaucgaaaauggaugggagggcaugguggaugggugguauggauucagacaccagaacuccgagggcauuggccaggcugccgaccugaaaucuacacaagcugccaucgaucagauuaaugggaagcucaaccggcugaucggaaaaaccaacgaaaaguuccaccagauugagaaggaauuuagcgagguggaaggcagaauccaggaccuugagaaauacgucgaggauacgaagauugaccugugguccuauaaugccgaacuccugguggcucuggagaaccaacauacaaucgaucucaccgacagcgaaaugaauaaacuguucgagaagaccaaaaagcagcuucgcgaaaacgcggaggauauggggaauggaugcuuuaagaucuaccacaaaugugacaacguuugcauuggcucuauccggaaugggacauaugaucaugacguguacagagacgaggcccugaacaaucgcuuccagauuaagggcgucgaacucaaauccggauacaaggauuggauccuguggauuagcuuugcuaucucuugcuuccuucuguguguggcccuccugggcuuuaucaugugggccugccagaaagggaacauucgguguaauaucugcauuuga

SEQ ID NO: 194338 - RNA, 1701 nt, Artificial Sequence
  derived and/or modified sequence opt5 from hemagglutinin__InfluenzaA__AHL90686
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggccccgcgucagaaauaucccuucucggaucagcauuuacuggaccaucgugaaacccggggauauucugcugaucaacuccaccggaaaucucauugcuccucgcggcuacuucaagaucagaagcgggaaaucuuccaucaugcggagcgacgcccccauuggaaaguguaacucugaaugcaucacaccgaauggcagcauuccuaacgacaagcccuuucagaaugugaaccgcaucacguauggcgcuuguccuagauacgucaaacaaaauacccugaaacuugccacagggaugcggaacguucccgagaagcagacccgcggaauuuucggcgcgaucgccggguuuaucgaaaauggaugggagggcaugguggaugggugguauggauucagacaccagaacuccgagggccggggccaagcugccgaccugaagucuacacaggcugccauugaucagaucaaugggaaacucaacagacugauuggaaagaccaacgaaaaauuccaccagaucgagaaggaauuuagcgagguggaaggccgcauucaagaccuugagaaguacgucgaggauacgaaaaucgaccugugguccuauaaugccgaacuccugguggcuauggagaaccagcauacaauugaucugaccgacagcgaaaugaauaaacucuucgagaagaccaagaaacagcugcgggaaaacgcggaggauauggggaauggaugcuuuaagaucuaccacaagugugacaacgccugcaucggcucuauuagaaaugggacauaugaucaugacguuuaccgcgacgaggcucuuaacaaucgguuccagaucaaaggcguggaacugaaguccggauacaaagauuggauucucuggaucagcuuugccauuucuugcuuccugcuuugugucgcccugcucggcuuuaucaugugggcuugccaaaaggggaacaucagauguaauauuugcaucuga

SEQ ID NO: 194339 - RNA, 1701 nt, Artificial Sequence; identical to SEQ ID NO: 185458
  derived and/or modified sequence opt5 from hemagglutinin__InfluenzaA__AHL90698

SEQ ID NO: 194340 - RNA, 1701 nt, Artificial Sequence; identical to SEQ ID NO: 185458
  derived and/or modified sequence opt5 from hemagglutinin__InfluenzaA__AHL90710

SEQ ID NO: 194341 - RNA, 1698 nt, Artificial Sequence; identical to SEQ ID NO: 188996
  derived and/or modified sequence opt5 from hemagglutinin__InfluenzaA__AHL90722

SEQ ID NO: 194342 - RNA, 1698 nt, Artificial Sequence
  derived and/or modified sequence opt5 from hemagglutinin__InfluenzaA__AHL90746
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucaagcgguuugaaaucuuccccaaagagagcucuuggccuaaccacacggugaccggaguuuccgccagcugcucucauaauggcgaguccagcuuuuaucgcaaccugcuuuggcugacaggcaagaaugggcucuaccccaaccugucuaaauccuaugcuaauaacaaggaaaaagaggugcugguccucuggggagugcaccacccuccgaacaucguggaccagaagacccuguacagaacagaaaaugccuacgucagcguuguguccucucauuauagccggaaguucacccccgagauugcuaaacgcccuaaggugagagaucaggaaggccggaucaacuacuauuggacgcuucuggagcccggggacacaauuaucuuugaggccaauggaaaccucauugcgccucgcuacgccuucgcucuguccagaggcuuugggagcggaaucauuaauucuaacgcccccaugggcaaaugugaugcuaagugccagaccccgcaaggcgccaucaauuccagccuuccuuuccagaacguccaccccgugacaaucggggaauguccuaaauauguucggucugcgaagcugcgcauggugaccggacucagaaauauucccagcauccagucccggggccuguuuggggccauugcuggauucaucgagggcggguggaccggaauggucgacggcugguacggcuaucaucaccagaacgaacaagggucuggauacgccgcugaucagaaaagcacacagaaugccauuaacggcaucacgaauaaggugaacuccguuaucgagaagaugaauacccaguuuacagccguggggaaagaguucaacaagcuggaacgcagaauggagaaccucaauaaaaaggucgacgauggauucauugacaucuggaccuacaacgcugaacugcuugugcugcucgagaaugaacggacacuggauuuucacgacagcaacgucaaaaaucuuuaugagaaggugaagucucaacugaaaaacaaugcgaaggaaauuggcaacgggugcuucgaguuuuaccauaaauguaaugacgagugcauggaauccguuaagaacggcaccuaugauuaccccaaauauagcgaggaaucuaagcucaaucgcgagaagaucgacggagugaaacuggaguccaugggcgucuaccagauucuggccaucuauagcacgguggcuuccucucucguucugcuugugagccugggggccaucuccuucuggaugugcucuaacggaagccuccaguguagaauuugcaucuga

SEQ ID NO: 194343 - RNA, 1698 nt, Artificial Sequence; identical to SEQ ID NO: 186155
  derived and/or modified sequence opt5 from hemagglutinin__InfluenzaA__AHL90758

SEQ ID NO: 194344 - RNA, 1698 nt, Artificial Sequence
  derived and/or modified sequence opt5 from hemagglutinin__InfluenzaA__AHL90770
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggacagcucuuggccuaaccacacggugaccggaguuuccgccagcugcucucauaauggcgaguccagcuuuuaucgcaaccugcuuuggcugacaggcaaaaaugggcucuaccccaaccugucuaaguccuaugcuaauaacaaagaaaaggaggugcugguccucuggggagugcaccacccuccgagcaucaacgaucagaaaacccuguaccauacagaaaaugccuacguguccgucguuucuagccaccauuccagaaaguucacccccgagauugcuaagcggccuaaagugcgcgaccaggaaggcagaaucaacuauuacuggacgcuucuggagcccggggauacaauuaucuuugaggccaauggaaaccucauugcgccucgguaugccuucgcucugagccgcggcuuugggucuggaaucauuaauuccaacgcccccauggacaagugugaugcuaaaugccagaccccgcaaggcgccaucaauagcucucuuccuuuccagaacgugcaccccgucacaaucggcgaauguccuaaguacgugagaagcgcgaaacugcggaugguuaccgggcuccgcaauauucccuccauccagucuagaggacuguuuggcgccauugcuggguucaucgagggaggcuggaccgggaugguggacggaugguauggcuaccaccaucagaacgaacaaggcagcggguaugccgcugaucagaaguccacacagaaugccauuaacggaaucacgaauaaagucaacagcgugaucgagaagaugaauacccaguuuacagccguuggcaaggaguucaacaaacuggaacggcgcauggagaaccucaauaagaaaguggacgauggguucauugacaucuggaccuacaacgcugaacugcuuguccugcucgagaaugaaagaacacuggacuuucacgauucuaacgugaagaaucuuuacgagaaagucaagucccaacugaagaacaaugcgaaagaaauuggaaacggcugcuucgaguuuuaucauaaguguaaugacgagugcauggaaagcgugaaaaacgggaccuacgauuaucccaaguacucugaggaauccaaacucaaucgggagaagaucgacggcguuaagcuggagagcaugggaguguaucagauucugacgaucuacuccacagucgccucuagccucgugcugcuuguuucccugggcgcuaucucuuucuggaugugcagcaacgggucccuccagugucgcauuugcaucuga

SEQ ID NO: 194345 - RNA, 1698 nt, Artificial Sequence; identical to SEQ ID NO: 186640
  derived and/or modified sequence opt5 from hemagglutinin__InfluenzaA__AHL90782

SEQ ID NO: 194346 - RNA, 1698 nt, Artificial Sequence
  derived and/or modified sequence opt5 from hemagglutinin__InfluenzaA__AHL90794
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaauacccuguaccauacagagaacgccuacgugagcgucguuuccucucacuauagcagaaaauucacccccgaaauugcuaagcggccuaaggugcgcgaucaggaggggagaaucaauuacuauuggacgcuucuggagcccggagacacaauuaucuuugaagccaacggcaaucucauugcgccucgguacgccuucgcucugucccgcggguuuggaagcggcaucauuaacucuaaugcccccauggauaaaugugacgcuaagugccagaccccgcaaggcgccaucaacuccagccuuccuuuccagaaugugcaucccgucacaaucggggaguguccuaaauaugugagaucugcgaagcugcggaugguuaccggacuccgcaacauucccagcauccaguccagaggccuguuuggggccauugcuggauucaucgaaggcggguggaccggaaugguggauggcugguacggcuaucaccaccagaaugagcaagggucuggauacgccgcugaccagaaaagcacacagaacgccauuaauggcaucacgaacaaggucaauuccgugaucgaaaagaugaacacccaguuuacagccguugggaaagaguucaacaagcuggagcggcgcauggaaaaucucaacaaaaagguggaugacggauucauugauaucuggaccuacaaugcugagcugcuuguccugcucgaaaacgagagaacacuggacuuucaugacagcaaugugaaaaaccuuuaugaaaaggucaaaucucaacugaagaauaacgcgaaggagauuggcaaugggugcuucgaguuuuaccacaaauguaacgaugaaugcauggaguccgugaagaauggcaccuaugacuaccccaaauauagcgaagagucuaagcucaaccgggagaaaaucgauggaguuaagcuggaauccaugggcguguaccagauucuggccaucuauagcacggucgcuuccucucucgugcugcuuguuagccugggggccaucuccuucuggaugugcucuaauggaagccuccagugucgcauuugcaucuga

SEQ ID NO: 194347 - RNA, 1698 nt, Artificial Sequence
  derived and/or modified sequence opt5 from hemagglutinin__InfluenzaA__AHL90806
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucguggaccagaaaacccuguacagaacagagaaugccuacgucagcguuguguccucucauuauagccggaaguucacccccgaaauugcuaagcgcccuaaagugagagaucaggagggccggaucaacuacuauuggacgcuucuggagcccggggacacaauuaucuuugaagccaauggaaaccucauugcgccucgcuacgccuucgcucuguccagaggcuuugggagcggaaucauuaauucuaacgcccccauggauaagugugacgcuaaaugccagaccccgcaaggcgccaucaauuccagccuuccuuuccagaacguccaccccgugacaaucggcgaguguccuaaguauguucggucugcgaaacugcgcauggugaccgggcucagaaauauucccagcauccagucccggggacuguuuggcgccauugcuggguucaucgaaggaggcuggaccgggauggucgauggaugguacggcuaucaucaccagaacgagcaaggcucuggguacgccgcugaccaaaagagcacacagaaugccauuaacggaaucacgaauaaagugaacuccguuaucgaaaagaugaauacccaguuuacagccgugggcaaggaguucaacaaacuggagcgcagaauggaaaaccucaauaagaaagucgaugacggguucauugauaucuggaccuacaacgcugagcugcuugugcugcucgaaaaugagcggacacuggacuuucacgacagcaacgucaagaaucuuuaugaaaaagugaagucucagcugaagaacaaugcgaaagagauuggaaacggcugcuucgaguuuuaccauaaguguaaugaugaaugcauggaguccguuaaaaacgggaccuaugacuaccccaaguauagcgaagagucuaaacucaaucgcgagaagaucgauggcgugaagcuggaauccaugggagucuaccagauucuggccaucuauagcacgguggcuuccucucucguucugcuuaucagccugggcgccauuuccuucuggaugugcucuaacgggagccuccaguguagaaucugcauuuga

SEQ ID NO: 194348 - RNA, 1698 nt, Artificial Sequence; identical to SEQ ID NO: 188996
  derived and/or modified sequence opt5 from hemagglutinin__InfluenzaA__AHL90818

SEQ ID NO: 194349 - RNA, 1698 nt, Artificial Sequence; identical to SEQ ID NO: 188996
  derived and/or modified sequence opt5 from hemagglutinin__InfluenzaA__AHL90830

SEQ ID NO: 194350 - RNA, 1698 nt, Artificial Sequence; identical to SEQ ID NO: 186155
  derived and/or modified sequence opt5 from hemagglutinin__InfluenzaA__AHL90842

SEQ ID NO: 194351 - RNA, 1698 nt, Artificial Sequence; identical to SEQ ID NO: 188537
  derived and/or modified sequence opt5 from hemagglutinin__InfluenzaA__AHL90854

SEQ ID NO: 194352 - RNA, 1698 nt, Artificial Sequence; identical to SEQ ID NO: 186155
  derived and/or modified sequence opt5 from hemagglutinin__InfluenzaA__AHL90866

SEQ ID NO: 194353 - RNA, 1698 nt, Artificial Sequence; identical to SEQ ID NO: 188537
  derived and/or modified sequence opt5 from hemagglutinin__InfluenzaA__AHL90878

SEQ ID NO: 194354 - RNA, 1698 nt, Artificial Sequence; identical to SEQ ID NO: 188996
  derived and/or modified sequence opt5 from hemagglutinin__InfluenzaA__AHL90890

SEQ ID NO: 194355 - RNA, 1698 nt, Artificial Sequence; identical to SEQ ID NO: 188537
  derived and/or modified sequence opt5 from hemagglutinin__InfluenzaA__AHL90902

SEQ ID NO: 194356 - RNA, 1698 nt, Artificial Sequence; identical to SEQ ID NO: 186155
  derived and/or modified sequence opt5 from hemagglutinin__InfluenzaA__AHL90914

SEQ ID NO: 194357 - RNA, 1698 nt, Artificial Sequence; identical to SEQ ID NO: 188537
  derived and/or modified sequence opt5 from hemagglutinin__InfluenzaA__AHL90938

SEQ ID NO: 194358 - RNA, 1698 nt, Artificial Sequence; identical to SEQ ID NO: 188537
  derived and/or modified sequence opt5 from hemagglutinin__InfluenzaA__AHL90950

SEQ ID NO: 194359 - RNA, 1698 nt, Artificial Sequence; identical to SEQ ID NO: 188537
  derived and/or modified sequence opt5 from hemagglutinin__InfluenzaA__AHL90962

SEQ ID NO: 194360 - RNA, 1698 nt, Artificial Sequence
  derived and/or modified sequence opt5 from hemagglutinin__InfluenzaA__AHL90974
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgagcaucuccgaccagaaaacccuguaccauacagagaacgccuacgugucugucguuagcucccacuauagcagaaaguucacccccgaaguggcuaagcggccuaaagugcgcgaucaggagggcagaauuaauuacuauuggacgcuucuggagcccggggacacaaucauuuuugaagccaacggaaaucucaucgcgccucgguacgccuucgcucugucucgcggcuuuggguccggaauuaucaacagcaaugcccccauggauaagugugacgcuaaaugccagaccccgcaaggcgccauuaacucuagccuuccuuuccagaauguccaucccgugacaaucggcgaguguccuaaguauguuagauccgcgaaacugcggauggugaccgggcuccgcaacauccccucuauucagagcagaggacuguuuggcgccaucgcuggguucauugaaggaggcuggaccgggauggucgauggaugguacggcuaucaccaccagaaugagcaaggcuccggguacgccgcugaccagaagucuacacagaacgccaucaauggaauuacgaacaaagugaauagcguuaucgaaaagaugaacacccaguuuacagccgugggcaaggaguucaauaaacuggagcggcgcauggaaaaccucaacaagaaagucgaugacggguucaucgauauuuggaccuacaaugcugagcugcuugugcugcucgaaaacgagagaacacuggacuuucaugacuccaaugucaagaaccuuuaugaaaaagugaagggacaacugaagaauaacgcgaaagagaucggcaaugggugcuucgaguuuuaccacaaguguaacgaugaaugcauggagagcguuaaaaauggcaccuaugacuaccccaaguauucugaagaguccaaacucaaccgggagaagauugauggagugaagcuggaaagcaugggcgucuaccagauccuggccauuuauuccacgguggcuucuagccucguucugcuugugucccugggggccaucucuuucuggaugugcagcaauggaucccuccagugucgcaucugcauuuga

SEQ ID NO: 194361 - RNA, 1698 nt, Artificial Sequence
  derived and/or modified sequence opt5 from hemagglutinin__InfluenzaA__AHL90986
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacagugaaaaauggccucuaccccaaccugucuaaguccuaugcuaauaacaaagagaaggaaguccuggugcucuggggagugcaccacccuccgaacaucgucgaccagaaaacccuguacagaacagagaaugccuacguuagcgugguguccucucauuauagccggaaguucacccccgaaauugcuaagcgcccuaaagucagagaucaggaggggcggaucaacuacuauuggacgcuucuggagcccggcgacacaauuaucuuugaagccaaugggaaccucauugcgccucgcuacgccuucgcucuguccaagggauuuggcagcgggaucauuaauucuaacgcccccauggauaaaugugacgcuaagugccagaccccgagaggagccaucaauuccagccuuccuuuccaaaacgugcaccccguuacaaucggcgaguguccuaaauaugugcggucugcgaagcugcgcauggucaccggccucagaaauauucccagcauccagucccgggggcuguuuggagccauugcuggcuucaucgaagggggauggaccggcaugguggaugggugguacggauaucaucaccagaacgagcagggcucuggcuacgccgcugaccagaaaagcacacaaaaugccauuaacgggaucacgaauaagguuaacuccgugaucgaaaagaugaauacccaguuuacagccgucggaaaagaguucaacaagcuggagcgcagaauggaaaaccucaauaaaaagguggaugacggcuucauugauaucuggaccuacaacgcugagcugcuuguccugcucgaaaaugagcggacacuggacuuucacgacagcaacgugaaaaaucuuuaugaaaagguuaagucucagcugaaaaacaaugcgaaggagauugggaacggaugcuucgaguuuuaccauaaauguaaugaugaaugcauggaguccgugaagaacggcaccuaugacuaccccaaauauagcgaagagucuaagcucaaucgcgagaagaucgauggggucaaacuggaauccaugggcguguaccaaauucuggccaucuauagcacgguugcuuccucucucgugcugcuugucagccugggagccaucuccuucuggaugugcucuaacggcagccuccaguguagaauuugcaucuga

SEQ ID NO: 194362 - RNA, 1698 nt, Artificial Sequence
  derived and/or modified sequence opt5 from hemagglutinin__InfluenzaA__AHL91010
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggacagcucuuggccuaaccacacggugaccggaguuuccgccagcugcucucauaauggcgaguccagcuuuuaucgcaaccugcuuuggcugacaggcaaaaaugggcucuaccccaaccugucuaaguccuaugcuaauaacaaagaaaaggaggugcugguccucuggggagugcaccacccuccgagcaucaacgaucagaaaacccuguaccauacagaaaaugccuacguguccgucguuucuagccacuauuccagaaaguucacccccgagauugcuaagcggccuaaagugcgcgaccaggaaggcagaaucaacuacuauuggacgcuucuggagcccggggauacaauuaucuuugaggccaauggaaaccucauugcgccucgguacgccuucgcucugagccgcggcuuugggucuggaaucauuaauuccaacgcccccauggacaagugugaugcuaaaugccagaccccgcaaggcgccaucaauagcucucuuccuuuccagaacgugcaucccgucacaaucggcgaauguccuaaguaugugagaagcgcgaaacugcggaugguuaccgggcuccgcaauauucccuccauccagucuagaggacuguuuggcgccauugcuggguucaucgagggaggcuggaccgggaugguggacggaugguacggcuaucaccaccagaacgaacaaggcagcggguacgccgcugaucagaaguccacacagaaugccauuaacggaaucacgaauaaagucaacagcgugaucgagaagaugaauacccaguuuacagccguuggcaaggaguucaacaaacuggaacggcgcauggagaaccucaauaagaaaguggacgauggguucauugacaucuggaccuacaacgcugaacugcuuguccugcucgagaaugaaagaacacuggacuuucaugauucuaacgugaagaaucuuuaugagaaagucaagucccaacugaagaacaaugcgaaagaaauuggaaacggcugcuucgaguuuuaccacaaguguaaugacgagugcauggaaagcgugaaaaacgggaccuaugauuaccccaaguauucugaggaauccaaacucaaucgggagaagaucgacggcguuaagcuggagagcaugggaguguaccagauucugacgaucuauuccacagucgccucuagccucgugcugcuuguuucccugggcgcuaucucuuucuggaugugcagcaacgggucccuccagugucgcauuugcaucuga

SEQ ID NO: 194363 - RNA, 1698 nt, Artificial Sequence
  derived and/or modified sequence opt5 from hemagglutinin__InfluenzaA__AHL91022
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggacagcucuuggccuaaccacacggugaccggaguuuccgccagcugcucucauaauggcgagaacuccuuuuaucgcaaucugcuuuggcugacaggcaaaaacgggcucuaccccaaucugagcaagucuuaugcuaacaacaaagaaaaggaggugcugguccucuggggagugcaccacccuccguccaucaaugaucagaaaacccuguaccauacagaaaacgccuacgugagcgucguuuccucucacuauagcagaaaguucacccccgagauugcuaagcggccuaaagugcgcgaccaggaaggcagaaucaauuacuauuggacgcuucuggagcccggggauacaauuaucuuugaggccaacggaaaucucauugcgccucgguacgccuucgcucugucccgcggcuuugggagcggaaucauuaacucuaaugcccccauggacaagugugaugcuaaaugccagaccccgcaaggcgccaucaacuccagccuuccuuuccagaaugugcaucccgucacaaucggcgaauguccuaaguaugugagaucugcgaaacugcggaugguuaccgggcuccgcaacauucccagcauccaguccagaggacuguuuggcgccauugcuggguucaucgagggaggcuggaccgggaugguggacggaugguacggcuaucaccaccagaaugaacaaggcucuggguacgccgcugaucaaaagagcacacagaacgccauuaauggaaucacgaacaaagucaauuccgugaucgagaagaugaacacccaguuuacagccguuggcaaggaguucaacaaacuggaacggcgcauggagaaucucaacaagaaaguggacgauggguucauugacaucuggaccuacaaugcugaacugcuuguccugcucgagaacgaaagaacacuggacuuucaugauagcaaugugaagaaccuuuaugagaaagucaagucucagcugaagaauaacgcgaaagaaauuggaaauggcugcuucgaguuuuaccacaaguguaacgacgagugcauggaauccgugaaaaaugggaccuaugauuaccccaaguauagcgaggaaucuaaacucaaccgggagaagaucgacggcguuaagcuggaguccaugggaguguaccagauucugacgaucuauagcacagucgccuccucucucgugcugcuuguuagccugggcgcuaucuccuucuggaugugcucuaaugggagccuccagugucgcauuugcaucuga

SEQ ID NO: 194364 - RNA, 1701 nt, Artificial Sequence; identical to SEQ ID NO: 185458
  derived and/or modified sequence opt5 from hemagglutinin__InfluenzaA__AHL91034

SEQ ID NO: 194365 - RNA, 1701 nt, Artificial Sequence; identical to SEQ ID NO: 188524
  derived and/or modified sequence opt5 from hemagglutinin__InfluenzaA__AHL91046

SEQ ID NO: 194366 - RNA, 1701 nt, Artificial Sequence; identical to SEQ ID NO: 194338
  derived and/or modified sequence opt5 from hemagglutinin__InfluenzaA__AHL91058

SEQ ID NO: 194367 - RNA, 1701 nt, Artificial Sequence
  derived and/or modified sequence opt5 from hemagglutinin__InfluenzaA__AHL91070
augaagaccaucauugcccugagcuacauccucugccugguguucgcucagaaacuucccggcaacgacaauuccauggccacacugugucucgggcaccaugcggucccuaacggaacgauuguuaagaccaucacaaaugaucaaauugaggugaccaacgcuacagaacuggugcagucuagcuccaccggcgagaucugcgacucuccgcaccagauccuugauggggaaaauuguacacugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacccuugaauuuaacaaugagucuuucaacuggacgggagugacccagaauggcacauccagcgcuugcaugcgcagaucuaacaauuccuuuuucagccggcugaacuggcucacccaucugaaguuuaaguauccugcccuuaaugucacaaugcccaacaacgagcaguucgacaaacuguacaucuggggcgugcaccauccugggaccgauaaugaccagauuuuucucuaugcgcaagccucuggacgcaucacgguuuccacaaagagaagccagcagaccgugauuccgaacaucggcucccggccccgcgucagaaauauuccuucucggaucagcaucuacuggacaauugugaaacccggggauauccugcugauuaacuccaccggaaaucucaucgcuccucgcggcuacuucaagauuagaagcgggaaaucuuccaucaugcggagcgacgcccccaucggaaaguguaacucugaaugcauuaccccgaauggcagcaucccuaacgacaagcccuuucagaaugugaaccgcauuacauauggcgcuuguccuagauacgucaaacaaaauacgcugaaacuugccaccgggaugcggaacguucccgagaagcagacacgcggaaucuucggcgcgauugccggguuuaucgaaaauggaugggagggcaugguggaugggugguauggauucagacaccagaacuccgagggccggggccaagcugccgaccugaagucuacccaggcugccaucgaucagauuaaugggaaacucaacagacugaucggaaagacaaacgaaaaauuccaccagauugagaaggaauuuagcgagguggaaggccgcauccaagaccuugagaaguacgucgaggauaccaaaauugaccugugguccuauaaugccgaacuccugguggcucuggagaaccagcauacgaucgaucucacagacagcgaaaugaauaagcuguucgagaaaaccaagaaacagcuucgggaaaacgcggaggauauggggaauggaugcuuuaagauuuaccacaagugugacaacgccugcaucggcucuaucagaaaugggaccuaugaucaugacguuuaccgcgacgaggcucugaacaaucgguuccagauuaaaggcguggaacucaaguccggauacaaagauuggauccuguggauuagcuuugccaucucuugcuuccuucugugugucgcccuccugggcuuuauuaugugggcuugccaaaaggggaacaucagauguaauaucugcauuuga

SEQ ID NO: 194368 - RNA, 1701 nt, Artificial Sequence
  derived and/or modified sequence opt5 from hemagglutinin__InfluenzaA__AHL91082
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggccccgcgucagaaauaucccuucucggaucagcauuuacuggaccaucgugaaacccggggauauucugcugaucaacuccaccggaaaucucauugcuccucgcggcuacuucaagaucagaagcgggaaaucuuccaucaugcggagcgacgcccccauuggaaaguguaacucugaaugcaucacaccgaauggcagcauuccuaacgacaagcccuuucagaaugugaaccgcaucacguauggcgcuuguccuauuuacgucaaacaaaauacccugaaacuugccacagggaugagaaacguucccgagaagcagacccggggaaucuucggcgcgaucgccggguuuauugaaaauggaugggagggcaugguggaugggugguauggauuccgccaccagaacuccgagggcagaggccaagcugccgaccugaagucuacacaggcugccaucgaucagauuaaugggaaacucaaccggcugaucggaaagaccaacgaaaaauuccaccagauugagaaggaauuuagcgagguggaaggcagaauccaagaccuugagaaguacgucgaggauacgaaaauugaccugugguccuauaaugccgaacuccugguggcucuggagaaccagcauacaaucgaucucaccgacagcgaaaugaauaagcuguucgagaaaaccaagaaacagcuucgcgaaaacgcggaggauauggggaauggaugcuuuaagaucuaccacaagugugacaacgccugcauuggcucuauccggaaugggacauaugaucaugacguuuacagagacgaggcucugaacaaucgcuuccagauuaaaggcguggaacucaaguccggauacaaagauuggauccuguggauuagcuuugccaucucuugcuuccuucugugugucgcccuccugggcuuuaucaugugggcuugccaaaaggggaacauucgguguaauaucugcauuuga

SEQ ID NO: 194369 - RNA, 1701 nt, Artificial Sequence; identical to SEQ ID NO: 188443
  derived and/or modified sequence opt5 from hemagglutinin__InfluenzaA__AHL91094

SEQ ID NO: 194370 - RNA, 1701 nt, Artificial Sequence
  derived and/or modified sequence opt5 from hemagglutinin__InfluenzaA__AHL91106
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccaaaggcgagaucugcgacucuccgcaccagauccuugauggggaaaauuguacacugauugacgcccuccugggagauccccagugcgacggcuuucaaaacaagaaaugggaucuguucgucgagagaagcaaggccuauuccaauuguuacccuuaugacgugcccgauuacgcuucucuccggagccugguugccuccagcgggacccuugaauuuaacaaugagucuuucaacuggacgggagugacccagaauggcacauccagcgcuugcauccgcagaucuaacaauuccuuuuucagccggcugaacuggcucacccaucugaaguuuaaauauccugcccuuaaugucacaaugcccaacaacgagcaguucgacaagcuguacauuuggggcgugcaccauccugggaccgauaaugaccagaucuuucucuaugcgcaagccucuggacgcauuacgguuuccacaaaaagaagccagcagaccgugaucccgaacauuggcucccggccccgcgucagaaauaucccuucucggaucagcauuuacuggacaaucgugaagcccggggauauucugcugaucaacuccaccggaaaucucauugcuccucgcggcuacuucaaaaucagaagcgggaagucuuccaucaugcggagcgacgcccccauuggaaaguguaacucugaaugcaucaccccgaauggcagcauuccuaacgacaaacccuuucagaaugugaaccgcaucacauauggcgcuuguccuagauacgucaagcaaaauacgcugaaacuugccaccgggaugcggaacguucccgagaagcagacacgcggaauuuucggcgcgaucgccggguuuaucgaaaauggaugggagggcaugguggaugggugguauggauucagacaccagaacuccgagggccggggccaagcugccgaccugaaaucuacccaggcugccauugaucagaucaaugggaagcucaacagacugauuggaaaaacaaacgaaaaguuccaccagaucgagaaggaauuuagcgagguggaaggccgcauucaagaccuugagaaauacgucgaggauaccaagaucgaccugugguccuauaaugccgaacuccugguggcucuggagaaccagcauacgauugaucucacagacagcgaaaugaauaaacuguucgagaagaccaaaaagcagcuucgggaaaacgcggaggauauggggaauggaugcuuuaagaucuaccacaaaugugacaacgccugcaucggcucuauuagaaaugggaccuaugaucaugacguuuaccgcgacgaggcucugaacaaucgguuccagaucaagggcguggaacucaaauccggauacaaggauuggauucuguggaucagcuuugccauuucuugcuuccuucugugugucgcccuccugggcuuuaucaugugggcuugccaaaaagggaacaucagauguaauauuugcaucuga

SEQ ID NO: 194371 - RNA, 1701 nt, Artificial Sequence
  derived and/or modified sequence opt5 from hemagglutinin__InfluenzaA__AHL91118
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagcaagcugaacuggcucacacaucugaaguuuaaauauccugcccuuaaugucaccaugcccaacaacgagcaguucgacaagcuguacauuuggggcgugcaccauccugggacggauaaugaccagaucuuucucuaugcgcaagccucuggacggauuacaguuuccaccaaacgcagccagcagacagugaucccgaacauuggcuccagaccccggguccgcaauaucccuucuagaaucagcauuuacuggaccaucgugaagcccggggauauucugcugaucaacuccaccggaaaucucauugcuccucggggcuacuucaaaauccgcagcgggaagucuuccaucaugagaagcgacgcccccauuggaaaguguaacucugaaugcaucacaccgaauggcagcauuccuaacgacaaacccuuucagaaugugaaccggaucacguauggcgcuuguccucgcuacgucaagcaaaauacccugaaacuugccacagggaugagaaacguucccgagaagcagacccggggaauuuucggcgcgaucgccggguuuaucgaaaauggaugggagggcaugguggaugggugguauggauuccgccaccagaacuccgagggcagaggccaagcugccgaccugaaaucuacacaggcugccauugaucagaucaaugggaagcucaaccggcugauuggaaaaaccaacgaaaaguuccaccagaucgagaaggaauuuagcgagguggaaggccgcauucaagaccuugagaaauacgucgaggauacgaagaucgaccugugguccuauaaugccgaacuccuggugacacuggagaaccagcauaccauugaucucaccgacagcgaaaugaauaaacuguucgagaagaccaaaaagcagcuuagagaaaacgcugaggauauggggaauggaugcuuuaagaucuaccacaaaugugacaacgcgugcaucggcucuauucggaaugggacauaugaucaugacguuuacagagacgaggcccugaacaaucgcuuccagaucaagggcguggaacucaaauccggauacaaggauuggauucuguggaucagcuuugcuauuucuugcuuccuucugugugucgcccuccugggcuuuaucaugugggccugccaaaaagggaacauccgguguaauauuugcaucuga

SEQ ID NO: 194372 - RNA, 1701 nt, Artificial Sequence
  derived and/or modified sequence opt5 from hemagglutinin__InfluenzaA__AHL91130
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugaucgccuccagcgggacgcuugaauuuaacaaugagucuuucaacuggaccggaguuacacagaauggcaccuccagcgcuugcauucgcagaucuaacaauuccuuuuucagccggcugaacuggcucacacaucugaaguuuaaguauccugcccuuaaugugaccaugcccaacaacgagcaguucgacaaacuguacaucuggggcguccaccauccugggacggauaaugaccagauuuuucucuaugcgcaagccucuggacgcaucacaguguccaccaagagaagccagcagacaguuauuccgaacaucggcucccggccccgcgugagaaauaucccuucucggauuagcaucuacuggaccauugucaaacccggggauauccugcugauuaacuccaccggaaaucucaucgcuccucgcggcuacuucaagaucagaagcgggaaaucuuccauuaugcggagcgacgcccccaucggaaaguguaacucugaaugcauuacaccgaauggcagcaucccuaacgacaagcccuuucagaaugugaaccgcauuacguauggcgcuuguccuagauacgugaaacaaaauacccugaaacuugccacagggaugcggaacguccccgagaagcagacccgcggaaucuucggcgcgaucgccggguuuauugaaaauggaugggagggcaugguugaugggugguauggauucagacaccagaacuccgagggccggggccaagcugccgaccugaagucuacacaggcugccaucgaucagauuaaugggaaacucaacagacugaucggaaagaccaacgaaaaauuccaccagauugagaaggaauuuagcgagguggaaggccgcauccaagaccuugagaaguacguggaggauacgaaaauugaccugugguccuauaaugccgaacuccuggucgcucuggagaaccagcauacaaucgaucucaccgacagcgaaaugaauaagcuguucgagaaaaccaagaaacagcuucgggaaaacgcggaggauauggggaauggaugcuuuaagaucuaccacaagugugacaacgccugcauuggcucuaucagaaaugggacauaugaucauaacguguaccgcgacgaggcucugaauaaccgguuccagauuaaaggcguugaacucaaguccggauacaaagacuggauccuguggauuagcuuugccaucucuugcuuccuucuguguguggcccuccugggcuuuaucaugugggcuugccaaaaggggaauauuagauguaacaucugcauuuga

SEQ ID NO: 194373 - RNA, 1701 nt, Artificial Sequence; identical to SEQ ID NO: 185458
  derived and/or modified sequence opt5 from hemagglutinin__InfluenzaA__AHL91142

SEQ ID NO: 194374 - RNA, 1701 nt, Artificial Sequence; identical to SEQ ID NO: 185458
  derived and/or modified sequence opt5 from hemagglutinin__InfluenzaA__AHL91154

SEQ ID NO: 194375 - RNA, 1701 nt, Artificial Sequence; identical to SEQ ID NO: 183654
  derived and/or modified sequence opt5 from hemagglutinin__InfluenzaA__AHL91166

SEQ ID NO: 194376 - RNA, 1701 nt, Artificial Sequence; identical to SEQ ID NO: 193491
  derived and/or modified sequence opt5 from hemagglutinin__InfluenzaA__AHL94984

SEQ ID NO: 194377 - RNA, 1701 nt, Artificial Sequence; identical to SEQ ID NO: 193491
  derived and/or modified sequence opt5 from hemagglutinin__InfluenzaA__AHL94996

SEQ ID NO: 194378 - RNA, 1701 nt, Artificial Sequence; identical to SEQ ID NO: 192859
  derived and/or modified sequence opt5 from hemagglutinin__InfluenzaA__AHL95008

SEQ ID NO: 194379 - RNA, 1701 nt, Artificial Sequence; identical to SEQ ID NO: 193021
  derived and/or modified sequence opt5 from hemagglutinin__InfluenzaA__AHL95020

SEQ ID NO: 194380 - RNA, 1701 nt, Artificial Sequence; identical to SEQ ID NO: 193018
  derived and/or modified sequence opt5 from hemagglutinin__InfluenzaA__AHL95032

SEQ ID NO: 194381 - RNA, 1701 nt, Artificial Sequence; identical to SEQ ID NO: 192892
  derived and/or modified sequence opt5 from hemagglutinin__InfluenzaA__AHL95044

SEQ ID NO: 194382 - RNA, 1701 nt, Artificial Sequence; identical to SEQ ID NO: 192882
  derived and/or modified sequence opt5 from hemagglutinin__InfluenzaA__AHL95056

SEQ ID NO: 194383 - RNA, 1701 nt, Artificial Sequence; identical to SEQ ID NO: 193021
  derived and/or modified sequence opt5 from hemagglutinin__InfluenzaA__AHL95068

SEQ ID NO: 194384 - RNA, 1701 nt, Artificial Sequence; identical to SEQ ID NO: 193569
  derived and/or modified sequence opt5 from hemagglutinin__InfluenzaA__AHL95080

SEQ ID NO: 194385 - RNA, 1701 nt, Artificial Sequence; identical to SEQ ID NO: 192892
  derived and/or modified sequence opt5 from hemagglutinin__InfluenzaA__AHL95092

SEQ ID NO: 194386 - RNA, 1701 nt, Artificial Sequence
  derived and/or modified sequence opt5 from hemagglutinin__InfluenzaA__AHL95104
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcaugagaggcagcaauucuuccuuuuucagccggcugaacuggcucacacaucugaauuuuaaguauccugcgcuuaacgucaccaugcccaacaaugagcaguucgacaagcuguacauuuggggagugcaccauccugggacagauaaagaccagaucuuucucuaugcccagucuuccggccgcauuaccguuagcacgaagagaucccaacaggcugugaucccgaacauugggucucggccccgcaucagaaauaucccuagccggauuuccaucuacuggacaauugucaaacccggagauauccugcugauuaacagcaccggcaaucucaucgccccucgcggguacuucaagaucagaucuggaaaauccagcauuaugcggucugacgcucccaucggcaaguguaagagcgaaugcauuacaccgaacggcuccaucccuaaugacaaacccuuucagaacgugaaucgcauuaccuauggggccuguccuagauacgugaagcagucuacccugaaacuugcgacaggaaugcggaacguccccgagaagcaaacgcgcggcaucuucggggccaucgcuggauuuauugaaaauggcugggaggggaugauggauggaugguauggcuucagacaccagaacagcgagggccgggggcaggccgcugaccugaaauccacccaagccgccaucgaucagauuaauggaaagcucaacagacugaucggcaaaacaaaugaaaaguuccaccagauugagaaggaauuuagcgagguugaagggcgcauccaggaccuugagaaauacguggaggauaccaagauugaccuguggucuuauaacgcugaacuccugguggcgcuggagaaccaacauacaaucgaucucaccgacuccgaaaugaauaaacuguucgagaagacgaaaaagcagcuucgggaaaacgccgaggauaugggaaauggcugcuuuaagaucuaccacaaaugugacaacgcuugcauugggagcaucagaaauggcacauaugaucaugacgucuaccgcgacgaggcccugaacaaucgguuccagauuaagggaguggaacucaaaucuggcuacaaggauuggauccuguggauuuccuuugccaucagcugcuuccuucuguguguugcucuccugggguuuaucaugugggccugccagaaaggaaacauuagauguaauaucugcauuuga

SEQ ID NO: 194387 - RNA, 1701 nt, Artificial Sequence
  derived and/or modified sequence opt5 from hemagglutinin__InfluenzaA__AHL95116
augaagaccaucauugcccugagcuacauccucugccugguguucgcucaggagcuucccggcaacgacgauuccacagccacgcugugucucgggcacuaugcggucccuaauggaaccauuguuaaaacaaucaccaacgaccaaauugaagugacaaaugcuaccgagcuggugcagucuagcuccacaggcgaaaucugcaacucuccgcaucagauccuugauggggagaauuguacccugauugacgcccuccugggagauccccagugcgacggcuuucaaaacaagaaaugggaucuguucgucgaaagaagcaaggcccacuccaauuguuacccuuaugacgugcccgauuacgcuucucuccggagccugguugccuccagcgggacgcuugaguuuaacaaugagucuuucaacuggaccggagugacacagaauggcaccuccagcgcuugcauccgcagaucuaacaauuccuuuuucagccggcugaacuggcucacacaucugaauuuuaaauauccugcccuuaacgucaccaugcccaacaaugaacaguucgacaagcuguacauuuggggcgugcaccauccugggacggauaaggaccagaucuuucucuaugcgaaagccucuggacgcauuacaguuuccaccaagagaagccaacaggcugugaucccgaacauuggcucccggccccgcgucagaaauaucccuucucgggugagcaucuacuggacaauugugaaacccggggauauccugcugauuaacuccaccggaaaucucaucgccccucgcggcuacuucaagauuagaagcgggaaaucuuccaucaugcggagcgacgcucccaucggaaaguguaacucugccugcauuaccccgaauggcagcaucccuaacgacaagcccuuucagaaugucaaccgcauuacauauggcgcguguccuagauacguuaaacagaauacgcugaaacuugccaccgggaugcggaacgugcccgagaagcaaacacgcggaaucuucggcgcuauugccggguuuaucgaaaauggaugggagggcaugguggaugggugguauggauucagacaccagaacuccgagggccggggccaggcugccgaccugaagucuacccaagccgcuaucgaucagauuaaugggaaacucaacagacugaucggaaagacaaacgaaaaauuccaccagauugagaaggaauuuagcgaggucgaaggccgcauccaggaccuugagaaguacguggaggauaccaaaauugaccugugguccuauaaugcggaacuccugguugcccuggagaaccaacauacgaucgaucucacagacagcgaaaugaauaagcuguucgagaaaaccaagaaacagcuucgggaaaacgcugaggauauggggaauggaugcuuuaagauuuaccacaagugugacaacgccugcaucggcucuaucagaaaugggaccuaugaucaugacguguaccgcgacgaggcccugaacaaucgguuccagauuaaaggcgucgaacucaaguccggauacaaagauuggauccuguggauuagcuuugcuaucucuugcuuccuucuguguguggcccuccugggcuuuauuaugugggcgugccagaaggggaacaucagauguaauaucugcauuuga

SEQ ID NO: 194388 - RNA, 1701 nt, Artificial Sequence; identical to SEQ ID NO: 192859
  derived and/or modified sequence opt5 from hemagglutinin__InfluenzaA__AHL95128

SEQ ID NO: 194389 - RNA, 1701 nt, Artificial Sequence; identical to SEQ ID NO: 192882
  derived and/or modified sequence opt5 from hemagglutinin__InfluenzaA__AHL95140

SEQ ID NO: 194390 - RNA, 1701 nt, Artificial Sequence; identical to SEQ ID NO: 192892
  derived and/or modified sequence opt5 from hemagglutinin__InfluenzaA__AHL95152

SEQ ID NO: 194391 - RNA, 1701 nt, Artificial Sequence; identical to SEQ ID NO: 192859
  derived and/or modified sequence opt5 from hemagglutinin__InfluenzaA__AHL95164

SEQ ID NO: 194392 - RNA, 1701 nt, Artificial Sequence; identical to SEQ ID NO: 192892
  derived and/or modified sequence opt5 from hemagglutinin__InfluenzaA__AHL95176

SEQ ID NO: 194393 - RNA, 1701 nt, Artificial Sequence; identical to SEQ ID NO: 192892
  derived and/or modified sequence opt5 from hemagglutinin__InfluenzaA__AHL95188

SEQ ID NO: 194394 - RNA, 1701 nt, Artificial Sequence; identical to SEQ ID NO: 193018
  derived and/or modified sequence opt5 from hemagglutinin__InfluenzaA__AHL95200

SEQ ID NO: 194395 - RNA, 1701 nt, Artificial Sequence; identical to SEQ ID NO: 192892
  derived and/or modified sequence opt5 from hemagglutinin__InfluenzaA__AHL95212

SEQ ID NO: 194396 - RNA, 1701 nt, Artificial Sequence; identical to SEQ ID NO: 192882
  derived and/or modified sequence opt5 from hemagglutinin__InfluenzaA__AHL95224

SEQ ID NO: 194397 - RNA, 1701 nt, Artificial Sequence; identical to SEQ ID NO: 192882
  derived and/or modified sequence opt5 from hemagglutinin__InfluenzaA__AHL95236

SEQ ID NO: 194398 - RNA, 1701 nt, Artificial Sequence; identical to SEQ ID NO: 192907
  derived and/or modified sequence opt5 from hemagglutinin__InfluenzaA__AHL95248

SEQ ID NO: 194399 - RNA, 1701 nt, Artificial Sequence
  derived and/or modified sequence opt5 from hemagglutinin__InfluenzaA__AHL95260
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucuccgagaucugcgacucuccgcaccagauucuugauggcgaaaacuguacacugaucgacgcccuccugggggauccccagugcgacggauuucagaauaaaaagugggaucuguucgucgagcggagcaaagccuauuccaacuguuacccuuaugacgugcccgauuacgcuucucuccgcagccugguugccuccagcggcacccuugaauuuaauaacgagucuuucaauugggcuggggugacgcaaaacggaaccuccagcgccugcauuagaggcucuaauuccagcuuuuucucucggcugaacuggcucacacaucugaauuuuaaguauccugcgcuuaacgucaccaugcccaacaaugagcaguucgacaagcuguacaucuggggcgugcaccauccugggacagauaaagaccagauuuuucucuaugcccaguccagcggacgcaucaccguuuccacgaagagaucucaacaggcugugauuccgaacaucggcagccggccccgcaucagaaauauuccuucccggaucagcauuuacuggacaaucgucaaacccggggauauucugcugaucaacucuaccggaaaucucaucgccccucgcggcuacuucaagauuagauccgggaaaagcucuaucaugcggagcgacgcucccauuggaaaguguaaguccgaaugcaucacaccgaacggcucuauuccuaaugacaaacccuuucagaacgugaaucgcaucaccuauggcgccuguccuagauacgugaagcagagcacccugaaacuugcgacagggaugcggaacguccccgagaagcaaacgcgcggaaucuucggcgccauugcuggguuuaucgaaaauggaugggagggcaugguugaugggugguauggauucagacaccagaacuccgagggccggggccaggccgcugaccugaaaagcacccaagccgccauugaucagaucaaugggaagcucaacagacugauuggaaaaacaaaugaaaaguuccaccagaucgagaaggaauuuucugagguggaaggccgcauucaggaccuugagaaauacguggaggauaccaagaucgaccugugguccuauaacgcugaacuccuggucgcgcuggagaaccaacauacaaucgaucucaccgacagcgaaaugaauaaacuguucgagaagacgaaaaagcagcuucgggaaaacgccgaggauauggggaauggaugcuuuaagauuuaccacaaaugugacaacgcuugcaucggcucuauuagaaaugggacauaugaucaugacguguaccgcgacgaggcccugaacaaucgguuccagaucaagggcguugaacucaaauccggauacaaggauuggauucuguggaucagcuuugccaucuccugcuuccuucuguguguggcucuccugggcuuuauuaugugggccugccagaaagggaacaucagauguaauauuugcaucuga

SEQ ID NO: 194400 - RNA, 1701 nt, Artificial Sequence; identical to SEQ ID NO: 192892
  derived and/or modified sequence opt5 from hemagglutinin__InfluenzaA__AHL95272

SEQ ID NO: 194401 - RNA, 1701 nt, Artificial Sequence; identical to SEQ ID NO: 193018
  derived and/or modified sequence opt5 from hemagglutinin__InfluenzaA__AHL95284

SEQ ID NO: 194402 - RNA, 1701 nt, Artificial Sequence
  derived and/or modified sequence opt5 from hemagglutinin__InfluenzaA__AHL95296
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagauguuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauaucaacgauaaggggaaagaagugcuuguccuguggggcauucaccaccccuccaccacagccgaccaacagucucucuaccagaaugcugaugccuacguguucgugggaaccagcaaguauuccaaaaaguuuaaaccugagaucgcuauuagaccgaagguccgggaccaggaggggcgcaugaacuacuauuggacgcugaucgaacccggagauaaaauuacauucgaggccaccggcaaccugguugugccuagauacgcguuugccauggaacggaaugcugggagcggaaucauuaucucugacacacccgugcaugauugcaacaccaccugucaaacaccugagggcgccaucaauacgucccuccccuuccagaacauucacccgaucaccauuggcaagugcccuaaguaugucaaaagcacaaagcugcgccuugcuaccgggcugagaaaugugcccucuauccagagccggggacucuuuggcgccauugccggguucaucgaaggaggcuggacagggaugguugacggaugguacggcuaucaucaccagaacgagcaaggcuccggguacgcugcggaccugaaaucuacccagaaugccaucgauaagauuacgaacaaagugaauagcgucaucgagaagaugaacacacaguuuaccgcugugggaaaggaguucaaucaccuugagaaacgcauugaaaaccugaauaagaaaguugacgauggcuuccucgacaucuggaccuacaacgccgagcugcuggugcuccuggaaaaugagagaacacuugauuaucaugacuccaacgucaagaaccuguacgagaaagugcggaaucagcucaaggauaacgccaaggaaauugggaauggauguuuugaguucuaucacaaaugcgacaacaccuguauggaaagcgucaagaauggcacauacgauuauccuaaauacucugaggaagcuaagcugaaccgcgagaaaaucgacggggugaaacuugaguccacgagaaucuaucaaauucuggccaucuacagcaccguugcgucuucccucgugcuggucgugagccugggcgcuauuuccuuuuggaugugcucuaauggaagccuccagugccggaucuguauuuga

SEQ ID NO: 194403 - RNA, 1701 nt, Artificial Sequence; identical to SEQ ID NO: 192859
  derived and/or modified sequence opt5 from hemagglutinin__InfluenzaA__AHL95307

SEQ ID NO: 194404 - RNA, 1701 nt, Artificial Sequence; identical to SEQ ID NO: 192882
  derived and/or modified sequence opt5 from hemagglutinin__InfluenzaA__AHL95319

SEQ ID NO: 194405 - RNA, 1701 nt, Artificial Sequence
  derived and/or modified sequence opt5 from hemagglutinin__InfluenzaA__AHL95331
augaagaccaucauugcccugagcuacauccucugccugguguucgcucagaaacuucccggcgacgauaacuccacagccacgcugugucucgggcaccaugcggucccuaauggaaccauuguuaagacaaucaccaacgacagaauugaggugacaaaugcuaccgaacuggugcaaaacucuagcaucggcgagaucugcgauuccccgcaccagauucuugacggggaaaauuguacacugaucgaugcccuccugggagacccccagugcgauggcuuucagaacaaaaagugggaccuguucgucgagcggucuaaagccuauagcaauuguuacccuuaugaugugcccgacuacgcuucccuccgcucucugguugccagcuccgggacccuugaauuuaacaaugagagcuucaacugggcuggagugacgcaaaauggcaccucuuccgccugcauuagaggcagcaacucuuccuuuuucagccggcugaauuggcucacacaucugaacuuuaaguauccugcgcuuaaugucaccaugcccaacaacgagcaguucgauaagcuguacaucuggggagugcaccauccugggacagacaaagaucagauuuuucucuaugcccagucuuccggccgcaucaccguuagcacgaagagaucccaacaggcugugauuccgaauaucgggucucggccccgcaucagaaacauuccuagccggaucuccauuuacuggacaaucgucaaacccggagacauucugcugaucaauagcaccggcaaccucaucgccccucgcggguacuucaagauuagaucuggaaaauccagcaucaugcggucugacgcucccauuggcaaguguaagagcgaaugcaucacaccgaauggcuccauuccuaacgauaaacccuuucagaaugugaaccgcaucaccuauggggccuguccuagauacgugaagcagucuacccugaaacuugcgacaggaaugcggaauguccccgagaagcaaacgcgcggcaucuucggggccauugcuggauuuaucgaaaacggcugggaggggaugguugacggaugguauggcuucagacaccagaauagcgagggccgggggcaggccgcugaucugaaauccacccaagccgccauugaccagaucaacggaaagcucaauagacugauuggcaaaacaaacgaaaaguuccaccagaucgagaaggaauuuagcgagguggaagggcgcauucaggaucuugagaaauacguggaggacaccaagaucgaucuguggucuuauaaugcugaacuccuggucgcgcuggagaaccaacauacaaucgaccucaccgauuccgaaaugaacaaacuguucgagaagacgaaaaagcagcuucgggaaaaugccgaggacaugggaaacggcugcuuuaagauuuaccacaaaugugauaaugcuugcaucgggagcauuagaaacggcacauaugaccaugacguguaccgcgaugaggcccugaauaaccgguuccagaucaagggaguugaacucaaaucuggcuacaaggacuggauucuguggaucuccuuugccaucagcugcuuccuucuguguguggcucuccugggguuuauuaugugggccugccagaaaggaaauaucagauguaacauuugcaucuga

SEQ ID NO: 194406 - RNA, 1701 nt, Artificial Sequence
  derived and/or modified sequence opt5 from hemagglutinin__InfluenzaA__AHL95343
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugguugauggaugguauggcuucagacaccagaacagcgagggccgggggcaggccgcugaccugaaauccacccaagccgccauugaucagaucaauggaaagcucaacagacugauuggcaaaacaaaugaaaaguuccaccagaucgagaaggaauuuagcgagguggaagggcgcauucaggaccuugagaaauacguggaggauaccaagaucgaccuguggucuuauaacgcugaacuccuggucgcgcuggagaaccaacauacaaucgaucucaccgacuccgaaaugaauaaacuguucgagaagacgaaaaagcagcuucgggaaaacgccgaggauaugggaaauggcugcuuuaagauuuaccacaaaugugacaacgcuugcaucgggagcauuagaaauggcacauaugaucaugacguguaccgcgacgaggcccugaacaaucgguuccagaucagaggaguugaacucaagucuggcuacaaagauuggauucuguggaucuccuuugccaucagcugcuuccuucuguguguggcucuccugggguuuauuaugugggccugccagaagggaaacauccgcuguaauauuugcaucuga

SEQ ID NO: 194407 - RNA, 1701 nt, Artificial Sequence; identical to SEQ ID NO: 192882
  derived and/or modified sequence opt5 from hemagglutinin__InfluenzaA__AHL95432

SEQ ID NO: 194408 - RNA, 1701 nt, Artificial Sequence; identical to SEQ ID NO: 193018
  derived and/or modified sequence opt5 from hemagglutinin__InfluenzaA__AHL95444

SEQ ID NO: 194409 - RNA, 1701 nt, Artificial Sequence; identical to SEQ ID NO: 192882
  derived and/or modified sequence opt5 from hemagglutinin__InfluenzaA__AHL95457

SEQ ID NO: 194410 - RNA, 1701 nt, Artificial Sequence
  derived and/or modified sequence opt5 from hemagglutinin__InfluenzaA__AHL95470
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagccuauuccaacuguuacccuuaugaugugcccgacuacgcuucucuccggagccugguugccuccagcgggacgcuugaauuuaauaacgagucuuucaauuggaccggagugaagcagaacggcacauccagcgcuugcauccgcagaucuaauuccagcuuuuucucucggcugaacuggcucacccaucugaauuuuaaguauccugcccuuaacgucacaaugcccaacaaugagcaguucgauaaacuguacauuuggggcgugcaccauccugggaccgacaaggaucagaucuuucucuaugcgcaauccagcggacgcauuacgguuuccacaaaaagaucucagcaggccgugaucccgaacauuggcagccggccccgcaucagaaauaucccuucccggauuagcaucuacuggaccauuguccgccccggggacauccugcugauuaacucuacaggaaaucucaucgcuccuagaggcuacuucaagauccgguccgggaaaagcucuauuaugcgcagcgaugcccccaucggaaaguguaacuccgaaugcauuaccccgaauggcucuaucccuaacgacaagcccuuucagaaugugaacagaauuaccuauggcgcuuguccucgguacgugaaacaaagcacacugaagcuggccacggggaugcgcaauguccccgagaaacagaccagaggaaucuucggcgcgaucgccggguuuauugaaaacggaugggagggcaugguugacgggugguauggauuccggcaccaaaauuccgagggcagaggccaggcugccgaucuuaagagcacacaggcugccaucgaccagauuaacgggaaacucaaucgccugaucggaaagaccaacgaaaaauuccaccagauugagaaggaauuuucugagguggaaggccggauccaagaucuugagaaguacguggaggacacaaaaauugaucugugguccuauaacgccgaacuccuggucgcucuggagaaucagcauaccaucgaccucacggauagcgaaaugaacaagcuguucgagaaaacaaagaaacagcuuagagaaaaugcggaggacauggggaacggaugcuuuaagaucuaccacaagugugauaaugccugcauuggcucuauccgcaacgggaccuauaaucaugacguguaccgggaugaggcucugaacaauagauuccagauuaaaggcguugaacucaaguccggauacaaagacuggauccuguggauuagcuuugccaucuccugcuuccuucuguguguggcccuccugggcuuuaucaugugggcuugccaaaaggggaacauucgcuguaauaucugcauuuga

SEQ ID NO: 194411 - RNA, 1701 nt, Artificial Sequence; identical to SEQ ID NO: 193018
  derived and/or modified sequence opt5 from hemagglutinin__InfluenzaA__AHL95482

SEQ ID NO: 194412 - RNA, 1701 nt, Artificial Sequence; identical to SEQ ID NO: 193018
  derived and/or modified sequence opt5 from hemagglutinin__InfluenzaA__AHL95494

SEQ ID NO: 194413 - RNA, 1701 nt, Artificial Sequence
  derived and/or modified sequence opt5 from hemagglutinin__InfluenzaA__AHL95506
augaagaccaucauugcccugagcuacauccucugccugguguucgcucagaaacuucccggcaacgacaauuccacagccacgcugugucucgggcaccaugcggucccuaacggaaccauuguuagaacaaucaccaaugaucggauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaagaaaugggaucuguucgucgagcgcucuaaggccuauagcaacuguuacccuuaugacgugcccgauuacgcuucccucagaucucugguugccagcuccgggacccuugaauuuaauaacgagagcuucaauugggcuggagugacgcaaaacggcaccucuuccgccugcauucggggcagcaauucuuccuuuuucagccgccugaacuggcucacacaucugaauuuuaaauauccugcgcuuaacgucaccaugcccaacaaugagcaguucgacaagcuguacaucuggggagugcaccauccugggacagauaaggaccagauuuuucucuaugcccagucuuccggcagaaucaccguuagcacgaaacggucccaacaggcugugauuccgaacaucgggucucgccccagaauccggaauauuccuagccgcaucuccauuuacuggacaaucgucaagcccggagauauucugcugaucaacagcaccggcaaucucaucgccccuagaggguacuucaaaauucggucuggaaaguccagcaucaugcgcucugacgcucccauuggcaaauguaagagcgaaugcaucacaccgaacggcuccauuccuaaugacaagcccuuucagaacgugaauagaaucaccuauggggccuguccucgguacgugaaacagucuacccugaaacuugcgacaggaaugcgcaacguccccgagaagcaaacgagaggcaucuucggggccauugcuggauuuaucgaaaauggcugggaggggaugguugauggaugguauggcuuccggcaccagaacagcgagggcagagggcaggccgcugaccugaaguccacccaagccgccauugaucagaucaauggaaaacucaaccgccugauuggcaagacaaaugaaaaauuccaccagaucgagaaggaauuuagcgagguggaagggcggauucaggaccuugagaaguacguggaggauaccaaaaucgaccuguggucuuauaacgcugaacuccuggucgcgcuggagaaccaacauacaaucgaucucaccgacuccgaaaugaauaagcuguucgagaaaacgaagaaacagcuuagagaaaacgccgaggauaugggaaauggcugcuuuaagauuuaccacaagugugacaacgcuugcaucgggagcauucgcaauggcacauaugaucaugacguguaccgggacgaggcccugaacaauagauuccagaucaaaggaguugaacucaagucuggcuacaaagauuggauucuguggaucuccuuugccaucagcugcuuccuucuguguguggcucuccugggguuuauuaugugggccugccagaagggaaacauccgcuguaauauuugcaucuga

SEQ ID NO: 194414 - RNA, 1701 nt, Artificial Sequence
  derived and/or modified sequence opt5 from hemagglutinin__InfluenzaA__AHL95518
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaaugucccuagccggauuuccaucuacuggacaauugugaaacccggagauauccugcugauuaacagcaccggcaaucucaucgccccucgcggguacuucaagaucagaucuggaaaauccagcauuaugcggucugacgcucccaucggcaaguguaagagcgaaugcauuacaccgaacggcuccaucccuaaugacaaacccuuucagaacgugaaucgcauuaccuauggggccuguccuagauacgucaagcagucuacccugaaacuugcgacaggaaugcggaacguucccgagaagcaaacgcgcggcaucuucggggccaucgcuggauuuauugaaaauggcugggaggggaugauggauggaugguauggcuucagacaccagaacagcgagggccgggggcaggccgcugaccugaaauccacccaagccgccaucgaucagauuaauggaaagcucaacagacugaucggcaaaacaaaugaaaaguuccaccagauugagaaggaauuuagcgagguggaagggcgcauccaggaccuugagaaauacguggaggauaccaagauugaccuguggucuuauaacgcugaacuccuggucgcgcuggagaaccaacauacaaucgaucucaccgacuccgaaaugaauaaacuguucgagaagacgaaaaagcagcuucgggaaaacgccgaggauaugggaaauggcugcuuuaagaucuaccacaaaugugacaacgcuugcauugggagcaucagaaauggcacauaugaucaugacguguaccgcgacgaggcccugaacaaucgguuccagauuaagggaguugaacucaaaucuggcuacaaggauuggauccuguggauuuccuuugccaucagcugcuuccuucuguguguggcucuccugggguuuaucaugugggccugccagaaaggaaacauuagauguaauaucugcauuuga

SEQ ID NO: 194415 - RNA, 1701 nt, Artificial Sequence; identical to SEQ ID NO: 192892
  derived and/or modified sequence opt5 from hemagglutinin__InfluenzaA__AHL95530

SEQ ID NO: 194416 - RNA, 1701 nt, Artificial Sequence; identical to SEQ ID NO: 192892
  derived and/or modified sequence opt5 from hemagglutinin__InfluenzaA__AHL95542

SEQ ID NO: 194417 - RNA, 1701 nt, Artificial Sequence
  derived and/or modified sequence opt5 from hemagglutinin__InfluenzaA__AHL95554
augaagaccaucauugcccugagcuacauccucugccugguguucgcucagaaacuucccggcaacgacaauuccauggccacacugugucucgggcaccaugcggucccuaacggaacgauuguuaagaccaucacaaaugauagaauugaggugaccaacgcuacagaacuggugcaaaauucuagcaucggcgagaucugcgacuccccgcaccagauucuugauggggaaaacuguacccugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacacuugaauuuaauaacgagagcuucaauuggaccggagugacgcaaaacggcaccucuuccgcuugcauuagacggagcaauucuuccuuuuucagccgccugaacuggcucacacaucugaauuuuaaguauccugcccuuaacgucaccaugcccaacaaugagcaguucgacaagcuguacaucuggggcgugcaccauccugggacagauaaagaccagauuuuucucuaugcgcagucuuccggaagaaucaccguuagcacgaagcggucccaacaggccgugauuccgaacaucggcucucgccccagaauccggaauauuccuagccgcaucuccauuuacuggacaaucgucaaacccggggauauucugcugaucaacagcaccggaaaucucaucgcuccuagaggcuacuucaagauucggucugggaaauccagcaucaugcgcucugacgcccccauuggaaaguguaagagcgaaugcaucacaccgaacggcuccauuccuaaugacaaacccuuucagaacgugaauagaaucaccuauggcgcuuguccucgguacgugaagcagucuacccugaaacuugccacagggaugcgcaacguccccgagaagcaaacgagaggaaucuucggcgcgauugccggguuuaucgaaaauggaugggagggcaugguugaugggugguauggauuccggcaccagaacagcgagggcagaggccaggcugccgaccugaaauccacccaagcugccauugaucagaucaaugggaagcucaaccgccugauuggaaaaacaaaugaaaaguuccaccagaucgagaaggaauuuagcgagguggaaggccggauucaggaccuugagaaauacguggaggauaccaagaucgaccuguggucuuauaacgccgaacuccuggucgcucuggagaaccaacauacaaucgaucucaccgacuccgaaaugaauaaacuguucgagaagacgaaaaagcagcuuagagaaaacgcggaggauauggggaauggaugcuuuaagauuuaccacaaaugugacaacgccugcaucggcagcauucgcaaugggacauaugaucauaacguguaccgggacgaggcucugaauaacagauuccagaucaagggcguugaacucaaaucuggauacaaggacuggauucuguggaucuccuuugccaucagcugcuuccuucuguguguggcccuccugggcuuuauuaugugggcuugccagaaagggaauauccgcuguaacauuugcaucuga

SEQ ID NO: 194418 - RNA, 1701 nt, Artificial Sequence
  derived and/or modified sequence opt5 from hemagglutinin__InfluenzaA__AHL95566
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugccagaucuuccggccgcaucaccguuagcacgaagcggucccagcaagcugugauuccgaacaucgggucucgccccagaauccggaauauuccuagccgcaucuccauuuacuggacaaucgucaaacccggagauauucugcugaucaacagcaccggcaaucucaucgccccuagaggguacuucaagauucggucuggaaaauccagcaucaugcgcucugacgcucccauuggcaaguguaagagcgaaugcaucacaccgaacggcuccauuccuaaugacaaacccuuucagaacgugaauagaaucaccuauggggccuguccucgguacgugaagcagucuacccugaaacuugcgacaggaaugcgcaacguccccgagaagcagacgagaggcaucuucggggccauugcuggauuuaucgaaaauggcugggaggggaugguugauggaugguauggcuuccggcaccaaaacagcgagggcagagggcaggccgcugaccugaaauccacccaggccgccauugaucaaaucaauggaaagcucaaccgccugauuggcaaaacaaaugaaaaguuccaccagaucgagaaggaauuuagcgagguggaagggcggauucaggaccuugagaaauacguggaggauaccaagaucgaccuguggucuuauaacgcugaacuccuggucgcgcuggagaaccagcauacaaucgaucucaccgacuccgaaaugaauaaacuguucgagaagacgaaaaagcaacuuagagaaaacgccgaggauaugggaaauggcugcuuuaagauuuaccacaaaugugacaacgcuugcaucgggagcauucgcaauggcacauaugaucaugacguguaccgggacgaggcccugaacaauagauuccagaucaagggaguugaacucaaaucuggcuacaaggauuggauucuguggaucuccuuugccaucagcugcuuccuucuguguguggcucuccugggguuuauuaugugggccugccagaaaggaaacauccgcuguaauauuugcaucuga

SEQ ID NO: 194419 - RNA, 1701 nt, Artificial Sequence
  derived and/or modified sequence opt5 from hemagglutinin__InfluenzaA__AHL95578
augaagaccaucauugcccugagcuacauccucugccugguguucgcucagaaacuucccggcaacgacgauuccacagccacgcugugucucgggcaccaugcggucccuaauggaaccauuguuaagacaaucaccaacgacagaauugaggugacaaaugcuaccgaacuggugcaaaacucuagcaucggcgagaucugcgauuccccgcaccagauucuugacggggaaaauuguacacugaucgaugcccuccugggagacccccagugcgauggcuuucagaacaaaaagugggaccuguucgucgagcggucuaaagccuauagcaauuguuacccuuaugaugugcccgacuacgcuucccuccgcucucugguugccagcuccgggacccuugaauuuaacaaugagagcuucaacugggcuggagugacgcaaaauggcaccucuuccgccugcauuagaggcagcaacucuuccuuuuucagccggcugaauuggcucacacaucugaacuuuaaguauccugcgcuuaaugucaccaugcccaacaacgagcaguucgauaagcuguacaucuggggagugcaccauccugggacagacaaagaucagauuuuucucuaugcccagucuuccggccgcaucaccguuagcacgaagagaucccaacaggcugugauuccgaauaucgggucucggccccgcaucagaaacauuccuagccggaucuccauuuacuggacaaucgucaaacccggagacauucugcugaucaauagcaccggcaaccucaucgccccucgcggguacuucaagauuagaucuggaaaauccagcaucaugcggucugacgcucccauuggcaaguguaagagcgaaugcaucacaccgaauggcuccauuccuaacgauaaacccuuucagaaugugaaccgcaucaccuauggggccuguccuagauacgugaagcagucuacccugaaacuugcgacaggaaugcggaauguccccgagaagcaaacgcgcggcaucuucggggccauugcuggauuuaucgaaaacggcugggaggggaugauggacggaugguauggcuucagacaccagaauagcgagggccgggggcaggccgcugaucugaaauccacccaagccgccauugaccagaucaacggaaagcucaauagacugauuggcaaaacaaacgaaaaguuccaccagaucgagaaggaauuuagcgagguugaagggcgcauucaggaucuugagaaauacguggaggacaccaagaucgaucuguggucuuauaaugcugaacuccugguggcgcuggagaaccaacauacaaucgaccucaccgauuccgaaaugaacaaacuguucgagaagacgaaaaagcagcuucgggaaaaugccgaggacaugggaaacggcugcuuuaagauuuaccacaaaugugauaaugcuugcaucgggagcauuagaaacggcacauaugaccaugacgucuaccgcgaugaggcccugaauaaccgguuccagaucaagggaguggaacucaaaucuggcuacaaggacuggauucuguggaucuccuuugccaucagcugcuuccuucuguguguugcucuccugggguuuauuaugugggccugccagaaaggaaauaucagauguaacauuugcaucuga

SEQ ID NO: 194420 - RNA, 1701 nt, Artificial Sequence
  derived and/or modified sequence opt5 from hemagglutinin__InfluenzaA__AHL95590
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccagcugcauuagacggucuaauuccagcuuuuucucucgccugaacuggcucacccaucugaauuuuaaguauccugcucuuaacgucacaaugcccaacaaugagcaguucgacaagcuguacaucuggggcgugcaccauccugggaccgauaaagaccagauuuuucucuaugcccaguccagcggaagaaucacgguuuccacaaagcggucucaacaggcggugauuccgaacaucggcagccgccccagaauccggaauauuccuucccgcaucagcauuuacuggaccaucgucaaacccggggauauucugcugaucaacucuacaggaaaucucaucgccccuagaggcuacuucaagauucgguccgggaaaagcucuaucaugcgcagcgacgcucccauuggaaaguguaaguccgaaugcaucaccccgaacggcucuauuccuaaugacaaacccuuucagaacgugaauagaaucaccuauggcgccuguccucgguacgugaagcagagcacacugaaacuugcuacggggaugcgcaacguccccgagaagcaaaccagaggaaucuucggcgccauugcgggguuuaucgaaaauggaugggagggcaugguugaugggugguauggauuccggcaccagaacuccgagggcagaggccaggccgcugaccugaaaagcacacaagccgcuauugaucagaucaaugggaagcucaaccgccugauuggaaaaaccaaugaaaaguuccaccagaucgagaaggaauuuucugagguggaaggccggauucaggaccuugagaaauacguggaggauacaaagaucgaccugugguccuauaacgccgaacuccuggucgcccuggagaaccaacauaccaucgaucucacggacagcgaaaugaauaaacuguucgagaagaccaaaaagcagcuuagagaaaacgcugaggauauggggaauggaugcuuuaagauuuaccacaaaugugacaacgcgugcaucggcucuauucgcaaugggacauaugaucauaacguguaccgggacgaggcccugaauaacagauuccagaucaagggcguugaacucaaauccggauacaaggacuggauucuguggaucagcuuugcuaucuccugcuuccuucuguguguggcccuccugggcuuuauuaugugggccugccagaaagggaauauccgcuguaacauuugcaucuga

SEQ ID NO: 194421 - RNA, 1701 nt, Artificial Sequence; identical to SEQ ID NO: 192892
  derived and/or modified sequence opt5 from hemagglutinin__InfluenzaA__AHL95602

SEQ ID NO: 194422 - RNA, 1701 nt, Artificial Sequence; identical to SEQ ID NO: 192892
  derived and/or modified sequence opt5 from hemagglutinin__InfluenzaA__AHL95614

SEQ ID NO: 194423 - RNA, 1701 nt, Artificial Sequence
  derived and/or modified sequence opt5 from hemagglutinin__InfluenzaA__AHL95626
augaagaccaucauugcccugagcuacgugcucugccuggucuucgcucagaaacuucccggcaacgacaauuccacagccacgcugugucucgggcaccaugcgguuccuaacggaaccaucgugaagacaauuaccaaugauagaaucgaggugacaaacgcuaccgaacugguccaaaauucuagcauuggcgagaucugcgacuccccgcaccagauccuugauggggaaaacuguacacugauugacgcccuccugggagauccccagugcgacggcuuucagaauaaaaagugggaucuguucguggagcggucuaaagccuauagcaacuguuacccuuaugacguucccgauuacgcuucccuccgcucucugguggccagcuccgggacccuugaauuuaauaacgagagcuucaauugggcuggagucacgcaaaacggcaccucuuccgccugcaucagaggcagcaauucuuccuuuuucagccggcugaacuggcucacacaucugaauuuuaaguauccugcgcuuaacgugaccaugcccaacaaugagcaguucgacaagcuguacauuuggggaguucaccauccugggacagauaaagaccagaucuuucucuaugcccagucuuccggccgcauuaccgugagcacgaagagaucccaacaggcugucaucccgaacauugggucucggccccgcaucagaaauaucccuagccggauuuccaucuacuggacaauugugaaacccggagauauccugcugauuaacagcaccggcaaucucaucgccccucgcggguacuucaagaucagaucuggaaaauccagcauuaugcggucugacgcucccaucggcaaguguaagagcgaaugcauuacaccgaacggcuccaucccuaaugacaaacccuuucagaacgugaaucgcauuaccuauggggccuguccuagauacgucaagcagucuacccugaaacuugcgacaggaaugcggaacguucccgagaagcaaacgcgcggcaucuucggggccaucgcuggauuuauugaaaauggcugggaggggaugguggauggaugguauggcuucagacaccagaacagcgagggccgggggcaggccgcugaccugaaauccacccaagccgccaucgaucagauuaauggaaagcucaacagacugaucggcaaaacaaaugaaaaguuccaccagauugagaaggaauuuagcgagguggaagggcgcauccaggaccuugagaaauacgucgaggauaccaagauugaccuguggucuuauaacgcugaacuccugguggcgcuggagaaccaacauacaaucgaucucaccgacuccgaaaugaauaaacuguucgagaagacgaaaaagcagcuucgggaaaacgccgaggauaugggaaauggcugcuuuaagaucuaccacaaaugugacaacgcuugcauugggagcaucagaaauggcacauaugaucaugacguuuaccgcgacgaggcccugaacaaucgguuccagauuaagggaguggaacucaaaucuggcuacaaggauuggauccuguggauuuccuuugccaucagcugcuuccuucugugugucgcucuccugggguuuaucaugugggccugccagaaaggaaacauuagauguaauaucugcauuuga

SEQ ID NO: 194424 - RNA, 1701 nt, Artificial Sequence; identical to SEQ ID NO: 192892
  derived and/or modified sequence opt5 from hemagglutinin__InfluenzaA__AHL95638

SEQ ID NO: 194425 - RNA, 1701 nt, Artificial Sequence; identical to SEQ ID NO: 192892
  derived and/or modified sequence opt5 from hemagglutinin__InfluenzaA__AHL95650

SEQ ID NO: 194426 - RNA, 1701 nt, Artificial Sequence
  derived and/or modified sequence opt5 from hemagglutinin__InfluenzaA__AHL95662
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugauggauggaugguauggcuucagacaccagaacagcgagggccgggggcaggccgcugaccugaaauccacccaagccgccauugaucagaucaauggaaagcucaacagacugauuggcaaaacaaaugaaaaguuccaccagaucgagaaggaauuuagcgagguugaagggcgcauucaggaccuugagaaauacguggaggauaccaagaucgaccuguggucuuauaacgcugaacuccuggugacacuggagaaccaacauaccaucgaucucacggacuccgaaaugaauaaacuguucgagaagaccaaaaagcagcuucgggaaaacgcggaggauaugggaaauggcugcuuuaagauuuaccacaaaugugacaacgccugcaucgggagcauuagaaauggcacauaugaucaugacgucuaccgcgacgaggcucugaacaaucgguuccagaucaagggaguggaacucaaaucuggcuacaaggauuggauucuguggaucuccuuugccaucagcugcuuccuucuguguguugcccuccugggguuuauuaugugggcuugccagaaaggaaacaucagauguaauauuugcaucuga

SEQ ID NO: 194427 - RNA, 1701 nt, Artificial Sequence; identical to SEQ ID NO: 193018
  derived and/or modified sequence opt5 from hemagglutinin__InfluenzaA__AHL95686

SEQ ID NO: 194428 - RNA, 1701 nt, Artificial Sequence; identical to SEQ ID NO: 193018
  derived and/or modified sequence opt5 from hemagglutinin__InfluenzaA__AHL95698

SEQ ID NO: 194429 - RNA, 1701 nt, Artificial Sequence; identical to SEQ ID NO: 192892
  derived and/or modified sequence opt5 from hemagglutinin__InfluenzaA__AHL95710

SEQ ID NO: 194430 - RNA, 1701 nt, Artificial Sequence; identical to SEQ ID NO: 194406
  derived and/or modified sequence opt5 from hemagglutinin__InfluenzaA__AHL95722

SEQ ID NO: 194431 - RNA, 1701 nt, Artificial Sequence; identical to SEQ ID NO: 192882
  derived and/or modified sequence opt5 from hemagglutinin__InfluenzaA__AHL95734

SEQ ID NO: 194432 - RNA, 1701 nt, Artificial Sequence; identical to SEQ ID NO: 192882
  derived and/or modified sequence opt5 from hemagglutinin__InfluenzaA__AHL95746

SEQ ID NO: 194433 - RNA, 1701 nt, Artificial Sequence; identical to SEQ ID NO: 193021
  derived and/or modified sequence opt5 from hemagglutinin__InfluenzaA__AHL95758

SEQ ID NO: 194434 - RNA, 1701 nt, Artificial Sequence; identical to SEQ ID NO: 192892
  derived and/or modified sequence opt5 from hemagglutinin__InfluenzaA__AHL95770

SEQ ID NO: 194435 - RNA, 1701 nt, Artificial Sequence
  derived and/or modified sequence opt5 from hemagglutinin__InfluenzaA__AHL95782
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcaacuccccgcaccagauucuugacggggaaaauuguacacugaucgaugcccuccugggagacccccagugcgauggcuuucagaacaaaaagugggaccuguucgucgagcggucuaaagccuauagcaauuguuacccuuaugaugugcccgacuacgcuucccuccgcucucugguugccagcuccgggacccuugaauuuaacaaugagagcuucaacuggacgggagugacccaaaauggcacaucuuccgcuugcauuagacggagcaacucuuccuuuuucagccgccugaauuggcucacccaucugaacuuuaaguauccugcccuuaacgucacaaugcccaauaacgagcaguucgauaagcuguacaucuggggcgugcaccauccugggaccgacaaagaucagauuuuucucuaugcgcagucuuccggaagaaucacgguuagcacaaagcggucccaacaggccgugauuccgaauaucggcucucgccccagaauccggaacauuccuagccgcaucuccauuuacuggaccaucgucaaacccggggacauucugcugaucaauagcacaggaaaccucaucgcuccuagaggcuacuucaagauucggucugggaaauccagcaucaugcgcucugaugcccccauuggaaaguguaagagcgaaugcaucaccccgaauggcuccauuccuaacgacaaacccuuucagaaugugaacagaaucaccuauggcgcuuguccucgguacgugaagcagucuacacugaaacuugccacggggaugcgcaauguccccgagaagcaaaccagaggaaucuucggcgcgauugccggguuuaucgaaaacggaugggagggcaugguugacgggugguauggauuccggcaccagaauagcgagggcagaggccaggcugccgaucugaaauccacacaagcugccauugaccagaucaacgggaagcucaaucgccugauuggaaaaaccaacgaaaaguuccaccagaucgagaaggaauuuagcgagguggaaggccggauucaggaucuugagaaauacguggaggacacaaagaucgaucuguggucuuauaacgccgaacuccuggucgcucuggagaaucaacauaccaucgaccucacggauuccgaaaugaacaaacuguucgagaagaccaaaaagcagcuuagagaaaaugcggaggacauggggaacggaugcuuuaagauuuaccacaaaugugauaaugccugcaucggcagcauucgcaacgggacauaugaccaugauguguaccgggacgaggcucugaauaacagauuccagaucaagggcguugaacucaaaucuggauacaaggacuggauucuguggaucuccuuugccaucagcugcuuccuucuguguguggcccuccugggcuuuauuaugugggcuugccagaaagggaauauccgcuguaacauuugcaucuga

SEQ ID NO: 194436 - RNA, 1701 nt, Artificial Sequence
  derived and/or modified sequence opt5 from hemagglutinin__InfluenzaA__AHL95794
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggaacaaagccuauucuaauuguuacccuuaugacgugcccgauuacgcuagccuccgcucccugguugccucuagcgggacccuugaauuuaacaaugaguccuucaacugggcuggagugacgcaaaauggcaccagcucugccugcauuagaggcuccaacagcuccuuuuucucucggcugaauuggcucacacaucugaacuuuaaguauccugcgcuuaacgucaccaugcccaauaacgagcaguucgacaagcuguacaucuggggagugcaccauccugggacagauaaagaccagauuuuucucuaugcccagagcucuggccgcaucaccguuuccacgaagagaagccaacaggcugugauuccgaauaucgggucccggccccgcaucagaaacauuccuucucggaucagcauuuacuggacaaucgucaaacccggagauauucugcugaucaauuccaccggcaaccucaucgccccucgcggguacuucaagauuagaagcggaaaaucuuccaucaugcggagcgacgcucccauuggcaaguguaagucugaaugcaucacaccgaauggcagcauuccuaacgacaaacccuuucagaaugugaaccgcaucaccuauggggccuguccuagauacgugaagcaguccacccugaaacuugcgacaggaaugcggaauguccccgagaagcaaacgcgcggcaucuucggggccauugcuggauuuaucgaaaacggcugggaggggaugguugauggaugguauggcuucagacaccaaaauucugagggccgggggcaggccgcugaccugaaaagcacccaggccgccauugaucagaucaacggaaagcucaauagacugauuggcaaaacaaacgaaaaguuccaccagaucgagaaggaauuuuccgagguggaagggcgcauucaggaccuugagaaauacguggaggauaccaagaucgaccuguggagcuauaacgcugaacuccuggucgcgcuggagaaucaacauacaaucgaucucaccgacucugaaaugaacaaacuguucgagaagacgaaaaagcagcuucgggaaaaugccgaggauaugggaaacggcugcuuuaagauuuaccacaaaugugacaaugcuugcaucggguccauuagaaacggcacauaugaucaugacguguaccgcgacgaggcccugaauaaccgguuccagaucaagggaguugaacucaaaagcggcuacaaggauuggauucuguggaucucuuuugccaucuccugcuuccuucuguguguggcucuccugggguuuauuaugugggccugccagaaaggaaauaucagauguaacauuugcaucuga

SEQ ID NO: 194437 - RNA, 1701 nt, Artificial Sequence
  derived and/or modified sequence opt5 from hemagglutinin__InfluenzaA__AHL95806
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugguugauggaugguauggcuucagacaccagaacagcgagggccgggggcaggccgcugaccugaaauccacccaagccgccauugaucagaucaauggaaagcucaacagacugauuggcaaaacaaaugaaaaguuccaccagaucgagaaggaauuuagcgagguggaagggcgcauucaggaccuugagaaauacguggaggauaccaagaucgaccuguggucuuauaacgcugaacuccuggucgcgcuggagaaccaacauacaaucgaucucaccgacuccgaaaugaauaaacuguucgagaagacgaaaaagcagcuucgggaaaacgccgaggauaugggaaauggcugcuuuaagauuuaccacaaaugugacaacgcuugcaucgggagcauuagaaauggcacauaugaucaugacguguaccgcgacgaggcccugaacaaucgguuccagaucaagggaguugaacucaaaucuggcuacaaggauuggauucuguggaucuccuuugccaucagcugcuuccuucuguguguggcucuccugggguccauuaugugggccugccagaaaggaaacaucagauguaauauuugcaucuga

SEQ ID NO: 194438 - RNA, 1701 nt, Artificial Sequence; identical to SEQ ID NO: 193018
  derived and/or modified sequence opt5 from hemagglutinin__InfluenzaA__AHL95818

SEQ ID NO: 194439 - RNA, 1701 nt, Artificial Sequence; identical to SEQ ID NO: 192882
  derived and/or modified sequence opt5 from hemagglutinin__InfluenzaA__AHL95830

SEQ ID NO: 194440 - RNA, 1701 nt, Artificial Sequence; identical to SEQ ID NO: 193018
  derived and/or modified sequence opt5 from hemagglutinin__InfluenzaA__AHL95842

SEQ ID NO: 194441 - RNA, 1701 nt, Artificial Sequence; identical to SEQ ID NO: 192882
  derived and/or modified sequence opt5 from hemagglutinin__InfluenzaA__AHL95854

SEQ ID NO: 194442 - RNA, 1701 nt, Artificial Sequence; identical to SEQ ID NO: 192892
  derived and/or modified sequence opt5 from hemagglutinin__InfluenzaA__AHL95866

SEQ ID NO: 194443 - RNA, 1701 nt, Artificial Sequence
  derived and/or modified sequence opt5 from hemagglutinin__InfluenzaA__AHL95878
augaaggccauccuggugauuaugcucuacaccuucgcuacagccaacgcggacacgcugugcaucggcuaucacgcuaauaacagcaccgauacagucgacaccguucuugagaaaaaugugacagugacccauuccgucaaccugcucgaagauaagcacaaugggaaacuguguaaacuuagaggagugucuccccugcaucucggcaagugcaacauugccggguggauccugggaaauccugagugugaaagccuguccacagccucuagcugguccuacauuguugagaccucuggcagcgacaacgggacgugcuauccgggagauuuuaucgacuacgaggagcuccgggagcagcuguccagcgugucuuccuucgaacgcuuugagaucuuccccaagaccagcucuuggccuaaucacgauuccaacaagggcgucacagcugccuguccccaugcuggcgccaaaggguuuuauaagaaucuuauuuggcuggugaaaaagggaaacagcuacccuaaacucucuaucuccuauauuaaugacaagggcaaggaaguucuggugcuuugggggauccaccaccccagcaccacagcggaucaacagucccuguaccagaacgccgacaccuacgucuucgugggaacgucuagauauagcaaaaaguuuaaaccugagauugcuauccggccgaaggugcgcgaucaggagggcagaaugaauuacuauuggacacucgucgaacccggggacaaaauuaccuucgaggccacaggaaaccugguugugccucgguacgcuuuugccauggaacgcaacgcgggcuccggcaucaucauuagcgauacccccgugcaugacugcaauaccacaugucaaacgccuaagggggccaucaacaccucucugcccuuccagaauauucacccgaucacaauuggaaaaugcccuaaguaugucaaguccaccaaacucagacuggcuacaggccuucggaacgugcccagcauccagucucgcgggcuguuuggagccaucgcuggcuucauugaagggggauggaccggcaugguugacggcugguacggguaucaucaccagaaugaacaaggaagcggcuacgccgccgaucucaaguccacgcagaacgcuaucgacaaaauuacaaauaaggugaacucugucaucgagaaaaugaauacccaguuuaccgcgguggggaaggaguucaaccaccuggaaaagagaauugagaaucuuaacaaaaagguugaugacggauuccuggauaucuggacauacaaugccgaacuccuggugcugcucgagaacgaacggacccuggacuaucaugauagcaaugucaaaaaccuuuacgagaaggugcgcaaccagcugaaaaauaacgcuaaggagaucggcaauggguguuuugaguucuaucacaagugcgacaacacauguauggaauccgucaaaaauggcacguacgauuauccuaaguacagcgaagaggccaaacucaacagagaagagauugacggagugaagcuggagucuacccggaucuaucaaauucuugccaucuacuccacagcugccagcucucugguucucguggucucccugggcgcgauuagcuuuuggaugugcuccaaugggucucugcagugccgcaucuguauuuga

SEQ ID NO: 194444 - RNA, 1701 nt, Artificial Sequence; identical to SEQ ID NO: 192892
  derived and/or modified sequence opt5 from hemagglutinin__InfluenzaA__AHL95889

SEQ ID NO: 194445 - RNA, 1701 nt, Artificial Sequence; identical to SEQ ID NO: 193018
  derived and/or modified sequence opt5 from hemagglutinin__InfluenzaA__AHL95901

SEQ ID NO: 194446 - RNA, 1701 nt, Artificial Sequence; identical to SEQ ID NO: 193018
  derived and/or modified sequence opt5 from hemagglutinin__InfluenzaA__AHL95913

SEQ ID NO: 194447 - RNA, 1701 nt, Artificial Sequence
  derived and/or modified sequence opt5 from hemagglutinin__InfluenzaA__AHL95937
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugguugauggaugguauggcuucagacaccagaacagcgagggccgggggcaggccgcugaccugaaauccacccaagccgccauugaucagaucaauggaaagcucaacagacugauuggcaaaacaaaugaaaaguuccaccagaucgagaaggaauuuagcgagguggaagggcgcauucaggaccuugagaaauacguggaggauaccaagacagaccuguggucuuauaacgcugaacuccuggucgcgcuggagaaccaacauaccaucgaucucacggacuccgaaaugaauaaacuguucgagaagaccaaaaagcagcuucgggaaaacgccgaggauaugggaaauggcugcuuuaagaucuaccacaaaugugacaacgcuugcauugggagcaucagaaauggcacauaugaucaugacguguaccgcgacgaggcccugaacaaucgguuccagauuaagggaguugaacucaaaucuggcuacaaggauuggauccuguggauuuccuuugccaucagcugcuuccuucuguguguggcucuccugggguuuaucaugugggccugccagaaaggaaacauuagauguaauaucugcauuuga

SEQ ID NO: 194448 - RNA, 1701 nt, Artificial Sequence
  derived and/or modified sequence opt5 from hemagglutinin__InfluenzaA__AHL95949
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauaacuccuuuuucucucgccugaauuggcucacccauagcaacuuuaaguauccugcccugaacaugacaaugcccaauaacgagcaguucgacaaacuuuacaucuggggcguccaccauccugggaccgauaaagaccagauuuuucuguaugcgcagucuuccggaagaaucacggugagcacaaagcggucccaacaggccguuauuccgaauaucggcucucgccccagaauccggaacauuccuagccgcaucuccauuuacuggaccaucgugaaacccggggauauucuccugaucaauagcacaggaaaccugaucgcuccuagaggcuacuucaagauucggucugggaaauccagcaucaugcgcucugacgcccccauuggaaaguguaagagcgaaugcaucaccccgaauggcuccauuccuaacgacaaacccuuucagaaugucaacagaaucaccuauggcgcuuguccucgguacgugaagcagucuacacucaaacuggccacggggaugcgcaaugugcccgagaagcaaaccagaggaaucuucggcgcgauugccggguuuaucgaaaacggaugggagggcaugauggaugggugguauggauuccggcaccagaauagcgagggcagaggccaggcugccgaccuuaaauccacacaagcugccauugaucagaucaacgggaagcugaaucgccucauuggaaaaaccaacgaaaaguuccaccagaucgagaaggaauuuagcgaggucgaaggccggauucaggaccuggagaaauacguugaggauacaaagaucgaccuuuggucuuauaacgccgaacugcucguggcucuggagaaucaacauaccaucgaucugacggacuccgaaaugaacaaacucuucgagaagacaaagaagcagcugagagaaaaugcggaggauauggggaacggaugcuuuaagauuuaccacaaaugugacaaugccugcaucggcagcauucgcaacgggaccuaugaucaugacguguaccgggacgaggcucuuaauaacagauuccagaucaagggcgucgaacugaaaucuggauacaaggauuggauucucuggaucuccuuugccaucagcugcuuccugcuuuguguggcccugcucggcuuuauuaugugggcuugccagaaagggaauauccgcuguaacauuugcaucuga

SEQ ID NO: 194449 - RNA, 1701 nt, Artificial Sequence; identical to SEQ ID NO: 192892
  derived and/or modified sequence opt5 from hemagglutinin__InfluenzaA__AHL95961

SEQ ID NO: 194450 - RNA, 1701 nt, Artificial Sequence; identical to SEQ ID NO: 192892
  derived and/or modified sequence opt5 from hemagglutinin__InfluenzaA__AHL95973

SEQ ID NO: 194451 - RNA, 1701 nt, Artificial Sequence; identical to SEQ ID NO: 192892
  derived and/or modified sequence opt5 from hemagglutinin__InfluenzaA__AHL95985

SEQ ID NO: 194452 - RNA, 1701 nt, Artificial Sequence
  derived and/or modified sequence opt5 from hemagglutinin__InfluenzaA__AHL95997
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccagcugcauuagaggcucuaaguccagcuuuuucucucggcugaauuggcucacacaucugaacuuuaaguauccugcccuuaaugucaccaugcccaacaacgagcaguucgacaaacuguacaucuggggagugcaccauccugggacagauaaggaccagauuuuucucuaugcgcaguccagcggccgcaucaccguuuccacgaaaagaucucaacaggccgugauuccgaauaucgggagccggccccgcaucagaaacauuccuucccggaucagcauuuacuggacaaucgucaagcccggagauauucugcugaucaauucuaccggcaaccucaucgcuccucgcggguacuucaaaauuagauccggaaagagcucuaucaugcggagcgacgcccccauuggcaaguguaaauccgaaugcaucacaccgaauggcucuauuccuaacgacaagcccuuucagaaugugaaccgcaucaccuauggggcuuguccuagauacgugaaacagagcacccugaagcuggccacaggaaugcggaauguccccgagaaacaaacgcgcggcaucuucggggcgauugccggauuuaucgaaaacggcugggaggggaugauggauggaugguauggcuucagacaccaaaauuccgagggccgggggcaggcugccgaccuuaagagcacccaggcugccauugaucagaucaacggaaaacucaauagacugauuggcaagacaaacgaaaaguuccaccagaucgagaaagaauuuucugagguugaagggcgcauucaggaccuugagaaguacguggaggauaccaaaaucgaccugugguccuauaaugccgaacuccugguggcucuggagaaccaacauacaaucgaucucaccgacagcgaaaugaacaagcuguucgagaaaacgaagaagcagcuucgggaaaaugcggaggauaugggaaacggcugcuuuaaaauuuaccacaagugugacaaugccugcaucgggucuauuagaaacggcacauaugaucaugacgucuaccgcgacgaggcucugaauaaccgguuccagaucaaaggaguggaacucaaguccggcuacaaagauuggauucuguggaucagcuuugccaucuccugcuuccuucuguguguugcccuccugggguuuauuaugugggcuugccagaagggaaauaucagauguaacauuugcaucuga

SEQ ID NO: 194453 - RNA, 1701 nt, Artificial Sequence
  derived and/or modified sequence opt5 from hemagglutinin__InfluenzaA__AHL96021
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaagucuuccuuuuucagccggcugaauuggcucacacaucugaacuuuaaguauccugcgcuuaaugucaccaugcccaacaacgagcaguucgacaaacuguacaucuggggagugcaccauccugggacagauaaggaccagauuuuucucuaugcccagucuuccggccgcaucaccguuagcacgaaaagaucccaacaggcugugauuccgaauaucgggucucggccccgcaucagaaacauuccuagccggaucuccauuuacuggacaaucgucaagcccggagauauucugcugaucaauagcaccggcaaccucaucgccccucgcggguacuucaaaauuagaucuggaaaguccagcaucaugcggucugacgcucccauuggcaaguguaaaagcgaaugcaucacaccgaauggcuccauuccuaacgacaagcccuuucagaaugugaaccgcaucaccuauggggccuguccuagauacgugaaacagucuacccugaaacuugcgacaggaaugcggaauguccccgagaagcaaacgcgcggcaucuucggggccauugcuggauuuaucgaaaacggcugggaggggaugauggauggaugguauggcuucagacaccagaauagcgagggccgggggcaggccgcugaccugaaguccacccaagccgccauugaucagaucaacggaaaacucaauagacugauuggcaagacaaacgaaaaguuccaccagaucgagaaagaauuuagcgagguugaagggcgcauucaggaccuugagaaguacguggaggauaccaaaaucgaccuguggucuuauaaugcugaacuccugguggcgcuggagaaccaacauacaaucgaucucaccgacuccgaaaugaacaagcuguucgagaaaacgaagaagcagcuucgggaaaaugccgaggauaugggaaacggcugcuuuaaaauuuaccacaagugugacaaugcuugcaucgggagcauuagaaacggcacauaugaucaugacgucuaccgcgacgaggcccugaauaaccgguuccagaucaaaggaguggaacucaagucuggcuacaaagauuggauucuguggaucuccuuugccaucagcugcuuccuucuguguguugcucuccugggguuuauuaugugggccugccagaagggaaauaucagauguaacauuugcaucuga

SEQ ID NO: 194454 - RNA, 1701 nt, Artificial Sequence; identical to SEQ ID NO: 192892
  derived and/or modified sequence opt5 from hemagglutinin__InfluenzaA__AHL96033

SEQ ID NO: 194455 - RNA, 1701 nt, Artificial Sequence; identical to SEQ ID NO: 193147
  derived and/or modified sequence opt5 from hemagglutinin__InfluenzaA__AHL96045

SEQ ID NO: 194456 - RNA, 1701 nt, Artificial Sequence; identical to SEQ ID NO: 193018
  derived and/or modified sequence opt5 from hemagglutinin__InfluenzaA__AHL96056

SEQ ID NO: 194457 - RNA, 1701 nt, Artificial Sequence; identical to SEQ ID NO: 192882
  derived and/or modified sequence opt5 from hemagglutinin__InfluenzaA__AHL96068

SEQ ID NO: 194458 - RNA, 1701 nt, Artificial Sequence; identical to SEQ ID NO: 192892
  derived and/or modified sequence opt5 from hemagglutinin__InfluenzaA__AHL96080

SEQ ID NO: 194459 - RNA, 1701 nt, Artificial Sequence
  derived and/or modified sequence opt5 from hemagglutinin__InfluenzaA__AHL96092
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucauugagcggucuaaagccuauagcaacuguuacccuuaugacguccccgauuacgcuucccuccgcucucugguggccagcuccgggacccuugaauuuaauaacgagagcuucaauugggcuggaguuacgcaaaacggcaccucuuccgccugcaucagaggcagcaauucuuccuuuuucagccggcugaacuggcucacacaucugaauuuuaaguauccugcgcuuaacgugaccaugcccaacaaugagcaguucgacaagcuguacauuuggggaguccaccauccugggacagauaaagaccagaucuuucucuaugcccagucuuccggccgcauuaccgugagcacgaagagaucccaacaggcuguuaucccgaacaucgggucucggccccgcauuagaaauaucccuagccggauuuccaucuacuggacaauugugaaacccggagauauccugcugaucaacagcaccggcaaucucauugccccucgcggguacuucaagaucagaucuggaaaauccagcauuaugcggucugacgcucccaucggcaaguguaagagcgaaugcauuacaccgaacggcuccaucccuaaugacaaacccuuucagaacgucaaucgcaucaccuauggggccuguccuagauacgugaagcagucuacccugaaacuugcgacaggaaugcggaacgugcccgagaagcaaacgcgcggcauuuucggggccaucgcuggauuuauugaaaauggcugggaggggauggucgauggaugguauggcuucagacaccagaacagcgagggccgggggcaggccgcugaccugaaauccacccaagccgccaucgaucagauuaauggaaagcucaacagacugaucggcaaaacaaaugaaaaguuccaccagauugagaaggaauuuagcgagguugaagggcgcauccaggaccuugagaaauacguggaggauaccaagaucgaccuguggucuuauaacgcugaacuccugguggcgcuggagaaccaacauacaauugaucucaccgacuccgaaaugaauaaacuguucgagaagacgaaaaagcagcuucgggaaaacgccgaggauaugggaaauggcugcuuuaagaucuaccacaaaugugacaacgcuugcauugggagcaucagaaauggcacauaugaucaugacgucuaccgcgacgaggcccugaacaaucgguuccagauuaagggaguggaacucaaaucuggcuacaaggauuggauccuguggaucuccuuugccauuagcugcuuccuucuguguguugcucuccugggguuuaucaugugggccugccagaaaggaaacauuagauguaauaucugcauuuga

SEQ ID NO: 194460 - RNA, 1701 nt, Artificial Sequence
  derived and/or modified sequence opt5 from hemagglutinin__InfluenzaA__AHL96104
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagucuacacugaaacuugccacggggaugcgcaacguccccgagagacaaacccggggaaucuucggcgcgauugccggguuuaucgaaaauggaugggagggcaugguugaugggugguauggauucagacaccagaacagcgagggccgcggccaggcugccgaccugaaguccacacaagcugccauugaucagaucaaugggaaacucaaccggcugauuggaaagaccaaugaaaaauuccaccagaucgagaaggaauuuagcgagguggaaggccgcauucaggaccuugagaaguacguggaggauacaaaaaucgaccuguggucuuauaacgccgaacuccuggucgcucuggagaaccaacauaccaucgaucucacggacuccgaaaugaauaagcuguucgagaaaacaaagaaacagcuuagagaaaacgcggaggauauggggaauggaugcuuuaagauuuaccacaagugugacaacgccugcaucggcagcauucggaaugggaccuaugaucauaacguguacagagacgaggcucugaauaaccgcuuccagaucaaaggcguugaacucaagucuggauacaaagacuggauucuguggaucuccuuugccaucagcugcuuccuucuguguguggcccuccugggcuuuauuaugugggcuugccagaaggggaauauccgguguaacauuugcaucuga

SEQ ID NO: 194461 - RNA, 1701 nt, Artificial Sequence; identical to SEQ ID NO: 193506
  derived and/or modified sequence opt5 from hemagglutinin__InfluenzaA__AHL96116

SEQ ID NO: 194462 - RNA, 1701 nt, Artificial Sequence; identical to SEQ ID NO: 192882
  derived and/or modified sequence opt5 from hemagglutinin__InfluenzaA__AHL96128

SEQ ID NO: 194463 - RNA, 1701 nt, Artificial Sequence; identical to SEQ ID NO: 193018
  derived and/or modified sequence opt5 from hemagglutinin__InfluenzaA__AHL96152

SEQ ID NO: 194464 - RNA, 1701 nt, Artificial Sequence
  derived and/or modified sequence opt5 from hemagglutinin__InfluenzaA__AHL96164
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugguugauggaugguauggcuucagacaccagaacagcgagggccgggggcaggccgcugaccugaaauccacccaagccgccauugaucagaucaauggaaagcucaacagacugauuggcaaaacaaaugaaaaguuccaccagaucgagaaggaauuuagcgagguggaagggcgcauucaggaccuugagaaauacguggaggauaccaagaucgaccuguggucuuauaacgcugaacuccuggucgcgcuggagaaccaacauacaaucgaucucaccgacuccgaaaugaauaaacuguucgagaagacgaaaaagcagcuucgggaaaacgccgaggauaugggaaauggcugcuuuaagauuuaccacaaaugugacaacgcuugcaucgggagcauuagaaauggcacauaugaucaugacguguaccgcgacgaggcccugaacaaucgguuccagaucaagggaguugaacucaaaucuggcuacaagaacuggauucuguggaucuccuuugccaucagcugcuuccuucuguguguggcucuccugggguuuauuaugugggccugccagaaaggaaauaucagauguaacauuugcaucuga

SEQ ID NO: 194465 - RNA, 1701 nt, Artificial Sequence; identical to SEQ ID NO: 193018
  derived and/or modified sequence opt5 from hemagglutinin__InfluenzaA__AHL96176

SEQ ID NO: 194466 - RNA, 1701 nt, Artificial Sequence; identical to SEQ ID NO: 193018
  derived and/or modified sequence opt5 from hemagglutinin__InfluenzaA__AHL96188

SEQ ID NO: 194467 - RNA, 1701 nt, Artificial Sequence
  derived and/or modified sequence opt5 from hemagglutinin__InfluenzaA__AHL96200
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagguccuugauggggaaaacuguacacugauugacgcccuccugggagauccccagugcgacggcuuucagaauaaaaagugggaucuguucguggagcggucuaaagccuauagcaacuguuacccuuaugacguucccgauuacgcuucccuccgcucucugguggccagcuccgggacccuugaauuuaauaacgagagcuucaauugggcuggagucacgcaaaacggcaccucuuccgccugcaucagaggcagcaauucuuccuuuuucagccggcugaacuggcucacacaucugaauuuuaaguauccugcgcuuaacgugaccaugcccaacaaugagcaguucgacaagcuguacauuuggggaguucaccauccugggacagauaaagaccagaucuuucucuaugcccagucuuccggccgcauuaccgugagcacgaagagaucccaacaggcugucaucccgaacauugggucucggccccgcaucagaaauaucccuagccggauuuccaucuacuggacaauugugaaacccggagauauccugcugauuaacagcaccggcaaucucaucgccccucgcggguacuucaagaucagaucuggaaaauccagcauuaugcggucugacgcucccaucggcaaguguaagagcgaaugcauuacaccgaacggcuccaucccuaaugacaaacccuuucagaacgugaaucgcauuaccuauggggccuguccuagauacgucaagcagucuacccugaaacuugcgacaggaaugcggaacguucccgagaagcaaacgcgcggcaucuucggggccaucgcuggauuuauugaaaauggcugggaggggaugguggauggaugguauggcuucagacaccagaacagcgagggccgggggcaggccgcugaccugaaauccacccaagccgccaucgaucagauuaauggaaagcucaacagacugaucggcaaaacaaaugaaaaguuccaccagauugagaaggaauuuagcgagguggaagggcgcauccaggaccuugagaaauacgucgaggauaccaagauugaccuguggucuuauaacgcugaacuccugguggcgcuggagaaccaacauacaaucgaucucaccgacuccgaaaugaauaaacuguucgagaagacgaaaaagcagcuucgggaaaacgccgaggauaugggaaauggcugcuuuaagaucuaccacaaaugugacaacgcuugcauugggagcaucagaaauggcacauaugaucaugacguuuaccgcgacgaggcccugaacaaucgguuccagauuaagggaguggaacucaaaucuggcuacaaggauuggauccuguggauuuccuuugccaucagcugcuuccuucugugugucgcucuccugggguuuaucaugugggccugccagaaaggaaacauuagauguaauaucugcauuuga

SEQ ID NO: 194468 - RNA, 1701 nt, Artificial Sequence; identical to SEQ ID NO: 192882
  derived and/or modified sequence opt5 from hemagglutinin__InfluenzaA__AHL96212

SEQ ID NO: 194469 - RNA, 1701 nt, Artificial Sequence; identical to SEQ ID NO: 193491
  derived and/or modified sequence opt5 from hemagglutinin__InfluenzaA__AHL96224

SEQ ID NO: 194470 - RNA, 1701 nt, Artificial Sequence
  derived and/or modified sequence opt5 from hemagglutinin__InfluenzaA__AHL96236
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaugggcgagaucugcgacuccccgcaccagauccuugauggggaaaacuguacacugauugacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcaucagacggagcaauucuuccuuuuucagccgccugaacuggcucacccaucugaauuuuaaguauccugcccuuaacgucacaaugcccaacaaugagcaguucgacaagcuguacauuuggggcgugcaccauccugggaccgauaaagaccagaucuuucucuaugcgcagucuuccggaagaauuacgguuagcacaaagcggucccaacaggccgugaucccgaacauuggcucucgccccagaauccggaauaucccuagccgcauuuccaucuacuggaccauugucaaacccggggauauccugcugauuaacagcacaggaaaucucaucgcuccuagaggcuacuucaagauccggucugggaaauccagcauuaugcgcucugacgcccccaucggaaaguguaagagcgaaugcauuaccccgaacggcuccaucccuaaugacaaacccuuucagaacgugaauagaauuaccuauggcgcuuguccucgguacgugaagcagucuacacugaaacuugccacggggaugcgcaacguccccgagaagcaaaccagaggaaucuucggcgcgaucgccggguuuauugaaaauggaugggagggcaugguugaugggugguauggauuccggcaccagaacagcgagggcagaggccaggcugccgaccugaaauccacacaagcugccaucgaucagauuaaugggaagcucaaccgccugaucggaaaaaccaaugaaaaguuccaccagauugagaaggaauuuagcgagguggaaggccggauccaggaccuugagaaauacguggaggauacaaagauugaccuguggucuuauaacgccgaacuccuggucgcucuggagaaccaacauaccaucgaucucacggacuccgaaaugaauaaacuguucgagaagaccaaaaagcagcuuagagaaaacgcggaggauauggggaauggaugcuuuaagaucuaccacaaaugugacaacgccugcauugagagcauccgcaauggcacauaugaucaugacguguaccgggacgaagcucugaacaauagauuccagauuaaggggguugagcucaaaucuggcuacaagaacuggauccuguggauuuccuuugccaucagcugcuuccuucuguguguggcccuccugggauuuaucaugugggcuugccagaaaggcaauauucgcuguaacaucugcauuuga

SEQ ID NO: 194471 - RNA, 1701 nt, Artificial Sequence
  derived and/or modified sequence opt5 from hemagglutinin__InfluenzaA__AHL96248
augaagaccaucauugcccugggcuacauccucugccugguguucgcucagaaacuucccgggaacgacaauagcacagccacgcugugucucggacaccaugcggucccuaacggcaccauuguuaagacaaucaccaaugauagaauugaggugacaaacgcuaccgaacuggugcaaaauuccucuaucggggagaucugcgacagcccgcaccagauucuugauggagaaaacuguacacugaucgacgcccuccugggcgauccccagugcgacggguuucagaauaaaaagugggaucuguucauugagcgguccaaagccuauucuaacuguuacccuuaugacguccccgauuacgcuagccuccgcucccugguggccucuagcggaacccuugaauuuaauaacgaguccuucaauuggacgggcguuacccaaaacggcacaagcucugcuugcaucagacgguccaauagcuccuuuuucucucgccugaacuggcucacccaucugaauuuuaaguauccugcccuuaacgugacaaugcccaacaaugagcaguucgacaagcuguacauuuggggaguccaccauccugggaccgauaaagaccagaucuuucucuaugcgcagagcucuggcagaauuacgguguccacaaagcggagccaacaggccguuaucccgaacaucgggucccgcccccggauuagaaauaucccuucucgcauuagcaucuacuggaccauugugaaacccggagauauccugcugaucaacuccacaggcaaucucauugcuccuagaggguacuucaagauccggagcggaaaaucuuccauuaugcgcagcgacgcccccaucggcaaguguaagucugaaugcauuaccccgaacggcagcaucccuaaugacaaacccuuucagaacgucaauagaaucaccuauggggcuuguccucgguacgugaagcaguccacacugaaacuugccacgggaaugcgcaacgugcccgagaagcaaaccagaggcauuuucggggcgaucgccggauuuauugaaaauggcugggaggggauggucgauggaugguauggcuuccggcaccagaacucugagggcagagggcaggcugccgaccugaaaagcacacaagcugccaucgaucagauuaauggaaagcucaaccgccugaucggcaaaaccaaugaaaaguuccaccagauugagaaggaauuuuccgagguugaagggcggauccaggaccuugagaaauacguggaggauacaaagaucgaccuguggagcuauaacgccgaacuccugguggcucuggagaaccaacauaccauugaucucacggacucugaaaugaauaaacuguucgagaagaccaaaaagcagcuuagagaaaacgcggaggauaugggaaauggcugcuuuaagaucuaccacaaaugugacaacgccugcauuggguccauccgcaauggcacauaugaucaugacgucuaccgggacgaggcucugaacaauagauuccagauuaagggaguggaacucaaaagcggcuacaaggauuggauccuguggaucucuuuugccauuuccugcuuccuucuguguguugcccuccugggguuuaucaugugggcuugccagaaaggaaacauucgcuguaauaucugcauuuga

SEQ ID NO: 194472 - RNA, 1701 nt, Artificial Sequence; identical to SEQ ID NO: 193018
  derived and/or modified sequence opt5 from hemagglutinin__InfluenzaA__AHL96260

SEQ ID NO: 194473 - RNA, 1701 nt, Artificial Sequence; identical to SEQ ID NO: 192882
  derived and/or modified sequence opt5 from hemagglutinin__InfluenzaA__AHL96274

SEQ ID NO: 194474 - RNA, 1701 nt, Artificial Sequence; identical to SEQ ID NO: 193018
  derived and/or modified sequence opt5 from hemagglutinin__InfluenzaA__AHL96304

SEQ ID NO: 194475 - RNA, 1701 nt, Artificial Sequence; identical to SEQ ID NO: 192859
  derived and/or modified sequence opt5 from hemagglutinin__InfluenzaA__AHL96318

SEQ ID NO: 194476 - RNA, 1701 nt, Artificial Sequence; identical to SEQ ID NO: 193018
  derived and/or modified sequence opt5 from hemagglutinin__InfluenzaA__AHL96330

SEQ ID NO: 194477 - RNA, 1701 nt, Artificial Sequence; identical to SEQ ID NO: 193021
  derived and/or modified sequence opt5 from hemagglutinin__InfluenzaA__AHL96342

SEQ ID NO: 194478 - RNA, 1701 nt, Artificial Sequence
  derived and/or modified sequence opt5 from hemagglutinin__InfluenzaA__AHL96354
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugguugauggaugguauggcuucagacaccugaacagcgagggccgggggcaggccgcugaccucaaauccacccaggccgccauugaucaaaucaauggaaagcugaacagacuuauuggcaaaacaaaugaaaaguuccaccagaucgagaaggaauuuagcgagguggaagggcgcauucaggaccuggagaaauacguggaggauaccaagaucgaccucuggucuuauaacgcugaacugcuggucgcgcucgagaaccagcauacaaucgaucugaccgacuccgaaaugaauaaacuuuucgagaagacgaaaaagcaacugcgggaaaacgccgaggauaugggaaauggcugcuuuaagauuuaccacaaaugugacaacgcuugcaucgggagcauuagaaauggcacauaugaucaugacguguaccgcgacgaggcccucaacaaucgguuccagaucaagggaguugaacugaaaucuggcuacaaggauuggauucuuuggaucuccuuugccaucagcugcuuccugcucuguguggcucugcugggguuuauuaugugggccugccagaaaggaaacaucagauguaauauuugcaucuga

SEQ ID NO: 194479 - RNA, 1701 nt, Artificial Sequence
  derived and/or modified sequence opt5 from hemagglutinin__InfluenzaA__AHL96366
augaagaccaucauugcccugagcuacauccucugccugguguucgcucagaaacuucccgagaacgacaauuccacagccacgcugugucucggccaccaugcggucccuaacgggaccauuguuaagacaaucaccaaugauagaauugaagugacaaacgcuaccgagcuggugcaaaauucuagcaucggagaaaucugcgacuccccgcaccagauucuugauggcgagaacuguacacugaucgacgcccuccugggggauccccagugcgacggauuucagaauaaaaagugggaucuguucgucgaacggucuaaagccuauagcaacuguuacccuuaugacgugcccgauuacgcuucccuccgcucucugguugccagcuccggcacccuugaguuuaauaacgagagcuucaauugggcuggggugacgcaaaacggaaccucuuccgccugcauuagaggcagcaauucuuccuuuuucagccggcugaacuggcucacacaucugaauuuuaaguauccugcgcuuaacgucaccaugcccaacaaugaacaguucgacaagcuguacaucuggggcgugcaccauccugggacagauaaagaccagauuuuucucuaugcccagucuuccggacgcaucaccguuagcacgaagagaucccaacaggcugugauuccgaacaucggcucucggccccgcaucagaaauauuccuagccggaucuccauuuacuggacaaucgucaaacccggggauauucugcugaucaacagcaccggaaaucucaucgccccucgcggcuacuucaagauuagaucugggaaauccagcaucaugcggucugacgcucccauuggaaaguguaagagcgagugcaucacaccgaacggcuccauuccuaaugacaaacccuuucagaacgugaaucgcaucaccuauggcgccuguccuagauacgugaagcagucuacccugaaacuugcgacagggaugcggaacguccccgaaaagcaaacgcgcggaaucuucggcgccauugcuggguuuaucgagaauggaugggagggcaugguugaugggugguauggauucagacaccagaacagcgaaggccggggccaggccgcugaccugaaauccacccaagccgccauugaucagaucaaugggaagcucaacagacugauuggaaaaacaaaugagaaguuccaccagaucgaaaaggaguuuagcgaaguggagggccgcauucaggaccuugagaaauacguggaagauaccaagaucgaccuguggucuuauaacgcugagcuccuggucgcgcuggaaaaccaacauacaaucgaucucaccgacuccgagaugaauaaacuguucgaaaagacgaaaaagcagcuucgggagaacgccgaggauauggggaauggaugcuuuaagauuuaccacaaaugugacaacgcuugcaucggcagcauuagaaaugggacauaugaucaugacguguaccgcgacgaagcccugaacaaucgguuccagaucaagggcguugagcucaaaucuggauacaaggauuggauucuguggaucuccuuugccaucagcugcuuccuucuguguguggcucuccugggcuuuauuaugugggccugccagaaagggaacaucagauguaauauuugcaucuga

SEQ ID NO: 194480 - RNA, 1701 nt, Artificial Sequence; identical to SEQ ID NO: 192892
  derived and/or modified sequence opt5 from hemagglutinin__InfluenzaA__AHL96378

SEQ ID NO: 194481 - RNA, 1701 nt, Artificial Sequence; identical to SEQ ID NO: 192882
  derived and/or modified sequence opt5 from hemagglutinin__InfluenzaA__AHL96390

SEQ ID NO: 194482 - RNA, 1701 nt, Artificial Sequence
  derived and/or modified sequence opt5 from hemagglutinin__InfluenzaA__AHL96402
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaggcagcaauucuuccuuuuucagccggcuuaacuggcugacccaucucaauuuuaaguauccugcccugaacgucacaaugcccaacaaugagcaguucgacaaacuuuacauuuggggagugcaccauccugggaccgauaaagaccagaucuuucuguaugcgcagucuuccggccgcauuacgguuagcacaaagagaucccaacaggccgugaucccgaacaucgggucucggccccgcauuagaaauaucccuagccggauuuccaucuacuggaccauugucaaacccggagauauccuccugaucaacagcacaggcaaucugauugcuccucgcggguacuucaagaucagaucuggaaaauccagcauuaugcggucugacgcccccaucggcaaguguaagagcgaaugcauuaccccgaacggcuccaucccuaaugacaaacccuuucagaacgugaaucgcaucaccuauggggcuuguccuagauacgugaagcagucuacacucaaacuggccacgggaaugcggaacguccccgagaagcaaacccgcggcauuuucggggcgaucgccggauuuauugaaaauggcugggaggggaugguugauggaugguauggcuucagacaccagaacagcgagggccgggggcaggcugccgaccuuaaauccacacaagcugccaucgaucagauuaauggaaagcugaacagacucaucggcaaaaccaauaagaaguuccaccagauugaaaaagaguuuagcgaaguggaggggcgcauccaggaccuggaaaaguacguggaggauacaaaaaucgaccuuuggucuuauaacgccgagcugcucgucgcucuggaaaaccaacauaccauugaucugacggacuccgagaugaauaaacucuucgaaaagacaaagaagcagcugcgggagaacgcggaagauaugggaaauggcugcuuuaagaucuaccacaagugugacaacgccugcauugggagcaucagaaauggcaccuaugaucaugacguguaccgcgacgaggcucuuaacaaucgguuccagauuaaaggaguugagcugaagucuggcuacaaagauuggauccucuggaucuccuuugccauuagcugcuuccugcuuuguguggcccugcucggguuuaucaugugggcuugccagaagggaaacauuagauguaauaucugcauuuga

SEQ ID NO: 194483 - RNA, 1701 nt, Artificial Sequence; identical to SEQ ID NO: 192892
  derived and/or modified sequence opt5 from hemagglutinin__InfluenzaA__AHL96414

SEQ ID NO: 194484 - RNA, 1701 nt, Artificial Sequence; identical to SEQ ID NO: 193018
  derived and/or modified sequence opt5 from hemagglutinin__InfluenzaA__AHL96426

SEQ ID NO: 194485 - RNA, 1701 nt, Artificial Sequence
  derived and/or modified sequence opt5 from hemagglutinin__InfluenzaA__AHL96438
augaagaccaucauugcccugagcuacauccucugccugguguucgcucaggagcuucccggcaacgacgauuccacagccacgcugugucucgggcaccaugcggucccuaauggaaccauuguuaaaacaaucaccaacgaccaaauugaagugacaaaugcuaccgagcuggugcagucuagcuccacaggcgaaaucugcaacucuccgcaccagauccuugauggggagaauuguacccugauugacgcccuccugggagauccccagugcgacggcuuucaaaacaagaaaugggaucuguucgucgaaagaagcaaggcccauuccaauuguuauccuuacgacgugcccgauuaugcuucucuccggagccugguugccuccagcgggacgcuugaguuuaacaaugagucuuucaacuggaccggagugacacagaauggcaccuccagcgcuugcauccgcagaucuaacaauuccuuuuucagccggcugaacuggcucacacaccugaauuuuaaauacccugcccuuaacgucaccaugcccaacaaugaacaguucgacaagcuguauauuuggggcgugcaucacccugggacggauaaggaccagaucuuucucuacgcgcaagccucuggacgcauuacaguuuccaccaaaagaagccagcaggcugugaucccgaacauuggcucccggccccgcgucagaaauaucccuucucgggugagcaucuauuggacaauugugaagcccggggauauccugcugauuaacuccaccggaaaucucaucgccccucgcggcuacuucaaaauuagaagcgggaagucuuccaucaugcggagcgacgcucccaucggaaaauguucuagcgccugcauuaccccgaacggcuccaucccuaaugacaagcccuuucagaacgucaaucgcauuacauacggcgcguguccuagauauguuaagcaaaacacgcugaaacuugccaccgggaugcggaaugugcccgagaagcagacacgcggaaucuucggcgcuauugccggguuuaucgaaaacggaugggagggcaugguggaugggugguacggauucagacaccaaaauucugagggccggggccaggcugccgaccugaaaagcacccaggccgcuaucgaucagauuaacgggaagcucaauagacugaucggaaaaacaaacgaaaaguuccaucagauugagaaagaauuuuccgaggucgaaggccgcauccaagaccuugagaaguauguggaggauaccaagauugaccuguggagcuacaacgcggaacuccugguugcccuggagaaucagcacacgaucgaucucacagacucugaaaugaacaaacuguucgagaagaccaaaaagcagcuucgggaaaaugcugaggauauggggaacggaugcuuuaaaauuuaucauaagugugacaaugccugcaucggcuccaucagaaacgggaccuacgaucacgacguguaucgcgacgaggcccugaauaaccgguuccagauuaagggcgucgaacucaaaagcggauacaaggauuggauccuguggauuucuuuugcuaucuccugcuuccuucuguguguggcccuccugggcuuuauuaugugggcgugccaaaaagggaauaucagauguaacaucugcauuuga

SEQ ID NO: 194486 - RNA, 1701 nt, Artificial Sequence; identical to SEQ ID NO: 192892
  derived and/or modified sequence opt5 from hemagglutinin__InfluenzaA__AHL96450

SEQ ID NO: 194487 - RNA, 1701 nt, Artificial Sequence; identical to SEQ ID NO: 193018
  derived and/or modified sequence opt5 from hemagglutinin__InfluenzaA__AHL96462

SEQ ID NO: 194488 - RNA, 1701 nt, Artificial Sequence
  derived and/or modified sequence opt5 from hemagglutinin__InfluenzaA__AHL96474
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguuucuccccugcaucucggcaagugcaacaucgccggguggauucugggaaauccugagugugaaagccuguccacagccucuagcugguccuacaucguggagaccucuggcagcgacaacgggacgugcuauccgggagauuuuauugacuacgaggagcuccgggagcagcuguccagcgucucuuccuucgaacgcuuugagaucuuccccaagaccagcucuuggccuaaucacgauuccaacaagggcgugacagcugccuguccccaugcuggcgccaaaggguuuuauaagaaucuuaucuggcugguuaaaaagggaaacagcuacccuaaacucucuauuuccuauaucaaugacaagggcaaggaagugcugguccuuugggggauucaccaccccagcaccacagcggaucaacagucccuguaccagaacgccgacaccuacguguucgugggaacgucuagauauagcaaaaaguuuaaaccugagaucgcuauucggccgaagguccgcgaucaggagggcagaaugaauuacuauuggacacucguugaacccggggacaaaaucaccuucgaggccacaggaaaccugguggugccucgguacgcuuuugccauggaacgcaacgcgggcuccggcauuaucaucagcgauacccccguccaugacugcaauaccacaugucaaacgccuaagggggccauuaacaccucucugcccuuccagaauauccacccgauuacaaucggaaaaugcccuaaguaugugaaguccaccaaacucagacuggcuacaggccuucggaacguucccagcauucagucucgcgggcuguuuggagccaucgcuggcuucaucgaagggggauggaccggcaugguggacggcugguacggguaucaucaccagaaugaacaaggaagcggcuacgccgccgaucucaaguccacgcagaacgcuauugacaaaaucacaaauaaggucaacucugugauugagaaaaugaauacccaguuuaccgcgguugggaaggaguucaaccaccuggaaaagagaaucgagaaucuuaacaaaaagguggaugacggauuccuggauauuuggacauacaaugccgaacuccugguccugcucgagaacgaacggacccuggacuaucaugauagcaaugugaaaaaccuuuacgagaagguccgcaaccagcugaaaaauaacgcuaaggagaucggcaauggguguuuugaguucuaucacaagugcgacaacacauguauggaauccgugaaaaauggcacguacgauuauccuaaguacagcgaagaggccaaacucaacagagaagagaucgacggaguuaagcuggagucuacccggauuuaucaaauccuugccauuuacuccacagcugccagcucucuggugcucgucgugucccugggcgcgaucagcuuuuggaugugcuccaaugggucucugcagugccgcauuuguaucuga

SEQ ID NO: 194489 - RNA, 1701 nt, Artificial Sequence
  derived and/or modified sequence opt5 from hemagglutinin__InfluenzaA__AHL96485
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugaagucugacgcccccauuggaaaguguaaaagcgaaugcaucaccccgaacggcuccauuccuaaugacaagcccuuucagaacgugaaucgcaucaccuauggcgcuuguccuagauacgugaaacagucuacacugaaacuugccacggggaugcggaacguccccgagaagcaaacccgcggaaucuucggcgcgauugccggguuuaucgaaaauggaugggagggcaugguugaugggugguauggauucagacaccagaacagcgagggccggggccaggcugccgaccugaaguccacacaagcugccauugaucagaucaaugggaaacucaacagacugauuggaaagaccaaugaaaaguuccaccagaucgagaaagaauuuagcgagguggaaggccgcauucaggaccuugagaaguacguggaggauacaaaaaucgaccuguggucuuauaacgccgaacuccuggucgcucuggagaaccaacauaccaucgaucucacggacuccgaaaugaauaagcuguucgagaaaacaaagaagcagcuucgggaaaacgcggaggauauggggaauggaugcuuuaaaauuuaccacaagugugacaacgccugcaucggcagcauuagaaaugggaccuaugaucauaacguguaccgcgacgaggcucugaauaaccgguuccagaucaaaggcguugaacucaagucuggauacaaagacuggauucuguggaucuccuuugccaucagcugcuuccuucuguguguggcccuccugggcuuuauuaugugggcuugccagaaggggaauaucagauguaacauuugcaucuga

SEQ ID NO: 194490 - RNA, 1701 nt, Artificial Sequence; identical to SEQ ID NO: 193018
  derived and/or modified sequence opt5 from hemagglutinin__InfluenzaA__AHL96497

SEQ ID NO: 194491 - RNA, 1701 nt, Artificial Sequence; identical to SEQ ID NO: 192892
  derived and/or modified sequence opt5 from hemagglutinin__InfluenzaA__AHL96509

SEQ ID NO: 194492 - RNA, 1701 nt, Artificial Sequence; identical to SEQ ID NO: 192859
  derived and/or modified sequence opt5 from hemagglutinin__InfluenzaA__AHL96521

SEQ ID NO: 194493 - RNA, 1701 nt, Artificial Sequence; identical to SEQ ID NO: 193018
  derived and/or modified sequence opt5 from hemagglutinin__InfluenzaA__AHL96533

SEQ ID NO: 194494 - RNA, 1701 nt, Artificial Sequence; identical to SEQ ID NO: 192882
  derived and/or modified sequence opt5 from hemagglutinin__InfluenzaA__AHL96545

SEQ ID NO: 194495 - RNA, 1701 nt, Artificial Sequence
  derived and/or modified sequence opt5 from hemagglutinin__InfluenzaA__AHL96569
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaguuacggugagcacaaagcggucccaacaggccgucaucccgaacauuggcucucgccccagaauccggaauaucccuagccgcauuuccaucuacuggaccauugugaaacccggggauauccugcugauuaacagcacaggaaaucucaucgcuccuagaggcuacuucaagauccggucugggaaauccagcauuaugcgcucugacgcccccaucggaaaguguaagagcgaaugcauuaccccgaacggcuccaucccuaaugacaaacccuuucagaacgugaauagaauuaccuauggcgcuuguccucgguacgucaagcagucuacacugaaacuugccacggggaugcgcaacguucccgagaagcaaaccagaggaaucuucggcgcgaucgccggguuuauugaaaauggaugggagggcaugguggaugggugguauggauuccggcaccagaacagcgagggcagaggccaggcugccgaccugaaauccacacaagcugccaucgaucagauuaaugggaagcucaaccgccugaucggaaaaaccaaugaaaaguuccaccagauugagaaggaauuuagcgagguggaaggccggauccaggaccuugagaaauacgucgaggauacaaagauugaccuguggucuuauaacgccgaacuccugguggcucuggagaaccaacauaccaucgaucucacggacuccgaaaugaauaaacuguucgagaagaccaaaaagcagcuuagagaaaacgcggaggauauggggaauggaugcuuuaagaucuaccacaaaugugacaacgccugcauuggcagcauccgcaaugggacauaugaucaugacguuuaccgggacgaggcucugaacaauagauuccagauuaagggcguggaacucaaaucuggauacaaggauuggauccuguggauuuccuuugccaucagcugcuuccuucugugugucgcccuccugggcuuuaucaugugggcuugccagaaagggaacauucgcuguaauaucugcauuuga

SEQ ID NO: 194496 - RNA, 1701 nt, Artificial Sequence; identical to SEQ ID NO: 194488
  derived and/or modified sequence opt5 from hemagglutinin__InfluenzaA__AHL96581

SEQ ID NO: 194497 - RNA, 1701 nt, Artificial Sequence
  derived and/or modified sequence opt5 from hemagglutinin__InfluenzaA__AHL96592
augaagaccaucauugcccugggcuacauccucugccugguguucgcucagaaaauucccgggaacgacaauagcacagccacgcuuugucugggacaccaugcggucccuaacggcaccaucguuaagacaauuaccaaugauagaaucgaggugacaaacgcuaccgaacucgugcaaaauuccucuaucggggagauuugcgacagcccgcaccagauccuggauggagaaaacuguacacuuauugacgcccugcucggcgauccccagugcgacggguuucagaauaaaaagugggaucuguucaucgagcgguccaaagccuauucuaacuguuacccuuaugacguccccgauuacgcuagccugcgcucccucguggccucuagcggaacccuggaauuuaauaacgaguccuucaauuggacgggcguuacccaaaacggcacaagcucugcuugcauuagacgguccaauagcuccuuuuucucucgccuuaacuggcugacccaucucaauuuuaaguauccugcccugaacgugacaaugcccaacaaugagcaguucgacaaacuuuacaucuggggaguccaccauccugggaccgauaaagaccagauuuuucuguaugcgcagagcucuggcagaaucacgguguccacaaagcggagccaacaggccguuaucccgaacauugggucccgccccagaauccggaauauuccuucucgcaucagcauuuacuggaccaucgugaaacccggagauauccuccugauuaacuccacaggcaaucugaucgcuccuagaggguacuucaagauucggagcggaaaaucuuccaucaugcgcagcgacgcccccauuggcaaguguaagucugaaugcaucaccccgaacggcagcaucccuaaugacaaacccuuucagaacgucaauagaauuaccuauggggcuuguccucgguacgugaagcaguccacacucaaacuggccacgggaaugcgcaacgugcccgagaagcaaaccagaggcaucuucggggcgauugccggauuuaucgaaaauggcugggaggggauggucgauggaugguauggcuuccggcaccagaacucugagggcagagggcaggcugccgaccuuaaaagcacacaagcugccauugaucagaucaauggaaagcugaaccgccucauuggcaaaaccaaugaaaaguuccaccagaucgagaaggaauuuuccgagguugaagggcggauccaggaccuggagaaauacguggaggauacaaagauugaccuuuggagcuauaacgccgaacugcucguggcucuggagaaccaacauaccaucgaucugacggacucugaaaugaauaaacucuucgagaagacaaagaagcagcugagagaaaacgcggaggauaugggaaauggcugcuuuaagauuuaccacaaaugugacaacgccugcaucggguccauucgcaauggcaccuaugaucaugacgucuaccgggacgaggcucuuaacaauagauuccagaucaagggaguggaacugaaaagcggcuacaaggauuggauccucuggauuucuuuugccaucuccugcuuccugcuuuguguugcccugcucggguuuauuaugugggcuugccagaaaggaaacauccgcuguaauauuugcaucuga

SEQ ID NO: 194498 - RNA, 1701 nt, Artificial Sequence; identical to SEQ ID NO: 193018
  derived and/or modified sequence opt5 from hemagglutinin__InfluenzaA__AHL96604

SEQ ID NO: 194499 - RNA, 1701 nt, Artificial Sequence; identical to SEQ ID NO: 193018
  derived and/or modified sequence opt5 from hemagglutinin__InfluenzaA__AHL96616

SEQ ID NO: 194500 - RNA, 1701 nt, Artificial Sequence
  derived and/or modified sequence opt5 from hemagglutinin__InfluenzaA__AHL96628
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagucuacacugaaacuugccacggggaugcgcaacguccccgagaagcaaaccagaggaaucuucggcgcgauugccggguuuaucgaaaauggauggggcgggaugguugauggaugguauggcuuccggcaccagaacagcgagggcagagggcaggcugccgaccugaaauccacacaagcugccauugaucagaucaauggaaagcucaaccgccugauuggcaaaaccaaugagaaguuccaccagaucgaaaaggaguuuagcgaaguggaggggcggauucaggaccuugaaaaauacguggaggauacaaagaucgaccuguggucuuauaacgccgagcuccuggucgcucuggaaaaccaacauaccaucgaucucacggacuccgagaugaauaaacuguucgaaaagaccaaaaagcagcuuagagagaacgcggaagauaugggaaauggcugcuuuaagauuuaccacaaaugugacaacgccugcaucgggagcauucgcaauggcacauaugaucauaacguguaccgggacgaggcucugaauaacagauuccagaucaagggaguugagcucaaaucuggcuacaaggacuggauucuguggaucuccuuugccaucagcugcuuccuucuguguguggcccuccugggguuuauuaugugggcuugccagaaaggaaauauccgcuguaacauuugcaucuga

SEQ ID NO: 194501 - RNA, 1701 nt, Artificial Sequence; identical to SEQ ID NO: 194489
  derived and/or modified sequence opt5 from hemagglutinin__InfluenzaA__AHL96640

SEQ ID NO: 194502 - RNA, 1701 nt, Artificial Sequence
  derived and/or modified sequence opt5 from hemagglutinin__InfluenzaA__AHL96652
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaagacucuagcaucggcgagaucugcgauuccccgcaccagauucuugacggggaaaauuguacacugaucgaugcccuccugggagacccccagugcgauggcuuucagaacaaaaagugggaccuguucgucgagcggucuaaagccuauagcaauuguuacccuuaugaugugcccgacuacgcuucccuccgcucucugguugccagcuccgggacccuugaauuuaacaaugagagcuucaacugggcuggagugacgcaaaauggcaccucuuccgccugcauuagaggcagcaacucuuccuuuuucagccggcugaauuggcucacacaucugaacuuuaaguauccugcgcuuaaugucaccaugcccaacaacgagcaguucgauaagcuguacaucuggggagugcaccauccugggacagacaaagaucagauuuuucucuaugcccagucuuccggccgcaucaccguuagcacgaagagaucccaacaggcugugauuccgaauaucgggucucggccccgcaucagaaacauuccuagccggaucuccauuuacuggacaaucgucaaacccggagacauucugcugaucaauagcaccggcaaccucaucgccccucgcggguacuucaagauuagaucuggaaaauccagcaucaugcggucugacgcucccauuggcaaguguaagagcgaaugcaucacaccgaauggcuccauuccuaacgauaaacccuuucagaaugugaaccgcaucaccuauggggccuguccuagauacgugaagcagucuacccugaaacuugcgacaggaaugcggaauguccccgagaagcaaacgcgcggcaucuucggggccauugcuggauuuaucgaaaacggcugggaggggaugguugacggaugguauggcuucagacaccagaauagcgagggccgggggcaggccgcugaucugaaauccacccaagccgccauugaccagaucaacggaaagcucaauagacugauuggcaaaacaaacgaaaaguuccaccagaucgagaaggaauuuagcgagguggaagggcgcauucaggaucuugagaaauacguggaggacaccaagaucgaucuguggucuuauaaugcugaacuccuggucgcgcuggagaaccaacauacaaucgaccucaccgauuccgaaaugaacaaacuguucgagaagacgaaaaagcagcuucgggaaaaugccgaggacaugggaaacggcugcuuuaagauuuaccacaaaugugauaaugcuugcaucgggagcauuagaaacggcacauaugaccaugacguguaccgcgaugaggcccugaauaaccgguuccagaucaagggaguugaacucaaaucuggcuacaaggacuggauucuguggaucuccuuugccaucagcugcuuccuucuguguguggcucuccugggguuuauuaugugggccugccagaaaggaaauaucagauguaacauuugcaucuga

SEQ ID NO: 194503 - RNA, 1701 nt, Artificial Sequence; identical to SEQ ID NO: 193491
  derived and/or modified sequence opt5 from hemagglutinin__InfluenzaA__AHL96664

SEQ ID NO: 194504 - RNA, 1701 nt, Artificial Sequence
  derived and/or modified sequence opt5 from hemagglutinin__InfluenzaA__AHL96676
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaucgacaaacccuuucagaaugugaacagaaucaccuauggcgcuuguccucgguacgugaagcagucuacacugaaacuugccacggggaugcgcaauguccccgagaagcaaaccagaggaauuuucggcgcgaucgccggguuuauugaaaacggaugggagggcaugguugaugggugguauggauuccggcaccagaauagcgagggcagaggccaggcugccgaccugaaauccacacaagcugccaucgaucagauuaacgggaagcucaaucgccugaucggaaaaaccaacgaaaaguuccaccagauugagaaggaauuuagcgagguggaaggccggauccaggaccuugagaaauacguggaggauacaaagaucgaccuguggucuuauaaugccgaacuccuggucgcucuggagaaccaacauaccauugaucucacggacuccgaaaugaacaaacuguucgagaagaccaaaaagcagcuuagagaaaaugcggaggauauggggaacggaugcuuuaagaucuaccacaaaugugacaaugccugcauuggcagcauccgcaacgggacauaugaucaugacguguaccgggacgaggcucugaauaacagauuccagauuaagggcguugaacucaaaucuggauacaaggauuggauccuguggaucuccuuugccauuagcugcuuccuucuguguguggcccuccugggcuuuaucaugugggcuugccagaaagggaauauucgcuguaacaucugcauuuga

SEQ ID NO: 194505 - RNA, 1701 nt, Artificial Sequence; identical to SEQ ID NO: 193018
  derived and/or modified sequence opt5 from hemagglutinin__InfluenzaA__AHL96688

SEQ ID NO: 194506 - RNA, 1701 nt, Artificial Sequence; identical to SEQ ID NO: 193018
  derived and/or modified sequence opt5 from hemagglutinin__InfluenzaA__AHL96700

SEQ ID NO: 194507 - RNA, 1701 nt, Artificial Sequence; identical to SEQ ID NO: 193018
  derived and/or modified sequence opt5 from hemagglutinin__InfluenzaA__AHL96712

SEQ ID NO: 194508 - RNA, 1701 nt, Artificial Sequence; identical to SEQ ID NO: 192892
  derived and/or modified sequence opt5 from hemagglutinin__InfluenzaA__AHL96724

SEQ ID NO: 194509 - RNA, 1701 nt, Artificial Sequence; identical to SEQ ID NO: 192882
  derived and/or modified sequence opt5 from hemagglutinin__InfluenzaA__AHL96748

SEQ ID NO: 194510 - RNA, 1701 nt, Artificial Sequence; identical to SEQ ID NO: 192892
  derived and/or modified sequence opt5 from hemagglutinin__InfluenzaA__AHL96784

SEQ ID NO: 194511 - RNA, 1701 nt, Artificial Sequence
  derived and/or modified sequence opt5 from hemagglutinin__InfluenzaA__AHL96796
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucauugagcggucuaaagccuauagcaacuguuacccuuaugacguccccgauuacgcuucccuccgcucucugguggccagcuccgggacccuugaauuuaauaacgagagcuucaauuggacgggaguuacccaaaacggcacaucuuccgcuugcaucagacggagcaauucuuccuuuuucagccgccugaacuggcucacccaucugaauuuuaaguauccugcccuuaacgugacaaugcccaacaaugagcaguucgacaagcuguacauuuggggcguccaccauccugggaccgauaaagaccagaucuuucucuaugcgcagucuuccggaagaauuacggugagcacaaagcggucccaacaggccguuaucccgaacaucggcucucgcccccggauuagaaauaucccuagccgcauuuccaucuacuggaccauugugaaacccggggauauccugcugaucaacagcacaggaaaucucauugcuccuagaggcuacuucaagauccggucugggaaauccagcauuaugcgcucugacgcccccaucggaaaguguaagagcgaaugcauuaccccgaacggcuccaucccuaaugacaaacccuuucagaacgucaauagaaucaccuauggcgcuuguccucgguacgugaagcagucuacacugaaacuugccacggggaugcgcaacgugcccgagaagcaaaccagaggaauuuucggcgcgaucgccggguuuauugaaaauggaugggagggcauggucgaugggugguauggauuccggcaccagaacagcgagggcagaggccaggcugccgaccugaaauccacacaagcugccaucgaucagauuaaugggaagcucaaccgccugaucggaaaaaccaaugaaaaguuccaccagauugagaaggaauuuagcgagguugaaggccggauccaggaccuugagaaauacguggaggauacaaagaucgaccuguggucuuauaacgccgaacuccugguggcucuggagaaccaacauaccauugaucucacggacuccgaaaugaauaaacuguucgagaagaccaaaaagcagcuuagagaaaacgcggaggauauggggaauggaugcuuuaagaucuaccacaaaugugacaacgccugcauuggcagcauccgcaaugggacauaugaucaugacgucuaccgggacgaggcucugaacaauagauuccagauuaagggcguggaacucaaaucuggauacaaggauuggauccuguggaucuccuuugccauuagcugcuuccuucuguguguugcccuccugggcuuuaucaugugggcuugccagaaagggaacauucgcuguaauaucugcauuuga

SEQ ID NO: 194512 - RNA, 1701 nt, Artificial Sequence; identical to SEQ ID NO: 192882
  derived and/or modified sequence opt5 from hemagglutinin__InfluenzaA__AHL96808

SEQ ID NO: 194513 - RNA, 1701 nt, Artificial Sequence; identical to SEQ ID NO: 192882
  derived and/or modified sequence opt5 from hemagglutinin__InfluenzaA__AHL96820

SEQ ID NO: 194514 - RNA, 1701 nt, Artificial Sequence; identical to SEQ ID NO: 192892
  derived and/or modified sequence opt5 from hemagglutinin__InfluenzaA__AHL96832

SEQ ID NO: 194515 - RNA, 1701 nt, Artificial Sequence; identical to SEQ ID NO: 192892
  derived and/or modified sequence opt5 from hemagglutinin__InfluenzaA__AHL96844

SEQ ID NO: 194516 - RNA, 1701 nt, Artificial Sequence; identical to SEQ ID NO: 192892
  derived and/or modified sequence opt5 from hemagglutinin__InfluenzaA__AHL96856

SEQ ID NO: 194517 - RNA, 1701 nt, Artificial Sequence
  derived and/or modified sequence opt5 from hemagglutinin__InfluenzaA__AHL96868
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugaugggggaaacuguacacugaucgacgcccuccugggcgauccccagugcgacggguuucagaauaaaaagugggaucuguucgucgaacggucuaaagccuauagcaacuguuacccuuaugacgugcccgauuacgcuucccuccgcucucugguugccagcuccggaacccuugaguuuaauaacgagagcuucaauuggacgggcgugacccaaaacggcacaucuuccgcuugcauuagacggagcaauucuuccuuuuucagccgccugaacuggcucacccaucugaauuuuaaguauccugcccuuaacgucacaaugcccaacaaugaacaguucgacaagcuguacaucuggggagugcaccauccugggaccgauaaagaccagauuuuucucuaugcgcagucuuccggcagaaucacgguuagcacaaagcggucccaacaggccguggucccgaacauugggucucgccccagaauccggaauaucccuagccgcauuuccaucuacuggaccauugugaaacccggagauauccugcugauuaacagcacaggcaaucucaucgcuccuagaggguacuucaagauccggucuggaaaauccagcauuaugcgcucugacgcccccaucggcaaguguaagagcgagugcauuaccccgaacggcuccaucccuaaugacaaacccuuucagaacgugaauagaauuaccuauggggcuuguccucgguacgucaagcagucuacacugaaacuugccacgggaaugcgcaacguucccgaaaagcaaaccagaggcaucuucggggcgaucgccggauuuauugagaauggcugggaagggaugauggauggaugguauggcuuccggcaccagaacagcgagggcagagggcaggcugccgaccugaaauccacacaagcugccaucgaucagauuaauggaaagcucaaccgccugaucggcaaaaccaaugagaaguuccaccagauugaaaaggaguuuagcgaaguggaggggcggauccaggaccuugaaaaauacguggaggauacaaagauugaccuguggucuuauaacgccgagcuccuggucgcucuggaaaaccaacauaccaucgaucucacggacuccgagaugaauaaacuguucgaaaagaccaaaaagcagcuuagagagaacgcggaagauaugggaaauggcugcuuuaagaucuaccacaaaugugacaacgccugcauugggagcauccgcaauggcacauaugaucaugacguguaccgggacgaggcucugaacaauagauuccagauuaagggaguugagcucaaaucuggcuacaaggauuggauccuguggauuuccuuugccaugagcugcuuccuucuguguguggcccuccugggguuuaucaugugggcuugccagaaaggaaacauccgcuguaauauuugcaucuga

SEQ ID NO: 194518 - RNA, 1701 nt, Artificial Sequence; identical to SEQ ID NO: 192882
  derived and/or modified sequence opt5 from hemagglutinin__InfluenzaA__AHL96880

SEQ ID NO: 194519 - RNA, 1701 nt, Artificial Sequence
  derived and/or modified sequence opt5 from hemagglutinin__InfluenzaA__AHL96892
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugguugauggaugguauggcuucagacaccagaacagcgagggccgggggcaggccgcugaccugaaauccacccaagccgccauugaucagaucaauggaaagcucaacagacugauuggcaaaacaaaugaaaaguuccaccagaucgagaaggaauuuagcgagguggaagggcgcgugcaggaccuugagaaauacgucgaggauaccaagauugaccuguggucuuauaacgcugaacuccugguggcgcuggagaaccaacauacaaucgaucucaccgacuccgaaaugaauaaacuguucgagaagacgaaaaagcagcuucgggaaaacgccgaggauaugggaaauggcugcuuuaagaucuaccacaaaugugacaacgcuugcauugggagcaucagaaauggcacauaugaucaugacguuuaccgcgacgaggcccugaacaaucgguuccagauuaagggaguggaacucaaaucuggcuacaaggauuggauccuguggauuuccuuugccaucagcugcuuccuucugugugucgcucuccugggguuuaucaugugggccugccagaaaggaaacauuagauguaauaucugcauuuga

SEQ ID NO: 194520 - RNA, 1701 nt, Artificial Sequence
  derived and/or modified sequence opt5 from hemagglutinin__InfluenzaA__AHL96904
augaagaccaucauugcccugagcuacauccucugccugguguucgcucagaaacuucccggcaacgacaauuccacagccacgcugugucucgggcaccaugcggucccuaacggaaugauuguuaagaccaucacaaaugauagaauugaggugaccaacgcuacagaacuggugcaaaauucuagcaucggcgagaucugcgacuccccgcaccagauucuugauggggaaaacuguacccugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacacuugaauuuaauaacgagagcuucaauuggaccggagugacgcaaaacggcaccucuuccgcuugcauuagacggagcaauucuuccuuuuucagccgccugaacuggcucacacaucugaauuuuaaguauccugcccuuaacgucaccaugcccaacaaugagcaguucgacaagcuguacaucuggggcgugcaccauccugggacagauaaagaccagauuuuucucuaugcgcagucuuccggaagaaucaccguuagcacgaagcggucccaacaggccguggucccgaacauuggcucucgccccagaauccggaauaucccuagccgcauuuccaucuacuggacaauugugaaacccggggauauccugcugauuaacagcaccggaaaucucaucgcuccuagaggcuacuucaagauccggucugggaaauccagcauuaugcgcucugacgcccccaucggaaaguguaagagcgaaugcauuacaccgaacggcuccaucccuaaugacaaacccuuucagaacgugaauagaauuaccuauggcgcuuguccucgguacgucaagcagucuacccugaaacuugccacagggaugcgcaacguucccgagaagcaaacgagaggaaucuucggcgcgaucgccggguuuauugaaaauggaugggagggcaugguggaugggugguauggauuccggcaccagaacagcgagggcagaggccaggcugccgaccugaaauccacccaagcugccaucgaucagauuaaugggaagcucaaccgccugaucggaaaaacaaaugaaaaguuccaccagauugagaaggaauuuagcgagguggaaggccggauccaggaccuugagaaauacgucgaggauaccaagauugaccuguggucuuauaacgccgaacuccugguggcucuggagaaccaacauacaaucgaucucaccgacuccgaaaugaauaaacuguucgagaagacgaaaaagcagcuuagagaaaacgcggaggauauggggaauggaugcuuuaagaucuaccacaaaugugacaacgccugcauuggcagcauccgcaaugggacauaugaucaugacguuuaccgggacgaggcucugaacaauagauuccagauuaagggcguggaacucaaaucuggauacaaggauuggauccuguggauuuccuuugccaugagcugcuuccuucugugugucgcccuccugggcuccaucaugugggcuugccagaaagggaacauccgcuguaauauuugcaucuga

SEQ ID NO: 194521 - RNA, 1701 nt, Artificial Sequence; identical to SEQ ID NO: 192882
  derived and/or modified sequence opt5 from hemagglutinin__InfluenzaA__AHL96916

SEQ ID NO: 194522 - RNA, 1701 nt, Artificial Sequence; identical to SEQ ID NO: 192882
  derived and/or modified sequence opt5 from hemagglutinin__InfluenzaA__AHL96928

SEQ ID NO: 194523 - RNA, 1701 nt, Artificial Sequence; identical to SEQ ID NO: 192882
  derived and/or modified sequence opt5 from hemagglutinin__InfluenzaA__AHL96940

SEQ ID NO: 194524 - RNA, 1701 nt, Artificial Sequence; identical to SEQ ID NO: 192892
  derived and/or modified sequence opt5 from hemagglutinin__InfluenzaA__AHL96952

SEQ ID NO: 194525 - RNA, 1701 nt, Artificial Sequence; identical to SEQ ID NO: 192892
  derived and/or modified sequence opt5 from hemagglutinin__InfluenzaA__AHL96964

SEQ ID NO: 194526 - RNA, 1701 nt, Artificial Sequence; identical to SEQ ID NO: 193050
  derived and/or modified sequence opt5 from hemagglutinin__InfluenzaA__AHL96976

SEQ ID NO: 194527 - RNA, 1701 nt, Artificial Sequence
  derived and/or modified sequence opt5 from hemagglutinin__InfluenzaA__AHL96988
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucagacccggggauauucugcugaucaacagcacaggaaaucucaucgcuccucggggcuacuucaaaauucgcucugggaaguccagcaucaugagaucugacgcccccauuggaaaauguaagagcgaaugcaucaccccgaacggcuccauuccuaaugacaagcccuuucagaacgugaaucggaucaccuauggcgcuuguccucgcuacgugaaacagucuacacugaaacuugccacggggaugagaaacguccccgagaagcaaacccggggaaucuucggcgcgauugccggguuuaucgaaaauggaugggagggcaugguugaugggugguauggauucagacaccagaacagcgagggccgcggccaggcugccgaccugaaguccacacaagcugccauugaucagaucaaugggaaacucaaccggcugauuggaaagaccaaugaaaaauuccaccagaucgagaaggaauuuagcgagguggaaggccgcauucaggaccuugagaaguacguggaggauacaaaaaucgaccuguggucuuauaacgccgaacuccuggucgcucuggagaaccaacauaccaucgaucucacggacuccgaaaugaauaagcuguucgagaaaacaaagaaacagcuuagagaaaacgcggaggauauggggaauggaugcuuuaagauuuaccacaagugugacaacgccugcaucggcagcauucggaaugggaccuaugaucauaacguguacagagacgaggcucugaauaaccgcuuccagaucaaaggcguugaacucaagucuggauacaaagacuggauucuguggaucuccuuugccaucagcugcuuccuucuguguguggcccuccugggcuuuauuaugugggcuugccagaaggggaauauccgguguaacauuugcaucuga

SEQ ID NO: 194528 - RNA, 1701 nt, Artificial Sequence; identical to SEQ ID NO: 192892
  derived and/or modified sequence opt5 from hemagglutinin__InfluenzaA__AHL97000

SEQ ID NO: 194529 - RNA, 1701 nt, Artificial Sequence; identical to SEQ ID NO: 193018
  derived and/or modified sequence opt5 from hemagglutinin__InfluenzaA__AHL97012

SEQ ID NO: 194530 - RNA, 1701 nt, Artificial Sequence
  derived and/or modified sequence opt5 from hemagglutinin__InfluenzaA__AHL97024
augaagaccaucauugcccugagcuacauccucugccugguguucgcucagaaacuucccggcaacgacaauuccacagccacgcugugucucgggcaccaugcggucccuaacggaaccauuguuaagacaaucaugaaugauagaauugaggugaccaacgcuacagaacuggugcaaaauucuagcaucggcgagaucugcgacuccccgcaccagauucuugauggggaaaacuguacccugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacacuugaauuuaauaacgagagcuucaauugggcuggagugacccaaaacggcacgucuuccgccugcauuagaggcagcaauucuuccuuuuucagccggcugaacuggcucacccaucugaauuuuaaguauccugcgcuuaacgucacaaugcccaacaaugagcaguucgacaagcuguacaucuggggagugcaccauccugggaccgauaaagaccagauuuuucucuaugcccagucuuccggccgcaucacaguuagcaccaagagaucccaacaggcugugauuccgaacaucgggucucggccccgcaucagaaauauuccuagccggaucuccauuuacuggacgaucgucaaacccggagauauucugcugaucaacagcacaggcaaucucaucgccccucgcggguacuucaagauuagaucuggaaaauccagcaucaugcggucugacgcucccauuggcaaguguaagagcgaaugcaucaccccgaacggcuccauuccuaaugacaaacccuuucagaacgugaaucgcaucacauauggggccuguccuagauacgugaagcagucuacccugaaacuugcgaccggaaugcggaacguccccgagaagcaaacacgcggcaucuucggggccauugcuggauuuaucgaaaauggcugggaggggaugauggauggaugguauggcuucagacaccagaacagcgagggccgggggcaggccgcugaccugaaauccacgcaagccgccauugaucagaucaauggaaagcucaacagacugauuggcaaaaccaaugaaaaguuccaccagaucgagaaggaauuuagcgagguugaagggcgcauucaggaccuugagaaauacguggaggauacaaagaucgaccuguggucuuauaacgcugaacuccugguggcgcuggagaaccaacauaccaucgaucucacagacuccgaaaugaauaaacuguucgagaagaccaaaaagcagcuucgggaaaacgccgaggauaugggaaauggcugcuuuaagauuuaccacaaaugugacaacgcuugcaucgggagcauuagaaauggcacguaugaucaugacgucuaccgcgacgaggcccugaacaaucgguuccagaucaagggaguggaacucaaaucuggcuacaaggauuggauucuguggaucuccuuugccaucagcugcuuccuucuguguguugcucuccugggguuuauuaugugggccugccagaaaggaaacaucagauguaauauuugcaucuga

SEQ ID NO: 194531 - RNA, 1701 nt, Artificial Sequence
  derived and/or modified sequence opt5 from hemagglutinin__InfluenzaA__AHL97036
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagucuacacugaaacuugccacggggaugcgcaacguccccgagaagcaaaccagaggaaucuucggcgcgauugccggguuuaucgaaaauggaugggagggcaugguugaugggugguauggauuccggcaccagaacagcgagggcagaggccaggcugccgaccugaaauccacacaagcugccauugaucagaucaaugggaagcucaaccgccugauuggaaaaaccaaugaaaaguuccaccagaucgagaaggaauuuagcgagguggaaggccggauucaggaccuugagaaauacguggaggauacaaagaucgaccuguggucuuauaacgccgaacuccuggucgcucuggagaaccaacauaccaucgaucucacggacuccgaaaugaauaaacuguucgagaagaccaaaaagcagcuuagagaaaacgcggaggauauggggaauggaugcuuuaagauuuaccacaaaugugacaacacaugcaucggcagcauucgcaaugggaccuaugaucaugacguguaccgggacgaggcccugaacaauagauuccagaucaagggcguugaacucaaaucuggauacaaggauuggauucuguggaucuccuuugcuaucagcugcuuccuucuguguguggcccuccugggcuuuauuaugugggccugccagaaagggaacauccgcuguaauauuugcaucuga

SEQ ID NO: 194532 - RNA, 1701 nt, Artificial Sequence; identical to SEQ ID NO: 192907
  derived and/or modified sequence opt5 from hemagglutinin__InfluenzaA__AHL97048

SEQ ID NO: 194533 - RNA, 1701 nt, Artificial Sequence
  derived and/or modified sequence opt5 from hemagglutinin__InfluenzaA__AHL97060
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcaauucuuccuuuuucagccgccuuaacuggcugacccaucucaauuuuaaguauccugcccugaacgucacaaugcccaacaaugagcaguucgacaaacuuuacauuuggggcgugcaccauccugggaccgauaaagaccagaucuuucuguaugcgcagucuuccggaagaauuacgguuagcacaaagcggucccaacaggccgugaucccgaacaucggcucucgcccccggauuagaaauaucccuagccgcauuuccaucuacuggaccauugucaaacccggggauauccuccugaucaacagcacaggaaaucugauugcuccuagaggcuacuucaagauccggucugggaaauccagcauuaugcgcucugacgcccccaucggaaaguguaagagcgaaugcauuaccccgaacggcuccaucccuaaugacaaacccuuucagaacgugaauagaaucaccuauggcgcuuguccucgguacgugaagcagucuacacucaaacuggccacggggaugcgcaacguccccgagaagcaaaccagaggaauuuucggcgcgaucgccggguuuauugaaaauggaugggagggcaugguugaugggugguauggauuccggcaccagaacagcgagggcagaggccaggcugccgaccuuaaauccacacaagcugccaucgaucagauuaaugggaagcugaaccgccucaucggaaaaaccaaugaaaaguuccaccagauugagaaggaauuuagcgagguggaaggccggauccaggaccuggagaaauacguggaggauacaaagaucgaccuuuggucuuauaacgccgaacugcucgucgcucuggagaaccaacauaccauugaucugacggacuccgaaaugaauaaacucuucgagaagacaaagaagcagcugagagaaaacgcggaggauauggggaauggaugcuuuaagaucuaccacaaaugugacaacgccugcauuggcagcauccgcaaugggaccuaugagcaugauguguaccgggacgaagcucuuaacaauagauuccagauuaagggcguugagcugaaaucuggauacaaggacuggauccucuggaucuccuuugccauuagcugcuuccugcuuuguguggcccugcucggcuuuaucaugugggcuugccagaaagggaacauucgcuguaauaucugcauuuga

SEQ ID NO: 194534 - RNA, 1701 nt, Artificial Sequence; identical to SEQ ID NO: 193018
  derived and/or modified sequence opt5 from hemagglutinin__InfluenzaA__AHL97072

SEQ ID NO: 194535 - RNA, 1701 nt, Artificial Sequence; identical to SEQ ID NO: 193018
  derived and/or modified sequence opt5 from hemagglutinin__InfluenzaA__AHL97084

SEQ ID NO: 194536 - RNA, 1701 nt, Artificial Sequence; identical to SEQ ID NO: 192859
  derived and/or modified sequence opt5 from hemagglutinin__InfluenzaA__AHL97096

SEQ ID NO: 194537 - RNA, 1701 nt, Artificial Sequence; identical to SEQ ID NO: 193021
  derived and/or modified sequence opt5 from hemagglutinin__InfluenzaA__AHL97108

SEQ ID NO: 194538 - RNA, 1701 nt, Artificial Sequence
  derived and/or modified sequence opt5 from hemagglutinin__InfluenzaA__AHL97120
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcgugaccuauggggccuguccuagauacgucaagcagucuacccugaaacuugcgacaggaaugcggaacguucccgagaagcaaacgcgcggcaucuucggggccaucgcuggauuuauugaaaauggcugggaggggaugguggauggaugguauggcuucagacaccagaacagcgagggccgggggcaggccgcugaccugaaauccacccaagccgccaucgaucagauuaauggaaagcucaacagacugaucggcaaaacaaaugaaaaguuccaccagauugagaaggaauuuagcgagguggaagggcgcauccaggaccuugagaaauacgucgaggauaccaagauugaccuguggucuuauaacgcugaacuccugguggcgcuggagaaccaacauacaaucgaucucaccgacuccgaaaugaauaaacuguucgagaagacgaaaaagcagcuucgggaaaacgccgaggauaugggaaauggcugcuuuaagaucuaccacaaaugugacaacgcuugcauugggagcaucauuaauggcacauaugaucaugacguuuacagagacgaggcccugaacaaucgcuuccagaucaagggaguggaacucaaaucuggcuacaaggauuggauucuguggaucuccuuugccaucagcugcuuccuucugugugucgcucuccugggguuuauuaugugggccugccagaaaggaaacauccgguguaauauuugcaucuga

SEQ ID NO: 194539 - RNA, 1701 nt, Artificial Sequence
  derived and/or modified sequence opt5 from hemagglutinin__InfluenzaA__AHL97132
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacccuugaauuuaauaacgagagcuucaauugggcuggagugacgcagaacggcaccucuuccgccugcauucgcggcagcaauucuuccuuuuucagcagacugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccaaucuuccggccggaucaccguuagcacgaagcgcucccagcaggcugugauuccgaacaucgggucuagaccccggauccgcaauauuccuagcagaaucuccauuuacuggacaaucgucaaacccggagauauucugcugaucaacagcaccggcaaucucaucgccccucggggguacuucaagauucgcucuggaaaauccagcaucaugagaucugacgcucccauuggcaaguguaagagcgaaugcaucacaccgaacggcuccauuccuaaugacaaacccuuucagaacgugaaucggaucaccuauggggccuguccucgcuacgugaagcaaucuacccugaaacuugcgacaggaaugagaaacguccccggcaagcagacgcgggggaucuucggagccauugcuggcuuuaucgagaaugggugggaaggaaugguugauggcugguauggcuuccgccaccagaacagcgaggggagaggacaagccgcugaccugaaauccacccaggccgccauugaucagaucaauggcaagcucaaccggcugauugggaaaacaaaugagaaguuccaccagaucgaaaaggaguuuagcgaaguggagggacgcauucaagaccuugaaaaauacguggaggauaccaagaucgaccuguggucuuauaacgcugagcuccuggucgcgcuggaaaaccagcauacaaucgaucucaccgacuccgagaugaauaaacuguucgaaaagacgaaaaagcagcuuagagagaacgccgaagauaugggcaaugggugcuuuaagauuuaccacaaaugugacaacgcuugcaucggcagcauucggaauggaacauaugaucaugacguguacagagacgaggcccugaacaaucgcuuccagaucaagggcguugagcucaaaucuggguacaaggauuggauucuguggaucuccuuugccaucagcugcuuccuucuguguguggcucuccugggauuuauuaugugggccugccaaaaaggcaacauccgguguaauauuugcaucuga

SEQ ID NO: 194540 - RNA, 1701 nt, Artificial Sequence; identical to SEQ ID NO: 193018
  derived and/or modified sequence opt5 from hemagglutinin__InfluenzaA__AHL97144

SEQ ID NO: 194541 - RNA, 1701 nt, Artificial Sequence; identical to SEQ ID NO: 193018
  derived and/or modified sequence opt5 from hemagglutinin__InfluenzaA__AHL97156

SEQ ID NO: 194542 - RNA, 1701 nt, Artificial Sequence; identical to SEQ ID NO: 193018
  derived and/or modified sequence opt5 from hemagglutinin__InfluenzaA__AHL97168

SEQ ID NO: 194543 - RNA, 1701 nt, Artificial Sequence; identical to SEQ ID NO: 192892
  derived and/or modified sequence opt5 from hemagglutinin__InfluenzaA__AHL97180

SEQ ID NO: 194544 - RNA, 1701 nt, Artificial Sequence; identical to SEQ ID NO: 193018
  derived and/or modified sequence opt5 from hemagglutinin__InfluenzaA__AHL97192

SEQ ID NO: 194545 - RNA, 1701 nt, Artificial Sequence; identical to SEQ ID NO: 193018
  derived and/or modified sequence opt5 from hemagglutinin__InfluenzaA__AHL97204

SEQ ID NO: 194546 - RNA, 1701 nt, Artificial Sequence; identical to SEQ ID NO: 193018
  derived and/or modified sequence opt5 from hemagglutinin__InfluenzaA__AHL97216

SEQ ID NO: 194547 - RNA, 1701 nt, Artificial Sequence
  derived and/or modified sequence opt5 from hemagglutinin__InfluenzaA__AHL97228
augaagaccaucauugcccugagcuacauccucugccugguguucgcucagaaacuucccggcaacgacaauuccacagccacgcugugucucgggcaccaugcggucccuaacggaaccguugugaagacaauuaccaaugauagaaucgaggugacaaacgcuaccgaacugguccaaaauucuagcauuggcgagaucugcgacuccccgcaccagauccuugauggggaaaacuguacacugauugacgcccuccugggagauccccagugcgacggcuuucagaauaaaaagugggaucuguucguggagcggucuaaagccuauagcaacuguuacccuuaugacguucccgauuacgcuucccuccgcucucugguggccagcuccgggacccuugaauuuaauaacgagagcuucaauuggacgggagucacccaaaacggcacaucuuccgcuugcaucagacggagcaauaacuccuuuuucucucgccugaauuggcucacccaucugaacuuuaaguauccugcccuuaacgugacaaugcccaauaacgagcaguucgacaagcuguacauuuggggcguucaccauccugggaccgauaaagaccagaucuuucucuaugcgcagagcucuggaagaauuacgguguccacaaagcggagccaacaggccgucaucccgaauauuggcucccgccccagaauccggaacaucccuucucgcauuagcaucuacuggaccauugugaaacccggggauauccugcugauuaauuccacaggaaaccucaucgcuccuagaggcuacuucaagauccggagcgggaaaucuuccauuaugcgcagcgacgcccccaucggaaaguguaagucugaaugcauuaccccgaauggcagcaucccuaacgacaaacccuuucagaaugugaacagaauuaccuauggcgcuuguccucgguacgucaagcaguccacacugaaacuugccacggggaugcgcaauguucccgagaagcaaaccagaggaaucuucggcgcgaucgccggguuuauugaaaacggaugggagggcaugguggaugggugguauggauuccggcaccaaaauucugagggcagaggccaggcugccgaccugaaaagcacacaggcugccaucgaucagauuaacgggaagcucaaucgccugaucggaaaaaccaacgaaaaguuccaccagauugagaaggaauuuuccgagguggaaggccggauccaggaccuugagaaauacgucgaggauacaaagauugaccuguggagcuauaacgccgaacuccugguggcucuggagaaucaacauaccaucgaucucacggacucugaaaugaacaaacuguucgagaagaccaaaaagcagcuuagagaaaaugcggaggauauggggaacggaugcuuuaagaucuaccacaaaugugacaaugccugcauuggcuccauccgcaacgggacauaugaucaugacguuuaccgggacgaggcucugaauaacagauuccagauuaagggcguggaacucaaaagcggauacaaggauuggauccuguggauuucuuuugccaucuccugcuuccuucugugugucgugcuccugggcuuuaucaugugggccugccagaaagggaauauucgcuguaacaucugcauuuga

SEQ ID NO: 194548 - RNA, 1701 nt, Artificial Sequence; identical to SEQ ID NO: 193018
  derived and/or modified sequence opt5 from hemagglutinin__InfluenzaA__AHL97240

SEQ ID NO: 194549 - RNA, 1701 nt, Artificial Sequence
  derived and/or modified sequence opt5 from hemagglutinin__InfluenzaA__AHL97252
augaagaccaucauugcccugagcuacauccucugccugguguucgcucaggagcuucccggcaacgacgauuccacagccacgcugugucucgggcaccaugcggucccuaauggaaccauuguuaaaacaaucaccaacgaccaaauugaagugacaaaugcuaccgagcuggugcagucuagcuccacaggcgaaaucugcaacucuccgcaccagauccuugauggggagaauuguacccugauugacgcccuccugggagauccccagugcgacggcuuucaaaacaagaaaugggaucuguucgucgaaagaagcaaggcccauuccaauuguuauccuuacgacgugcccgauuaugcuucucuccggagccugguugccuccagcgggacgcuugaguuuaacaaugagaacuucaauuggaccggagugacacagaacggcaccucuuccgcuugcauccgcagaagcaauaacagcuuuuucucccggcugaauuggcucacacaccugaacuuuaaauacccugcccuuaacgucaccaugcccaauaacgaacaguucgacaagcuguauauuuggggcgugcaucacccugggacggauaaggaccagaucuuucucuacgcgcaagccagcggacgcauuacaguuucuaccaaaagaucccagcaggcugugaucccgaauauuggcagccggccccgcgucagaaacaucccuucccgggugucuaucuauuggacaauugugaagcccggggauauccugcugauuaauagcaccggaaaccucaucgccccucgcggcuacuucaaaauuagauccgggaagucuucuaucaugcgguccgacgcucccaucggaaaauguaauagcgccugcauuaccccgaacggcucuaucccuaaugacaagcccuuucagaacgucaaucgcauuacauacggcgcguguccuagauauguuaagcaaaacacgcugaaacuugccaccgggaugcggaaugugcccgagaagcagacacgcggaaucuucggcgcuauugccggguuuaucgaaaacggaugggagggcaugguggaugggugguacggauucagacaccagaauagcgagggccggggccaagcugccgaccugaaauccacccaggccgcuaucgaucagauuaacgggaagcucaacagacugaucggaaaaacaaaugaaaaguuccaucagauugagaaagaauuuucugaggucgaaggccgcauccaagaccuugagaaguauguggaggauaccaagauugaccuguggagcuacaacgcggaacuccugguugcccuggagaaucagcacacgaucgaucucacagacuccgaaaugaacaaacuguucgagaagaccaaaaagcagcuucgggaaaaugcugaggauauggggaacggaugcuuuaaaauuuaucauaagugugacaaugccugcaucggcagcaucagaaacgggaccuacgaucacgacguguaucgcgacgaggcccugaauaaccgguuccagauuaagggcgucgaacucaaaucuggauacaaggauuggauccuguggauuuccuuugcuaucagcugcuuccuucuguguguggcccuccugggcuuuauuaugugggcgugccaaaaagggaauaucagauguaacaucugcauuuga

SEQ ID NO: 194550 - RNA, 1701 nt, Artificial Sequence; identical to SEQ ID NO: 192882
  derived and/or modified sequence opt5 from hemagglutinin__InfluenzaA__AHL97264

SEQ ID NO: 194551 - RNA, 1701 nt, Artificial Sequence; identical to SEQ ID NO: 193018
  derived and/or modified sequence opt5 from hemagglutinin__InfluenzaA__AHL97276

SEQ ID NO: 194552 - RNA, 1701 nt, Artificial Sequence
  derived and/or modified sequence opt5 from hemagglutinin__InfluenzaA__AHL97288
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcaacuccccgcaccagauucuugacggggaaaauuguacacugaucgaugcccuccugggagacccccagugcgauggcuuucagaacaaaaagugggaccuguucgucgagcggucuaaagccuauagcaauuguuacccuuaugaugugcccgacuacgcuucccuccgcucucugguugccagcuccgggacccuugaauuuaacaaugagagcuucaacuggacgggagugacccaaaauggcacaucuuccgcuugcauuagacggagcaacucuuccuuuuucagccgccugaauuggcucacccaucugaacuuuaaguauccugcccuuaacgucacaaugcccaauaacgagcaguucgauaagcuguacaucuggggcgugcaccauccugggaccgacaaagaucagauuuuucucuaugcgcagucuuccggaagaaucacgguuagcacaaagcggucccaacaggccgugauuccgaauaucggcucucgccccagaauccggaacauuccuagccgcaucuccauuuacuggaccaucgucaaacccggggacauucugcugaucaauagcacaggaaaccucaucgcuccuagaggcuacuucaagauucggucugggaaauccagcaucaugcgcucugaugcccccauuggaaaguguaagagcgaaugcaucaccccgaauggcuccauuccuaacgacaaacccuuucagaaugugaacagaaucaccuauggcgcuuguccucgguacgugaagcagucuacacugaaacuugccacggggaugcgcaauguccccgagaagcaaaccagaggaaucuucggcgcgauugccggguuuaucgaaaacggaugggagggcaugguugacgggugguauggauuccggcaccagaauagcgagggcagaggccaggcugccgaucugaaauccacacaagcugccauugaccagaucaacgggaagcucaaucgccugauuggaaaaaccaacgaaaaguuccaccagaucgagaaggaauuuagcgagguggaaggccggauucaggaucuugagaaauacguggaggacacaaagaucgaucuguggucuuauaacgccgaacuccuggucgcucuggagaaucaacauaccaucgaccucacggauuccgaaaugaacaaacuguucgagaagauuaaaaagcagcuuagagaaaaugcggaggacauggggaacggaugcuuuaagaucuaccacaaaugugauaaugccugcauuggcagcauccgcaacgggacauaugaccauaauguguaccgggaugaggcucugaacaauagauuccagauuaagggcguugaacucaaaucuggauacaaggacuggauccuguggaucuccuuugccauuagcugcuuccuucuguguguggcccuccugggcuuuaucaugugggcuugccagaaagggaacauucgcuguaauaucugcauuuga

SEQ ID NO: 194553 - RNA, 1701 nt, Artificial Sequence; identical to SEQ ID NO: 192892
  derived and/or modified sequence opt5 from hemagglutinin__InfluenzaA__AHL97300

SEQ ID NO: 194554 - RNA, 1701 nt, Artificial Sequence; identical to SEQ ID NO: 193018
  derived and/or modified sequence opt5 from hemagglutinin__InfluenzaA__AHL97312

SEQ ID NO: 194555 - RNA, 1701 nt, Artificial Sequence; identical to SEQ ID NO: 193018
  derived and/or modified sequence opt5 from hemagglutinin__InfluenzaA__AHL97336

SEQ ID NO: 194556 - RNA, 1701 nt, Artificial Sequence; identical to SEQ ID NO: 193018
  derived and/or modified sequence opt5 from hemagglutinin__InfluenzaA__AHL97348

SEQ ID NO: 194557 - RNA, 1701 nt, Artificial Sequence
  derived and/or modified sequence opt5 from hemagglutinin__InfluenzaA__AHL97372
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaacgccuauagcaauuguuacccuuaugacgugcccgauuacgcuucccuccgcucucugguugccagcuccgggacccuugaauuuaacaaugagagcuucaacugggcuggagugacgcaaaauggcaccucuuccgccugcauuagaggcagcaacucuuccuuuuucagccggcugaauuggcucacacaucugaacuuuaaauauccugcgcuuaacgucaccaugcccaauaacgagcaguucgacaagcuguacaucuggggagugcaccauccugggacagauaaggaccagauuuuucucuaugcccagucuuccggccgcaucaccguuagcacgaaaagaucccaacaggcugugauuccgaauaucgggucucggccccgcaucagaaacauuccuagccggaucuccauuuacuggacaaucgucaagcccggagauauucugcugaucaauagcaccggcaaccucaucgccccucgcggguacuucaaaauuagaucuggaaaguccagcaucaugcggucugacgcucccauuggcaaauguaagagcgaaugcaucacaccgaauggcuccauuccuaacgacaagcccuuucagaaugugaaccgcaucaccuauggggccuguccuagauacgugaaacagucuacccugaaacuugcgacaggaaugcggaauguccccgagaagcaaacgcgcggcaucuucggggccauugcuggauuuaucgaaaacggcugggaggggaugguugauggaugguauggcuucagacaccagaauagcgagggccgggggcaggccgcugaccugaaguccacccaagccgccauugaucagaucaacggaaaacucaauagacugauuggcaagacaaacgaaaaauuccaccagaucgagaaggaauuuagcgagguggaagggcgcauucaggaccuugagaaguacguggaggauaccaaaaucgaccuguggucuuauaacgcugaacuccuggucgcgcuggagaaucaacauacaaucgaucucaccgacuccgaaaugaacaagcuguucgagaaaacgaagaaacagcuucgggaaaaugccgaggauaugggaaacggcugcuuuaagauuuaccacaagugugacaaugcuugcaucgggagcauuagaaacggcacauaugaucaugacguguaccgcgacgaggcccugaauaaccgguuccagaucaaaggaguugaacucaagucuggcuacaaagauuggauucuguggaucuccuuugccaucagcugcuuccuucuguguguggcucuccugggguuuauuaugugggccugccagaagggaaauaucagauguaacauuugcaucuga

SEQ ID NO: 194558 - RNA, 1701 nt, Artificial Sequence; identical to SEQ ID NO: 193018
  derived and/or modified sequence opt5 from hemagglutinin__InfluenzaA__AHL97384

SEQ ID NO: 194559 - RNA, 1701 nt, Artificial Sequence; identical to SEQ ID NO: 192882
  derived and/or modified sequence opt5 from hemagglutinin__InfluenzaA__AHL97396

SEQ ID NO: 194560 - RNA, 1701 nt, Artificial Sequence; identical to SEQ ID NO: 192859
  derived and/or modified sequence opt5 from hemagglutinin__InfluenzaA__AHL97408

SEQ ID NO: 194561 - RNA, 1701 nt, Artificial Sequence; identical to SEQ ID NO: 194530
  derived and/or modified sequence opt5 from hemagglutinin__InfluenzaA__AHL97420

SEQ ID NO: 194562 - RNA, 1701 nt, Artificial Sequence
  derived and/or modified sequence opt5 from hemagglutinin__InfluenzaA__AHL97444
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuaugggaccuguccuagauacgugaagcagucuacacugaaacuugccacgggaaugcggaacguccccgagaagcaaacccgcggcaucuucggggcgauugccggauuuaucgaaaauggcugggaggggaugguugauggaugguauggcuucagacaccagaacagcgagggccgggggcaggcugccgaccugaaauccacacaagcugccauugaucagaucaauggaaagcucaacagacugauuggcaaaaccaaugaaaaguuccaccagaucgagaaggaauuuagcgagguggaagggcgcauucaggaccuugagaaauacguggaggauacaaagaucgaccuguggucuuauaacgccgaacuccuggucgcucuggagaaccaacauaccaucgaucucacggacuccgaaaugaauaaacuguucgagaagaccaaaaagcagcuucgggaaaacgcggaggauaugggaaauggcugcuuuaagauuuaccacaaaugugacaacgccugcaucgggagcauuagaaauggcacauaugaucaugacguguaccgcgacgaggcucugaacaaucgguuccagaucaagggaguugaacucaaaucuggcuacaaggauuggauucuguggaucuccuuugccaucagcugcuuccuucuguguguggcccuccugggguuuauuaugugggcuugccagaaaggaaacaucagauguaauauuugcaucuga

SEQ ID NO: 194563 - RNA, 1701 nt, Artificial Sequence; identical to SEQ ID NO: 192892
  derived and/or modified sequence opt5 from hemagglutinin__InfluenzaA__AHL97456

SEQ ID NO: 194564 - RNA, 1701 nt, Artificial Sequence
  derived and/or modified sequence opt5 from hemagglutinin__InfluenzaA__AHL97468
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagucuacacugaaacuugccacggggaugcgcaacguccccgagaagcaaaccagaggaaucuucggcgcgauugccggguuuaucgaaaauggaugggagggcaugauggaugggugguauggauuccggcaccagaacagcgagggcagaggccaggcugccgaccugaaauccacacaagcugccauugaucagaucaaugggaagcucaaccgccugauuggaaaaaccaaugaaaaguuccaccagaucgagaaggaauuuagcgagguugaaggccggauucaggaccuugagaaauacguggaggauacaaagaucgaccuguggucuuauaacgccgaacuccugguggcucuggagaaccaacauaccaucgaucucacggacuccgaaaugaauaaacuguucgagaagaccaaaaagcagcuuagagaaaacgcggaggauauggggaauggaugcuuuaagauuuaccacaaaugugacaacgccugcaucggcagcauucgcaaugggacauaugaucauaacgucuaccgggacgaggcucugaauaacagauuccagaucaagggcguggaacucaaaucuggauacaaggacuggauucuguggaucuccuuugccaucagcugcuuccuucuguguguugcccuccugggcuuuauuaugugggcuugccagaaagggaauauccgcuguaacauuugcaucuga

SEQ ID NO: 194565 - RNA, 1701 nt, Artificial Sequence; identical to SEQ ID NO: 193018
  derived and/or modified sequence opt5 from hemagglutinin__InfluenzaA__AHL97480

SEQ ID NO: 194566 - RNA, 1701 nt, Artificial Sequence; identical to SEQ ID NO: 193018
  derived and/or modified sequence opt5 from hemagglutinin__InfluenzaA__AHL97493

SEQ ID NO: 194567 - RNA, 1701 nt, Artificial Sequence; identical to SEQ ID NO: 194530
  derived and/or modified sequence opt5 from hemagglutinin__InfluenzaA__AHL97505

SEQ ID NO: 194568 - RNA, 1701 nt, Artificial Sequence
  derived and/or modified sequence opt5 from hemagglutinin__InfluenzaA__AHL97517
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacacaacggucccagcaggccgugauuccgaacaucggcucucgccccagaauccggaauauuccuagccgcaucuccauuuacuggaccaucgucaagcccggggauauucugcugaucaacagcacaggaaaucucaucgcuccuagaggcuacuucaaaauucggucugggaaguccagcaucaugcgcucugacgcccccauuggaaaauguaagagcgaaugcaucaccccgaacggcuccauuccuaaugacaagcccuuucagaacgugaauagaaucaccuauggcgcuuguccucgguacgugaaacaaucuacacugaaacuugccacggggaugcgcaacguccccgagaagcagaccagaggaaucuucggcgcgauugccggguuuaucgaaaauggaugggagggcaugguugaugggugguauggauuccggcaccagaacagcgagggcagaggccaagcugccgaccugaaguccacacaggcugccauugaucagaucaaugggaaacucaaccgccugauuggaaagaccaaugaaaaauuccaccagaucgagaaggaauuuagcgagguggaaggccggauucaagaccuugagaaguacguggaggauacaaaaaucgaccuguggucuuauaacgccgaacuccuggucgcucuggagaaccagcauaccaucgaucucacggacuccgaaaugaauaagcuguucgagaaaacaaagaaacagcuuagagaaaacgcggaggauauggggaauggaugcuuuaagauuuaccacaagugugacaacgccugcaucggcagcauucgcaaugggaccuaugaucauaacguguaccgggacgaggcucugaauaacagauuccagaucaaaggcguugaacucaagucuggauacaaagacuggauucuguggaucuccuuugccaucagcugcuuccuucuguguguggcccuccugggcuuuauuaugugggcuugccaaaaggggaauauccgcuguaacauuugcaucuga

SEQ ID NO: 194569 - RNA, 1701 nt, Artificial Sequence; identical to SEQ ID NO: 192907
  derived and/or modified sequence opt5 from hemagglutinin__InfluenzaA__AHL97529

SEQ ID NO: 194570 - RNA, 1701 nt, Artificial Sequence; identical to SEQ ID NO: 192892
  derived and/or modified sequence opt5 from hemagglutinin__InfluenzaA__AHL97541

SEQ ID NO: 194571 - RNA, 1701 nt, Artificial Sequence; identical to SEQ ID NO: 193018
  derived and/or modified sequence opt5 from hemagglutinin__InfluenzaA__AHL97553

SEQ ID NO: 194572 - RNA, 1701 nt, Artificial Sequence; identical to SEQ ID NO: 192859
  derived and/or modified sequence opt5 from hemagglutinin__InfluenzaA__AHL97565

SEQ ID NO: 194573 - RNA, 1701 nt, Artificial Sequence
  derived and/or modified sequence opt5 from hemagglutinin__InfluenzaA__AHL97577
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaggcagcaauucuuccuuuuucagccggcuuaacuggcugacccaucucaauuuuaaguauccugcccugaacgucacaaugcccaacaaugagcaguucgacaaacuuuacauuuggggagugcaccauccugggaccgauaaggaccagaucuuucuguaugcgcagucuuccggccgcauuacgguuagcacaaagagaucccaacaggccgugaucccgaacaucgggucucggccccgcauuagaaauaucccuagccggauuuccaucuacuggaccauugucaaacccggagauauccuccugaucaacagcacaggcaaucugauugcuccucgcggguacuucaagaucagaucuggaaaauccagcauuaugcggucugacgcccccaucggcaaguguaagagcgaaugcauuaccccgaacggcuccaucccuaaugacaaacccuuucagaacgugaaucgcaucaccuauggggcuuguccuagauacgugaagcagucuacacucaaacuggccacgggaaugcggaacguccccgagaagcaaacccgcggcauuuucggggcgaucgccggauuuauugaaaauggcugggaggggaugguugauggaugguauggcuucagacaccagaacagcgagggccgggggcaggcugccgaccuuaaauccacacaagcugccaucgaucagauuaauggaaagcugaacagacucaucggcaaaaccaaugaaaaguuccaccagauugagaaggaauuuagcgagguggaagggcgcauccaggaccuggagaaauacguggaggauacaaagaucgaccuuuggucuuauaacgccgaacugcucgucgcucuggagaaccaacauaccauugaucugacggacuccgaaaugaauaaacucuucgagcggacaaagaaacagcugagagaaaacgcggaggauaugggaaauggcugcuuuaagaucuaccacaagugugacaacgccugcauugggagcauccgcaauggcaccuaugaucaugacguguaccgggacgaggcucuuaacaauagauuccagauuaaaggaguugaacugaagcccggcuacaaagauuggauccucuggaucucuuuugccauuuccugcuuccugcuuuguguggcccugcucggguuuaucaugugggcuugccagaagggaaacauucgcuguaauaucugcauuuga

SEQ ID NO: 194574 - RNA, 1701 nt, Artificial Sequence; identical to SEQ ID NO: 193047
  derived and/or modified sequence opt5 from hemagglutinin__InfluenzaA__AHL97589

SEQ ID NO: 194575 - RNA, 1701 nt, Artificial Sequence; identical to SEQ ID NO: 193018
  derived and/or modified sequence opt5 from hemagglutinin__InfluenzaA__AHL97601

SEQ ID NO: 194576 - RNA, 1701 nt, Artificial Sequence; identical to SEQ ID NO: 192882
  derived and/or modified sequence opt5 from hemagglutinin__InfluenzaA__AHL97613

SEQ ID NO: 194577 - RNA, 1701 nt, Artificial Sequence; identical to SEQ ID NO: 194564
  derived and/or modified sequence opt5 from hemagglutinin__InfluenzaA__AHL97625

SEQ ID NO: 194578 - RNA, 1701 nt, Artificial Sequence; identical to SEQ ID NO: 192892
  derived and/or modified sequence opt5 from hemagglutinin__InfluenzaA__AHL97637

SEQ ID NO: 194579 - RNA, 1701 nt, Artificial Sequence
  derived and/or modified sequence opt5 from hemagglutinin__InfluenzaA__AHL97661
augaagaccaucauugcccugggcuacauccucugccugguguucgcucagaaacuucccgggaacgacaauagcacagccacgcugugucucggacaccaugcggucccuaacggcaccauuguuaagacaaucaccaaugauagaauugaggugacaaacgcuaccgaacuggugcaaaauuccucuaucggggagaucugcgacagcccgcaccagauucuugauggagaaaacuguacacugaucgacgcccuccugggcgauccccagugcgacggguuucagaauaaaaagugggaucuguucgucgagcgguccaaagccuauucuaacuguuacccuuaugacgugcccgauuacgcuagccuccgcucccugguugccucuagcggaacccuugaauuuaauaacgaguccuucaauuggacgggcgugacccaaaacggcacaagcucugcuugcauuagacgguccaauagcuccuuuuucucucgccugaacuggcucacccaucugaauuuuaaguauccugcccuuaacgucacaaugcccaacaaugagcaguucgacaagcuguacaucuggggagugcaccauccugggaccgauaaagaccagauuuuucucuaugcgcagagcucuggcagaaucacgguuuccacaaagcggagccaacaggccgugauuccgaacaucgggucccgccccagaauccggaauauuccuucucgcaucagcauuuacuggaccaucgucaaacccggagauauucugcugaucaacuccacaggcaaucucaucgcuccuagaggguacuucaagauucggagcggaaaaucuuccaucaugcgcagcgacgcccccauuggcaaguguaagucugaaugcaucaccccgaacggcagcauuccuaaugacaaacccuuucagaacgugaauagaaucaccuauggggcuuguccucgguacgugaagcaguccacacugaaacuugccacgggaaugcgcaacguccccgagaagcaaaccagaggcaucuucggggcgauugccggauuuaucgaaaauggcugggaggggaugguugauggaugguauggcuuccggcaccagaacucugagggcagagggcaggcugccgaccugaaaagcacacaagcugccauugaucagaucaauggaaagcucaaccgccugauuggcaaaaccaaugaaaaguuccaccagaucgagaaggaauuuuccgagguggaagggcggauucaggaccuugagaaauacguggaggauacaaagaucgaccuguggagcuauaacgccgaacuccuggucgcucuggagaaccaacauaccaucgaucucacggacucugaaaugaauaaacuguucgagaagaccaaaaagcagcuuagagaaaacgcggaggauaugggaaauggcugcuuuaagauuuaccacaaaugugacaacgccugcaucggguccauucgcaauggcacauaugaucauaacguguaccgggacgaggcucugaauaacagauuccagaucaagggaguugaacucaaaagcggcuacaaggacuggauucuguggaucucuuuugccaucuccugcuuccuucuguguguggcccuccugggguuuauuaugugggcuugccagaaaggaaauauccgcuguaacauuugcaucuga

SEQ ID NO: 194580 - RNA, 1701 nt, Artificial Sequence
  derived and/or modified sequence opt5 from hemagglutinin__InfluenzaA__AHL97673
augaagaccacaaucgcccugagcuacauucucugccugguguucgcucaggagcuucccggcaacgacgauuccacggccacccugugucucgggcaccaugcggucccuaauggaacaaucguuaaaaccauuacaaacgaccaaaucgaagugaccaaugcuacagagcuggugcagucuagcuccaccggcgaaauuugcaacucuccgcaccagauccuugauggggagaauuguacgcugaucgacgcccuccugggagauccccagugcgacggcuuucaaaacaagaaaugggaucuguucgucgaaagaagcaaggcccauuccaauuguuauccuuacgacgugcccgauuaugcuucucuccggagccugguugccuccagcgggacccuugaguuuaacaaugagucuuucaacuggacaggagugacccagaauggcacauccagcgcuugcauucgcagaucuaacaauuccuuuuucagccggcugaacuggcucacccaccugaauuuuaaauacccugcccuuaacgucacgaugcccaacaaugaacaguucgacaagcuguauaucuggggcgugcaucacccugggacagauaaggaccagauuuuucucuacgcgcaagccucuggacgcaucaccguuuccacaaaaagaagccagcaggcugugauuccgaacaucggcucccggccccgcgucagaaauauuccuucucgggugagcaucuauuggaccaucgugaagcccggggauauucugcugaucaacuccaccggaaaucucauugccccucgcggcuacuucaaaaucagaagcgggaagucuuccauuaugcggagcgacgcucccaucggaaaauguaacucugccugcaucacaccgaauggcagcauuccuaacgacaagcccuuucagaaugucaaccgcaucacguacggcgcguguccuagauauguuaagcaaaauacccugaaacuugccacagggaugcggaacgugcccgagaagcagacccgcggaauuuucggcgcuaucgccggguuuauugaaaauggaugggagggcaugguggaugggugguacggauucagacaccagaacuccgagggccggggccaagcugccgaccugaaaucuacacaggccgcuaucgaucagaucaaugggaagcucaacagacugauuggaaaaaccaacgaaaaguuccaucagaucgagaaagaauuuagcgaggucgaaggccgcauucaagaccuugagaaguauguggaggauacgaagaucgaccugugguccuacaaugcggaacuccugguugcccuggagaaccagcacacaauugaucucaccgacagcgaaaugaauaaacuguucgagaagaccaaaaagcagcuucgggaaaacgcugaggauauggggaauggaugcuuuaaaaucuaucauaagugugacaacgccugcauuggcucuaucagaaaugggacauacgaucacgacguguaucgcgacgaggcccugaacaaucgguuccagaucaagggcgucgaacucaaauccggauacaaggauuggauucuguggaucagcuuugcuauuucuugcuuccuucuguguguggcccuccugggcuuuaucaugugggcgugccaaaaagggaacauuagauguaauaucugcaucuga

SEQ ID NO: 194581 - RNA, 1701 nt, Artificial Sequence; identical to SEQ ID NO: 193018
  derived and/or modified sequence opt5 from hemagglutinin__InfluenzaA__AHL97685

SEQ ID NO: 194582 - RNA, 1701 nt, Artificial Sequence
  derived and/or modified sequence opt5 from hemagglutinin__InfluenzaA__AHL97697
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcgggggaaagccuauucuaacuguuacccuuaugacgugcccgauuacgcuagccuccgcucccugguugccucuagcggaacccuugaauuuaauaacgaguccuucaauugggcuggcgugacgcaaaacggcaccagcucugccugcauuagaggguccaauagcuccuuuuucucucggcugaacuggcucacacaucugaauuuuaaguauccugcgcuuaacgucaccaugcccaacaaugagcaguucgacaagcuguacaucuggggagugcaccauccuggcacagauaaagaccagauuuuucucuaugcccagagcucugggcgcaucaccguuuccacgaagagaagccaacaggcugugauuccgaacaucggaucccggccccgcaucagaaauauuccuucucggaucagcauuuacuggacaaucgucaaacccggcgauauucugcugaucaacuccaccgggaaucucaucgccccucgcggauacuucaagauuagaagcggcaaaucuuccaucaugcggagcgacgcucccauuggcaaguguaagucugaaugcaucacaccgaacgggagcauuccuaaugacaaacccuuucagaacgugaaucgcaucaccuauggagccuguccuagauacgugaagcaguccacccugaaacuugcgacaggcaugcggaacguccccgagaagcaaacgcgcgggaucuucggagccauugcuggcuuuaucgaaaaugggugggagggaaugguugauggcugguauggcuucagacaccagaacucugaggggcggggacaggccgcugaccugaaaagcacccaagccgccauugaucagaucaauggcaagcucaacagacugauugggaaaacaaaugaaaaguuccaccagaucgagaaggaauuuuccgagguggaaggacgcauucaggaccuugagaaauacguggaggauaccaagaucgaccuguggagcuauaacgcugaacuccuggucgcgcuggagaaccaacauacaaucgaucucaccgacucugaaaugaauaaacuguucgagaagacgaaaaagcagcuucgggaaaacgccgaggauaugggcaaugggugcuuuaagauuuaccacaaaugugacaacgcuugcaucggcuccauuagaaauggaacauaugaucaugacguguaccgcgacgaggcccugaacaaucgguuccagaucaagggcguugaacucaaaagcggguacaaggauuggauucuguggaucucuuuugccaucuccugcuuccuucuguguguggcucuccugggauuuauuaugugggccugccagaaaggcaacaucagauguaauauuugcaucuga

SEQ ID NO: 194583 - RNA, 1701 nt, Artificial Sequence; identical to SEQ ID NO: 192892
  derived and/or modified sequence opt5 from hemagglutinin__InfluenzaA__AHL97709

SEQ ID NO: 194584 - RNA, 1701 nt, Artificial Sequence; identical to SEQ ID NO: 193018
  derived and/or modified sequence opt5 from hemagglutinin__InfluenzaA__AHL97721

SEQ ID NO: 194585 - RNA, 1701 nt, Artificial Sequence; identical to SEQ ID NO: 192892
  derived and/or modified sequence opt5 from hemagglutinin__InfluenzaA__AHL97733

SEQ ID NO: 194586 - RNA, 1701 nt, Artificial Sequence; identical to SEQ ID NO: 192882
  derived and/or modified sequence opt5 from hemagglutinin__InfluenzaA__AHL97745

SEQ ID NO: 194587 - RNA, 1701 nt, Artificial Sequence; identical to SEQ ID NO: 193018
  derived and/or modified sequence opt5 from hemagglutinin__InfluenzaA__AHL97757

SEQ ID NO: 194588 - RNA, 1701 nt, Artificial Sequence; identical to SEQ ID NO: 193018
  derived and/or modified sequence opt5 from hemagglutinin__InfluenzaA__AHL97769

SEQ ID NO: 194589 - RNA, 1701 nt, Artificial Sequence
  derived and/or modified sequence opt5 from hemagglutinin__InfluenzaA__AHL97781
augaagaccaucauugcccugagcuacauccucugccugguguucgcucaggagcuucccggcaacgacgauuccacagccacgcugugucucgggcaccaugcggucccuaauggaaccauuguuaaaacaaucaccaacgaccaaauugaagugacaaaugcuaccgagcuggugcagucuagcuccacaggcgaaaucugcaacucuccgcaccagauccuugauggggagaauuguacccugauugacgcccuccugggagauccccagugcgacggcuuucaaaacaagaaaugggaucuguucgucgaaagaagcaaggcccauuccaauuguuauccuuacgacgugcccgauuaugcuucucuccggagccugguugccuccagcgggacgcuugaguuuaacaaugagucuuucaacuggaccggagugacacagaauggcaccuccagcgcuugcauccgcagaucuaacaauuccuuuuucagccggcugaacuggcucacacaccugaauuuuaaauacccugcccuuaacgucaccaugcccaacaaugaacaguucgacaagcuguauauuuggggcgugcaucacccugggacggauaaggaccagaucuuucucuacgcgcaagccucuggacgcauuacaguuuccaccaaaagaagccagcaggcugugaucccgaacauuggcucccggccccgcgucagaaauaucccuucucgggugagcaucuauuggacaauugugaagcccggggauauccugcugauuaacuccaccggaaaucucaucgccccucgcggcuacuucaaaauuagaagcgggaacucuuccaucaugcggagcgacgcucccaucggaaaguguaauucuaccugcauuacaccgaacggcagcaucccuaaugacaaacccuuucagaacgucaaucgcauuacguacggcgccuguccuagauauguuaagcaaaacacccugaaacuugcgacagggaugcggaaugugcccgagaagcagacccgcggaaucuucggcgccauugcuggguuuaucgaaaacggaugggagggcaugguggaugggugguacggauucagacaccaaaauuccgagggccggggccaggccgcugaccugaagucuacacaggccgccaucgaucagauuaacgggaaacucaacagacugaucggaaagaccaaugaaaaauuccaucagauugagaaggaauuuagcgaggucgaaggccgcauccaagaccuugagaaauauguggaggauacgaagauugaccugugguccuacaacgcugaacuccugguugcgcuggagaaucagcacacaaucgaucucaccgacagcgaaaugaacaagcuguucgagaaaaccaagaaacagcuucgggaaaaugccgaggauauggggaacggaugcuuuaagauuuaucauaaaugugacaaugcuugcaucggcucuaucagaaacgggacauacgaucacgacguguaucgcgacgaggcccugaauaaccgguuccagauuaagggcgucgaacucaaguccggauacaaagauuggauccuguggauuagcuuugccaucucuugcuuccuucuguguguggcucuccugggcuuuauuaugugggccugccaaaaggggaauaucagauguaacaucugcauuuga

SEQ ID NO: 194590 - RNA, 1701 nt, Artificial Sequence; identical to SEQ ID NO: 193018
  derived and/or modified sequence opt5 from hemagglutinin__InfluenzaA__AHL97793

SEQ ID NO: 194591 - RNA, 1701 nt, Artificial Sequence
  derived and/or modified sequence opt5 from hemagglutinin__InfluenzaA__AHL97805
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugguugauggaugguauggcuucagacaccagaacuacgagggccgggggcaggccgcugaccugaaaagcacccaagccgccauugaucagaucaauggaaagcucaacagacugauuggcaaaacaaaugaaaaguuccaccagaucgagaaggaauuuuccgagguggaagggcgcauucaggaccuugagaaauauguggaggauaccaagaucgaccuguggagcuacaacgcugaacuccuggucgcgcuggagaaccaacauacaaucgaucucaccgacucugaaaugaauaaacuguucgagaagacgaaaaagcagcuucgggaaaacgccgaggauaugggaaauggcugcuuuaagauuuaucacaaaugugacaacgcuugcaucggguccauuagaaauggcacauacgaucaugacguguaccgcgacgaggcccugaacaaucgguuccagaucaagggaguugaacucaaaagcggcuauaaggauuggauucuguggaucucuuuugccaucuccugcuuccuucuguguguggcucuccugggguuuauuaugugggccugccagaaaggaaacaucagauguaauauuugcaucuga

SEQ ID NO: 194592 - RNA, 1701 nt, Artificial Sequence; identical to SEQ ID NO: 192892
  derived and/or modified sequence opt5 from hemagglutinin__InfluenzaA__AHL97817

SEQ ID NO: 194593 - RNA, 1701 nt, Artificial Sequence; identical to SEQ ID NO: 194582
  derived and/or modified sequence opt5 from hemagglutinin__InfluenzaA__AHL97829

SEQ ID NO: 194594 - RNA, 1701 nt, Artificial Sequence; identical to SEQ ID NO: 193018
  derived and/or modified sequence opt5 from hemagglutinin__InfluenzaA__AHL97841

SEQ ID NO: 194595 - RNA, 1701 nt, Artificial Sequence; identical to SEQ ID NO: 193018
  derived and/or modified sequence opt5 from hemagglutinin__InfluenzaA__AHL97853

SEQ ID NO: 194596 - RNA, 1701 nt, Artificial Sequence; identical to SEQ ID NO: 193018
  derived and/or modified sequence opt5 from hemagglutinin__InfluenzaA__AHL97865

SEQ ID NO: 194597 - RNA, 1701 nt, Artificial Sequence; identical to SEQ ID NO: 193018
  derived and/or modified sequence opt5 from hemagglutinin__InfluenzaA__AHL97877

SEQ ID NO: 194598 - RNA, 1701 nt, Artificial Sequence; identical to SEQ ID NO: 192892
  derived and/or modified sequence opt5 from hemagglutinin__InfluenzaA__AHL97889

SEQ ID NO: 194599 - RNA, 1701 nt, Artificial Sequence; identical to SEQ ID NO: 192892
  derived and/or modified sequence opt5 from hemagglutinin__InfluenzaA__AHL97901

SEQ ID NO: 194600 - RNA, 1701 nt, Artificial Sequence; identical to SEQ ID NO: 192882
  derived and/or modified sequence opt5 from hemagglutinin__InfluenzaA__AHL97913

SEQ ID NO: 194601 - RNA, 1701 nt, Artificial Sequence
  derived and/or modified sequence opt5 from hemagglutinin__InfluenzaA__AHL97925
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauaacuccuuuuucucucgccugaauuggcucacccauagcaacuuuaaguauccugcccugaacgucacaaugcccaauaacgagcaguucgacaaacuuuacaucuggggcgugcaccauccugggaccgauaaagaccagauuuuucuguaugcgcagucuuccggaagaaucacgguuagcacaaagcggucccaacaggccgugauuccgaauaucggcucucgccccagaauccggaacauuccuagccgcaucuccauuuacuggaccaucgucaaacccggggauauucuccugaucaauagcacaggaaaccugaucgcuccuagaggcuacuucaagauucggucugggaaauccagcaucaugcgcucugacgcccccauuggaaaguguaagagcgaaugcaucaccccgaauggcuccauuccuaacgacaaacccuuucagaaugugaacagaaucaccuauggcgcuuguccucgguacgugaagcagucuacacucaaacuggccacggggaugcgcaauguccccgagaagcaaaccagaggaaucuucggcgcgauugccggguuuaucgaaaacggaugggagggcaugauggaugggugguauggauuccggcaccagaauagcgagggcagaggccaggcugccgaccuuaaauccacacaagcugccauugaucagaucaacgggaagcugaaucgccucauuggaaaaaccaacgaaaaguuccaccagaucgagaaggaauuuagcgagguugaaggccggauucaggaccuggagaaauacguggaggauacaaagaucgaccuuuggucuuauaacgccgaacugcucguggcucuggagaaucaacauaccaucgaucugacggacuccgaaaugaacaaacucuucgagaagacaaagaagcugcuuagagaaaaugcggaggauauggggaacggaugcuuuaagauuuaccacaaaugugacaaugccugcaucggcagcauucgcaacgggaccuaugaucaugacgucuaccgggacgaggcucugaauaacagauuccagaucaagggcguggaacucaaaucuggauacaaggauuggauucuguggaucuccuuugccaucagcugcuuccuucuguguguugcccuccugggcuuuauuaugugggcuugccagaaagggaauauccgcuguaacauuugcaucuga

SEQ ID NO: 194602 - RNA, 1701 nt, Artificial Sequence; identical to SEQ ID NO: 192882
  derived and/or modified sequence opt5 from hemagglutinin__InfluenzaA__AHL97937

SEQ ID NO: 194603 - RNA, 1701 nt, Artificial Sequence; identical to SEQ ID NO: 194562
  derived and/or modified sequence opt5 from hemagglutinin__InfluenzaA__AHL97949

SEQ ID NO: 194604 - RNA, 1701 nt, Artificial Sequence; identical to SEQ ID NO: 192892
  derived and/or modified sequence opt5 from hemagglutinin__InfluenzaA__AHL97961

SEQ ID NO: 194605 - RNA, 1701 nt, Artificial Sequence; identical to SEQ ID NO: 192892
  derived and/or modified sequence opt5 from hemagglutinin__InfluenzaA__AHL97973

SEQ ID NO: 194606 - RNA, 1701 nt, Artificial Sequence; identical to SEQ ID NO: 192892
  derived and/or modified sequence opt5 from hemagglutinin__InfluenzaA__AHL97985

SEQ ID NO: 194607 - RNA, 1701 nt, Artificial Sequence
  derived and/or modified sequence opt5 from hemagglutinin__InfluenzaA__AHL97997
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagucuacacugaaacuugccacggggaugcgcaacguccccgagaagcaaaccagaggaaucuucggcgcgauugccggguuuaucgaaaauggaugggagggcaugguugaugggugguauggauuccggcaccagaacagcgagggcagaggccaggcugccgaccugaaauccacacaagcugccauugaucagaucaaugggaagcucaaccgccugauuggaaaaaccaaugaaaaguuccaccagaucgagaaggaauuuagcgagguggaaggccggauucaggaccuugagaaauacguggaggauacaaagaucgaccuguggucuuauaacgccgaacuccuggucgcucuggagaaccaacauaccaucgaucucacggacuccgaaaugaauaaacuguucgagaagaccaaaaagcagcuuagagaaaacgcggaggauauggggaauggaugcuuuaagauuuaccacaaaugugacaacgccugcaucggcagcauucgcaaugggacauaugaucaugacguguaccgggacgaggcucugaacaauagauuccagauccgcggcguugaacucaagucuggauacaaagauuggauucuguggaucuccuuugccaucagcugcuuccuucuguguguggcccuccugggcuuuauuaugugggcuugccagaaggggaacauccgguguaauauuugcaucuga

SEQ ID NO: 194608 - RNA, 1701 nt, Artificial Sequence; identical to SEQ ID NO: 193018
  derived and/or modified sequence opt5 from hemagglutinin__InfluenzaA__AHL98009

SEQ ID NO: 194609 - RNA, 1701 nt, Artificial Sequence
  derived and/or modified sequence opt5 from hemagglutinin__InfluenzaA__AHL98021
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcaaaaucugcgacuccccgcaccagauucuugauggggagaacuguacacugauggacgcccuccugggagauccccagugcgacggcuuucagaauaagaaaugggaucuguucgucgaacggucuaaggccuauagcaacuguuacccuuaugacgugcccgauuacgcuucccuccgcucucugguugccagcuccgggacccuugaguuuaauaacgagagcuucaauugggcuggagugacgcaaaacggcaccucuuccgccugcaucagacggagcaauucuuccuuuuucagccgccugaacuggcucacacaucugaauuuuaaguauccugcgcuuaacgucaccaugcccaacaaugaacaguucgacaaacuguacauuuggggcgugcaccauccugggacagauaaggaccagaucuuucucuaugcccagucuuccggaagaauuaccguuagcacgaaacggucccaacaggcugugaucccgaacauuggcucucgccccagaauccggaauaucccuagccgcauuuccaucuacuggacaauugucaagcccggggauauccugcugauuaacagcaccggaaaucucaucgccccuagaggcuacuucaaaauccggucugggaaguccagcauuaugcgcucugacgcucccaucggaaaguguaaaagcgagugcauuacaccgaacggcuccaucccuaaugacaagcccuuucagaacgugaauagaauuaccuauggcgccuguccucgguacgugaaacagucuacccugaaacuugcgacagggaugcgcaacguccccgaaaaacaaacgagaggaaucuucggcgccaucgcuggguuuauugagaauggaugggaaggcaugauggaugggugguauggauuccggcaccagaacagcgagggcagaggccaggccgcugaccugaaguccacccaagccgccaucgaucagauuaaugggaaacucaaccgccugaucggaaagacaaaugagaaguuccaccagauugaaaaagaguuuagcgaaguugagggccggauccaggaccuugaaaaguacguggaggauaccaaaauugaccuguggucuuauaacgcugagcuccugguggcgcuggaaaaccaacauacaaucgaucucaccgacuccgagaugaauaagcuguucgaaaagacgaagaagcagcuuagagagaacgccgaagauauggggaauggaugcuuuaaaaucuaccacaagugugacaacgcuugcauuggcagcauccgcaaugggacauaugaucauaacgucuaccgggacgaggcccugaauaacagauuccagauuaaaggcguggagcucaagucuggauacaaagacuggauccuguggauuuccuuugccaucagcugcuuccuucuguguguugcucuccugggcuuuaucaugugggccugccagaaggggaauauucgcuguaacaucugcauuuga

SEQ ID NO: 194610 - RNA, 1701 nt, Artificial Sequence; identical to SEQ ID NO: 192892
  derived and/or modified sequence opt5 from hemagglutinin__InfluenzaA__AHL98033

SEQ ID NO: 194611 - RNA, 1701 nt, Artificial Sequence; identical to SEQ ID NO: 194489
  derived and/or modified sequence opt5 from hemagglutinin__InfluenzaA__AHL98045

SEQ ID NO: 194612 - RNA, 1701 nt, Artificial Sequence; identical to SEQ ID NO: 194489
  derived and/or modified sequence opt5 from hemagglutinin__InfluenzaA__AHL98057

SEQ ID NO: 194613 - RNA, 1701 nt, Artificial Sequence; identical to SEQ ID NO: 194489
  derived and/or modified sequence opt5 from hemagglutinin__InfluenzaA__AHL98069

SEQ ID NO: 194614 - RNA, 1701 nt, Artificial Sequence
  derived and/or modified sequence opt5 from hemagglutinin__InfluenzaA__AHL98081
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagaaagagcaauucuuccuuuuucagccggcugaacuggcucacccaucugaauuuuaaguauccugcccuuaacgucacaaugcccaacaaugagcaguucgacaaacuguacaucuggggcgugcaccauccugggaccgauaaggaccagauuuuucucuaugcgcagucuuccggacgcaucacgguuagcacacaaagaucccagcaggccgugauuccgaacaucggcucucggccccgcaucagaaauauuccuagccggaucuccauuuacuggaccaucgucaaacccggggauauucugcugaucaacagcacaggaaaucucaucgcuccucgcggcuacuucaagauuagaucugggaaauccagcaucaugcggucugacgcccccauuggaaaguguaagagcgaaugcaucaccccgaacggcuccauuccuaaugacaaacccuuucagaacgugaaucgcaucaccuauggcgcuuguccuagauacgugaagcaaucuacacugaaacuugccacggggaugcggaacguccccgagaagcagacccgcggaaucuucggcgcgauugccggguuuaucgaaaauggaugggagggcaugguugaugggugguauggauucagacaccagaacagcgagggccggggccaagcugccgaccugaaauccacacaggcugccauugaucagaucaaugggaagcucaacagacuggugggaaaaaccaaugaaaaguuccaccagauugagaaggaauuuagcgagguggaaggccgcauccaagaccuugagaaauacgucgaggauacaaagauugaccuguggucuuauaacgccgaacuccugguggcucuggagaaccagcauaccaucgaucucacggacuccgaaaugaauaaacuguucgagaagaccaaaaagcagcuucgggaaaacgcggaggauauggggaauggaugcuuuaagaucuaccacaaaugugacaacgccugcauuggcagcaucagaaaugggacauaugaucaugacguuuaccgcgacgaggcucugaacaaucgguuccagauuaagggcguggaacucaaaucuggauacaaggauuggauccuguggauuuccuuugccaucagcugcuuccuucugugugucgcccuccugggcuuuaucaugugggcuugccaaaaagggaacauuagauguaauaucugcauuuga

SEQ ID NO: 194615 - RNA, 1701 nt, Artificial Sequence; identical to SEQ ID NO: 192882
  derived and/or modified sequence opt5 from hemagglutinin__InfluenzaA__AHL98093

SEQ ID NO: 194616 - RNA, 1701 nt, Artificial Sequence
  derived and/or modified sequence opt5 from hemagglutinin__InfluenzaA__AHL98105
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaagugcaacaucgccggguggauucugggaaauccugagugugaaucucugagcacagccuccucuuggagcuacaucguggagaccuccggcucugacaacgggacgugcuauccgggagauuuuauugacuacgaggagcuccgggagcagcugagcuccgucagcucuuucgaacgcuuugagaucuuccccaagaccuccagcuggccuaaucacgauucuaacaagggcgugacagccgcuuguccccaugccggcgcgaaaggguuuuauaagaaucuuaucuggcugguuaaaaagggaaacuccuacccuaaacucagcauuucuuauaucaaugacaagggcaaggaagugcugguccuuugggggauucaccaccccuccaccacagccgaucaacagagccuguaccagaacgcugacaccuacguguucgugggagccuccagauauucuaaaaaguuuaaaccugagaucgcuauucggccgaagguccgcgaucaggagggcagaaugaauuacuauuggacgcucguugaacccggggacaaaaucacauucgaggccaccggaaaccugguggugccucgguacgcguuugccauggaacgcaacgcuggcagcggcauuaucaucuccgauacacccguccaugacugcaauaccaccugucaaacaccuaagggggccauuaacacgagccugcccuuccagaauauccacccgauuaccaucggaaaaugcccuaaguaugugaagucuacaaaacucagacuggcuaccggccuucggaacguucccuccauucagagccgcgggcuguuuggagccaucgccggcuucaucgaagggggauggacaggcaugguggacggcugguacggguaucaucaccagaaugaacaaggaucuggcuacgcugcggaucucaagagcacccagaacgccauugacaaaaucacgaauaaggucaacuccgugauugagaaaaugaauacacaguuuaccgcuguugggaaggaguucaaccaccuggaaaagagaaucgagaaucuuaacaaaaagguggaugacggauuccuggauauuuggaccuacaaugccgaacuccugguccugcucgagaacgaacggacacuggacuaucaugauucuaaugugaaaaaccuuuacgagaagguccgcaaccagcugaaaaauaacgccaaggagaucggcaauggguguuuugaguucuaucacaagugcgacaacaccuguauggaaagcgugaaaaauggcacauacgauuauccuaaguacuccgaagaggcuaaacucaacagagaagagaucgacggaguuaagcuggagagcacgcggauuuaucaaauccuugccauuuacucuaccgcggcuuccagccuggugcucgucgugucucugggcgccaucuccuuuuggaugugcagcaaugggucccugcagugccgcauuuguaucuga

SEQ ID NO: 194617 - RNA, 1701 nt, Artificial Sequence; identical to SEQ ID NO: 192882
  derived and/or modified sequence opt5 from hemagglutinin__InfluenzaA__AHL98116

SEQ ID NO: 194618 - RNA, 1701 nt, Artificial Sequence; identical to SEQ ID NO: 192892
  derived and/or modified sequence opt5 from hemagglutinin__InfluenzaA__AHL98128

SEQ ID NO: 194619 - RNA, 1701 nt, Artificial Sequence; identical to SEQ ID NO: 192882
  derived and/or modified sequence opt5 from hemagglutinin__InfluenzaA__AHL98140

SEQ ID NO: 194620 - RNA, 1701 nt, Artificial Sequence; identical to SEQ ID NO: 192882
  derived and/or modified sequence opt5 from hemagglutinin__InfluenzaA__AHL98152

SEQ ID NO: 194621 - RNA, 1701 nt, Artificial Sequence; identical to SEQ ID NO: 192892
  derived and/or modified sequence opt5 from hemagglutinin__InfluenzaA__AHL98164

SEQ ID NO: 194622 - RNA, 1701 nt, Artificial Sequence; identical to SEQ ID NO: 192892
  derived and/or modified sequence opt5 from hemagglutinin__InfluenzaA__AHL98176

SEQ ID NO: 194623 - RNA, 1701 nt, Artificial Sequence; identical to SEQ ID NO: 192882
  derived and/or modified sequence opt5 from hemagglutinin__InfluenzaA__AHL98188

SEQ ID NO: 194624 - RNA, 1701 nt, Artificial Sequence; identical to SEQ ID NO: 193047
  derived and/or modified sequence opt5 from hemagglutinin__InfluenzaA__AHL98200

SEQ ID NO: 194625 - RNA, 1701 nt, Artificial Sequence; identical to SEQ ID NO: 192882
  derived and/or modified sequence opt5 from hemagglutinin__InfluenzaA__AHL98212

SEQ ID NO: 194626 - RNA, 1701 nt, Artificial Sequence; identical to SEQ ID NO: 192882
  derived and/or modified sequence opt5 from hemagglutinin__InfluenzaA__AHL98224

SEQ ID NO: 194627 - RNA, 1701 nt, Artificial Sequence; identical to SEQ ID NO: 193018
  derived and/or modified sequence opt5 from hemagglutinin__InfluenzaA__AHL98236

SEQ ID NO: 194628 - RNA, 1701 nt, Artificial Sequence; identical to SEQ ID NO: 192892
  derived and/or modified sequence opt5 from hemagglutinin__InfluenzaA__AHL98248

SEQ ID NO: 194629 - RNA, 1701 nt, Artificial Sequence; identical to SEQ ID NO: 192882
  derived and/or modified sequence opt5 from hemagglutinin__InfluenzaA__AHL98260

SEQ ID NO: 194630 - RNA, 1701 nt, Artificial Sequence; identical to SEQ ID NO: 192892
  derived and/or modified sequence opt5 from hemagglutinin__InfluenzaA__AHL98272

SEQ ID NO: 194631 - RNA, 1701 nt, Artificial Sequence; identical to SEQ ID NO: 194488
  derived and/or modified sequence opt5 from hemagglutinin__InfluenzaA__AHL98284

SEQ ID NO: 194632 - RNA, 1701 nt, Artificial Sequence
  derived and/or modified sequence opt5 from hemagglutinin__InfluenzaA__AHL98295
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauugggcuggagugacgcaaaacggcaccucuuccgccugcaucagaggcagcaauucuuccuuuuucagccggcuuaacuggcugacacaucucaauuuuaaguauccugcgcugaacgucaccaugcccaacaaugagcaguucgacaaacuuuacauuuggggagugcaccauccugggacagauaaggaccagaucuuucuguaugcccagucuuccggccgcauuaccguuagcacgaagagaucccaacaggcugugaucccgaacaucgggucucggccccgcauuagaaauaucccuagccggauuuccaucuacuggacaauugucaaacccggagauauccuccugaucaacagcaccggcaaucugauugccccucgcggguacuucaagaucagaucuggaaaauccagcauuaugcggucugacgcucccaucggcaaguguaagagcgaaugcauuacaccgaacggcuccaucccuaaugacaaacccuuucagaacgugaaucgcaucaccuauggggccuguccuagauacgugaagcagucuacccucaaacuggcgacaggaaugcggaacguccccgagaagcaaacgcgcggcauuuucggggccaucgcuggauuuauugaaaauggcugggaggggaugauggauggaugguauggcuucagacaccagaacagcgagggccgggggcaggccgcugaccuuaaauccacccaagccgccaucgaucagauuaauggaaagcugaacagacucaucggcaaaacaaaugaaaaguuccaccagauugagaaggaauuuagcgagguugaagggcgcauccaggaccuggagaaauacguggaggauaccaagaucgaccuuuggucuuauaacgcugaacugcucguggcgcuggagaaccaacauacaauugaucugaccgacuccgaaaugaauaaacucuucgagaagacgaaaaagcagcugcgggaaaacgccgaggauaugggaaauggcugcuuuaagaucuaccacaaaugugacaacgcuugcauugggagcaucagaaauggcacauaugaucaugacgucuaccgcgacgaggcccuuaacaaucgguuccagauuaagggaguggaacugaaaucuggcuacaaggauuggauccucuggaucuccuuugccauuagcugcuuccugcuuuguguugcucugcucggguuuaucaugugggccugccagaaaggaaacauuagauguaauaucugcauuuga

SEQ ID NO: 194633 - RNA, 1701 nt, Artificial Sequence; identical to SEQ ID NO: 194530
  derived and/or modified sequence opt5 from hemagglutinin__InfluenzaA__AHL98307

SEQ ID NO: 194634 - RNA, 1701 nt, Artificial Sequence; identical to SEQ ID NO: 192892
  derived and/or modified sequence opt5 from hemagglutinin__InfluenzaA__AHL98319

SEQ ID NO: 194635 - RNA, 1701 nt, Artificial Sequence; identical to SEQ ID NO: 192892
  derived and/or modified sequence opt5 from hemagglutinin__InfluenzaA__AHL98331

SEQ ID NO: 194636 - RNA, 1701 nt, Artificial Sequence; identical to SEQ ID NO: 193018
  derived and/or modified sequence opt5 from hemagglutinin__InfluenzaA__AHL98343

SEQ ID NO: 194637 - RNA, 1701 nt, Artificial Sequence; identical to SEQ ID NO: 194530
  derived and/or modified sequence opt5 from hemagglutinin__InfluenzaA__AHL98354

SEQ ID NO: 194638 - RNA, 1701 nt, Artificial Sequence; identical to SEQ ID NO: 192882
  derived and/or modified sequence opt5 from hemagglutinin__InfluenzaA__AHL98366

SEQ ID NO: 194639 - RNA, 1701 nt, Artificial Sequence; identical to SEQ ID NO: 192882
  derived and/or modified sequence opt5 from hemagglutinin__InfluenzaA__AHL98378

SEQ ID NO: 194640 - RNA, 1701 nt, Artificial Sequence; identical to SEQ ID NO: 192882
  derived and/or modified sequence opt5 from hemagglutinin__InfluenzaA__AHL98390

SEQ ID NO: 194641 - RNA, 1701 nt, Artificial Sequence; identical to SEQ ID NO: 192882
  derived and/or modified sequence opt5 from hemagglutinin__InfluenzaA__AHL98402

SEQ ID NO: 194642 - RNA, 1701 nt, Artificial Sequence; identical to SEQ ID NO: 192892
  derived and/or modified sequence opt5 from hemagglutinin__InfluenzaA__AHL98414

SEQ ID NO: 194643 - RNA, 1701 nt, Artificial Sequence
  derived and/or modified sequence opt5 from hemagglutinin__InfluenzaA__AHL98426
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauaacuccuuuuucucucgccugaauuggcucacccauagcaacuuuaaguauccugcccugaacgucacaaugcccaauaacgagcaguucgacaaacuuuacaucuggggcgugcaccauccugggaccgauaaagaccagauuuuucuguaugcgcagucuuccggaagaaucacgguuagcacaaagcggucccaacaggccgugauuccgaauaucggcucucgccccagaauccggaacauuccuagccgcaucuccauuuacuggaccaucgucaaacccggggauauucuccugaucaauagcacaggaaaccugaucgcuccuagaggcuacuucaagauucggucugggaaauccagcaucaugcgcucugacgcccccauuggaaaguguaagagcgaaugcaucaccccgaauggcuccauuccuaacgacaaacccuuucagaaugugaacagaaucaccuauggcgcuuguccucgguacgugaagcagucuacacucaaacuggccacggggaugcgcaauguccccgagaagcaaaccagaggaaucuucggcgcgauugccggguuuaucgaaaacggaugggagggcaugauggaugggugguauggauuccggcaccagaauagcgagggcagaggccaggcugccgaccuuaaauccacacaagcugccauugaucagaucaacgggaagcugaaucgccucauuggaaaaaccaacgaaaaguuccaccagaucgagaaggaauuuagcgagguugaaggccggauucaggaccuggagaaauacguggaggauacaaagaucgaccuuuggucuuauaacgccgaacugcucguggcucuggagaaucaacauaccaucgaucugacggacuccgaaaugaacaaacucuucgagaagacaaagaagcagcugagagaaaaugcggaggauauggggaacggaugcuuuaagauuuaccacaaaugugacaaugccugcaucggcagcauucgcaacgggaccuaugaucaugacgucuaccgggacgaggcucuuaauaacagauuccaggugaagggcguugaacugaaaucuggauacaaggauuggauccucuggauuuccuuugccaucagcugcuuccugcuuuguguggcccugcucggcuuuaucaugugggcuugccagaaagggaauauucgcuguaacaucugcauuuga

SEQ ID NO: 194644 - RNA, 1701 nt, Artificial Sequence; identical to SEQ ID NO: 193064
  derived and/or modified sequence opt5 from hemagglutinin__InfluenzaA__AHL98438

SEQ ID NO: 194645 - RNA, 1701 nt, Artificial Sequence; identical to SEQ ID NO: 193064
  derived and/or modified sequence opt5 from hemagglutinin__InfluenzaA__AHL98449

SEQ ID NO: 194646 - RNA, 1701 nt, Artificial Sequence
  derived and/or modified sequence opt5 from hemagglutinin__InfluenzaA__AHL98471
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauuaauuacgaagaacugcgggagcagcuuuccagcgucucuuccuucgaaaaguuugagaucuuccccaagaccagcucuuggccuaaccacgacuccaauaaaggagugacagccgcuuguccccaugccggcgccaagagcuuuuauaaaaaccugaucuggcucguuaagaaaggcaauucuuacccuaagcugcgcgaauccuauauuaacgauaaggggaaagaggugcuuguccuguggggaauccaccaccccagcaccacagccgaccaacagucccucuaccagaaugcugaugccuacguguucgugggcaccucuagauauagcaagaaauuuaagccugagauugcuauccggccgaaaguccgcgaccaggaagggagaaugaacuacuauuggacgcugauugagcccggagauaagaucacauucgaagccaccggcaaccugguugugccucgguacgcguuugccauggagcgcaaugcuggguccggaauuaucaucagcgacacacccgugcaugauugcaacaccaccugucaaacaccugaaggcgccauuaauacgucucuccccuuccagaacauccacccgauuaccaucggcaaaugcccuaaguaugucaaguccacaaaacugagacuugcuaccgggcugcggaaugugcccagcauucagucucgcggacucuuuggcgccaucgccggguucaucgagggaggcuggacagggaugguugacggaugguacggcuaucaucaccagaacgagcaaggcagcggguacgcugcggaccugaaguccacccagaaugccauugauaaaaucacgaacaaggucaauucugugauugagaaaaugaacacacaguuuaccgcugugggaaaggaguucaaucaccuugaaaagagaaucgagaaccugaauaaaaagguugacgauggcuuccucgacauuuggaccuacaacgccgaacugcuggugcuccuggagaaugagcggacacuugauuaucaugacagcaacgucaaaaaccuguacgaaaaggugcgcaaucagcucaaaaacaaugccaaggagaucgggaacggauguuuugaguucuaucacaagugcgauaauaccuguauggaauccgucaaaaacggcacauacgacuauccuaaguacagcgaagaggcuaaacugaauagagagaagaucgauggggugaaacuugaaucuacgcggauuuaucaaauccuggccauuuacuccaccguugcgagcucucucgugcuggucgugucccugggcgcuaucagcuuuuggaugugcuccaacggaucucuccagugccgcauuuguaucuga

SEQ ID NO: 194647 - RNA, 1701 nt, Artificial Sequence; identical to SEQ ID NO: 193018
  derived and/or modified sequence opt5 from hemagglutinin__InfluenzaA__AHL98482

SEQ ID NO: 194648 - RNA, 1701 nt, Artificial Sequence; identical to SEQ ID NO: 192859
  derived and/or modified sequence opt5 from hemagglutinin__InfluenzaA__AHL98494

SEQ ID NO: 194649 - RNA, 1701 nt, Artificial Sequence; identical to SEQ ID NO: 193018
  derived and/or modified sequence opt5 from hemagglutinin__InfluenzaA__AHL98506

SEQ ID NO: 194650 - RNA, 1701 nt, Artificial Sequence; identical to SEQ ID NO: 193018
  derived and/or modified sequence opt5 from hemagglutinin__InfluenzaA__AHL98518

SEQ ID NO: 194651 - RNA, 1701 nt, Artificial Sequence; identical to SEQ ID NO: 192859
  derived and/or modified sequence opt5 from hemagglutinin__InfluenzaA__AHL98530

SEQ ID NO: 194652 - RNA, 1701 nt, Artificial Sequence; identical to SEQ ID NO: 193018
  derived and/or modified sequence opt5 from hemagglutinin__InfluenzaA__AHL98542

SEQ ID NO: 194653 - RNA, 1701 nt, Artificial Sequence; identical to SEQ ID NO: 193018
  derived and/or modified sequence opt5 from hemagglutinin__InfluenzaA__AHL98554

SEQ ID NO: 194654 - RNA, 1701 nt, Artificial Sequence; identical to SEQ ID NO: 192892
  derived and/or modified sequence opt5 from hemagglutinin__InfluenzaA__AHL98566

SEQ ID NO: 194655 - RNA, 1701 nt, Artificial Sequence; identical to SEQ ID NO: 192892
  derived and/or modified sequence opt5 from hemagglutinin__InfluenzaA__AHL98578

SEQ ID NO: 194656 - RNA, 1701 nt, Artificial Sequence; identical to SEQ ID NO: 193018
  derived and/or modified sequence opt5 from hemagglutinin__InfluenzaA__AHL98590

SEQ ID NO: 194657 - RNA, 1701 nt, Artificial Sequence; identical to SEQ ID NO: 192882
  derived and/or modified sequence opt5 from hemagglutinin__InfluenzaA__AHL98602

SEQ ID NO: 194658 - RNA, 1701 nt, Artificial Sequence; identical to SEQ ID NO: 192859
  derived and/or modified sequence opt5 from hemagglutinin__InfluenzaA__AHL98614

SEQ ID NO: 194659 - RNA, 1701 nt, Artificial Sequence
  derived and/or modified sequence opt5 from hemagglutinin__InfluenzaA__AHL98626
augaagaccaucauugcccugagcuacauccucugccugguguucgcucaggagcuucccggcaacgacgauuccacagccacgcugugucucgggcaccaugcggucccuaauggaaccauuguuaaaacaaucaccaacgaccaaauugaagugacaaaugcuaccgagcuggugcagucuagcuccacaggcgaaaucugcaacucuccgcaccagauccuugauggggagaauuguacccugauugacgcccuccugggagauccccagugcgacggcuuucaaaacaagagaugggaucuguucgucgaacggagcaaagcccauuccaauuguuauccuuacgacgugcccgauuaugcuucucuccgcagccugguugccuccagcgggacgcuugaguuuaacaaugagucuuucaacuggaccggagugacacagaauggcaccuccagcgcuugcaucagacggucuaacaauuccuuuuucagccgccugaacuggcucacacaccugaauuuuaaguacccugcccuuaacgucaccaugcccaacaaugaacaguucgacaaacuguauauuuggggcgugcaucacccugggacggauaaggaccagaucuuucucuacgcgcaagccucuggaagaauuacaguuuccaccaagcggagccagcaggcugugaucccgaacauuggcucccgccccagaguccggaauaucccuucucgcgugagcaucuauuggacaauugugaaacccggggauauccugcugauuaacuccaccggaaaucucaucgccccuagaggcuacuucaagauucggagcgggaaaucuuccaucaugcgcagcgacgcucccaucggaaaguguaacucugccugcauuaccccgaauggcagcaucccuaacgacaaacccuuucagaaugucaacagaauuacauacggcgcguguccucgguauguuaagcaaaauacgcugaaacuugccaccgggaugcgcaacgugcccgagaagcagacaagaggaaucuucggcgcuauugccggguuuaucgaaaauggaugggagggcaugguggaugggugguacggauuccggcaccagaacuccgagggcagaggccaagcugccgaccugaagucuacccaggccgcuaucgaucagauuaaugggaaacucaaccgccugaucggaaagacaaacgaaaaauuccaucagauugagaaggaauuuagcgaggucgaaggccggauccaagaccuugagaaauauguggaggauaccaagauugaccugugguccuacaaugcggaacuccugguugcccuggagaaccagcacacgaucgaucucacagacagcgaaaugaauaagcuguucgagaaaaccaagaaacagcuuagagaaaacgcugaggauauggggaauggaugcuuuaagauuuaucauaaaugugacaacgccugcaucggcucuauccgcaaugggaccuacgaucacgacguguaucgggacgaggcccugaacaauagauuccagauuaagggcgucgaacucaaguccggauacaaagauuggauccuguggauuagcuuugcuaucucuugcuuccuucuguguguggcccuccugggcuuuauuaugugggcgugccaaaaggggaacauccgcuguaauaucugcauuuga

SEQ ID NO: 194660 - RNA, 1701 nt, Artificial Sequence; identical to SEQ ID NO: 192882
  derived and/or modified sequence opt5 from hemagglutinin__InfluenzaA__AHL98638

SEQ ID NO: 194661 - RNA, 1701 nt, Artificial Sequence; identical to SEQ ID NO: 192892
  derived and/or modified sequence opt5 from hemagglutinin__InfluenzaA__AHL98650

SEQ ID NO: 194662 - RNA, 1701 nt, Artificial Sequence
  derived and/or modified sequence opt5 from hemagglutinin__InfluenzaA__AHL98662
augaagaccaucauugcccugagcuacauccucugccugguguucgcucagaaacuucccggcaacgacaauuccacagccacgcugugucucgggcaccaugcggucccuaacggaaccaugguuaagacaauuaccaaugauagaaucgaggugacaaacgcuaccgaacuggugcaaaauucuagcauuggcgagaucugcgacuccccgcaccagauccuugauggggaaaacuguacacugauugacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcaucagacggagcaauaacuccuuuuucucucgccugaauuggcucacccauagcaacuuuaaguauccugcccugaacgucacaaugcccaauaacgagcaguucgacaaacuuuacauuuggggcgugcaccauccugggaccgauaaagaccagaucuuucuguaugcgcagucuuccggaagaauuacgguuagcacaaagcggucccaacaggccgugaucccgaauauuggcucucgccccagaauccggaacaucccuagccgcauuuccaucuacuggaccauugucaaacccggggauauccuccugauuaauagcacaggaaaccugaucgcuccuagaggcuacuucaagauccggucugggaaauccagcauuaugcgcucugacgcccccaucggaaaguguaagagcgaaugcauuaccccgaauggcuccaucccuaacgacaaacccuuucagaaugugaacagaauuaccuauggcgcuuguccucgguacgugaagcagucuacacucaaacuggccacggggaugcgcaauguccccgagaagcaaaccagaggaaucuucggcgcgaucgccggguuuauugaaaacggaugggagggcaugauggaugggugguauggauuccggcaccagaauagcgagggcagaggccaggcugccgaccuuaaauccacacaagcugccaucgaucagauuaacgggaagcugaaucgccucaucggaaaaaccaacgaaaaguuccaccagauugagaaggaauuuagcgagguugaaggccggauccaggaccuggagaaauacguggaggauacaaagauugaccuuuggucuuauaacgccgaacugcucguggcucuggagaaucaacauaccaucgaucugacggacuccgaaaugaacaaacucuucgagaagacaaagaagcagcugagagaaaaugcggaggauauggggaacggaugcuuuaagaucuaccacaaaugugacaaugccugcauuggcagcauccgcaacgggaccuaugaucaugacgucuaccgggacgaggcucuuaauaacagauuccagauuaagggcguggaacugaaaucuggauacaaggauuggauccucuggauuuccuuugccaucagcugcuuccugcuuuguguugcccugcucggcuuuaucaugugggcuugccagaaagggaauauucgcuguaacaucugcauuuga

SEQ ID NO: 194663 - RNA, 1701 nt, Artificial Sequence; identical to SEQ ID NO: 194530
  derived and/or modified sequence opt5 from hemagglutinin__InfluenzaA__AHL98674

SEQ ID NO: 194664 - RNA, 1701 nt, Artificial Sequence; identical to SEQ ID NO: 192882
  derived and/or modified sequence opt5 from hemagglutinin__InfluenzaA__AHL98686

SEQ ID NO: 194665 - RNA, 1701 nt, Artificial Sequence; identical to SEQ ID NO: 193018
  derived and/or modified sequence opt5 from hemagglutinin__InfluenzaA__AHL98699

SEQ ID NO: 194666 - RNA, 1701 nt, Artificial Sequence; identical to SEQ ID NO: 193147
  derived and/or modified sequence opt5 from hemagglutinin__InfluenzaA__AHL98711

SEQ ID NO: 194667 - RNA, 1701 nt, Artificial Sequence; identical to SEQ ID NO: 193491
  derived and/or modified sequence opt5 from hemagglutinin__InfluenzaA__AHL98722

SEQ ID NO: 194668 - RNA, 1701 nt, Artificial Sequence; identical to SEQ ID NO: 192892
  derived and/or modified sequence opt5 from hemagglutinin__InfluenzaA__AHL98734

SEQ ID NO: 194669 - RNA, 1701 nt, Artificial Sequence; identical to SEQ ID NO: 193018
  derived and/or modified sequence opt5 from hemagglutinin__InfluenzaA__AHL98746

SEQ ID NO: 194670 - RNA, 1701 nt, Artificial Sequence; identical to SEQ ID NO: 192892
  derived and/or modified sequence opt5 from hemagglutinin__InfluenzaA__AHL98758

SEQ ID NO: 194671 - RNA, 1701 nt, Artificial Sequence; identical to SEQ ID NO: 192882
  derived and/or modified sequence opt5 from hemagglutinin__InfluenzaA__AHL98770

SEQ ID NO: 194672 - RNA, 1701 nt, Artificial Sequence; identical to SEQ ID NO: 193021
  derived and/or modified sequence opt5 from hemagglutinin__InfluenzaA__AHL98782

SEQ ID NO: 194673 - RNA, 1701 nt, Artificial Sequence
  derived and/or modified sequence opt5 from hemagglutinin__InfluenzaA__AHL98794
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaagugucgcagcgaaugcaucacaccgaacggcuccauuccuaaugacaagcccuuucagaacgugaauagaaucaccuauggggccuguccucgguacgugaaacagucuacccugaaacuugcgacaggaaugcgcaacguccccgagaagcaaacgagaggcaucuucggggccauugcuggauuuaucgaaaauggcugggaggggaugguugauggaugguauggcuuccggcaccagaacagcgagggcagagggcaggccgcugaccugaaguccacccaagccgccauugaucagaucaauggaaaacucaaccgccugauuggcaagacaaaugaaaaauuccaccagaucgagaaggaauuuagcgagguggaagggcggauucaggaccuugagaaguacguggaggauaccaaaaucgaccuguggucuuauaacgcugaacuccuggucgcgcuggagaaccaacauacaaucgaucucaccgacuccgaaaugaauaagcuguucgagaaaacgaagaaacagcuuagagaaaacgccgaggauaugggaaauggcugcuuuaagauuuaccacaagugugacaacgcuugcaucgggagcauucgcaauggcacauaugaucaugacguguaccgggacgaggcccugaacaauagauuccagaucaaaggaguugaacucaagucuggcuacaaagauuggauucuguggaucuccuuugccaucagcugcuuccuucuguguguggcucuccugggguuuauuaugugggccugccagaagggaaacauccgcuguaauauuugcaucuga

SEQ ID NO: 194674 - RNA, 1701 nt, Artificial Sequence
  derived and/or modified sequence opt5 from hemagglutinin__InfluenzaA__AHL98806
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugguugauggaugguauggcuucagacaccagaacagcgagggccgggggcaggccgcugaccugaaauccacccaaacagccauugaucagaucaauggaaagcucaacagacugauuggcaaaaccaaugaaaaguuccaccagaucgagaaggaauuuagcgagguggaagggcgcauucaggaccuugagaaauacguggaggauacaaagaucgaccuguggucuuauaacgccgaacuccuggucgcucuggagaaccaacauaccaucgaucucacggacuccgaaaugaauaaacuguucgagaagaccaaaaagcagcuucgggaaaacgcggaggauaugggaaauggcugcuuuaagauuuaccacaaaugugacaacgccugcaucgggagcauuagaaauggcacauaugaucaugacguguaccgcgacgaggcucugaacaaucgguuccagaucaagggaguugaacucaaaucuggcuacaaggauuggauucuguggaucuccuuugccaucagcugcuuccuucuguguguggcccuccugggguuuauuaugugggcuugccagaaaggaaacaucagauguaauauuugcaucuga

SEQ ID NO: 194675 - RNA, 1701 nt, Artificial Sequence; identical to SEQ ID NO: 192882
  derived and/or modified sequence opt5 from hemagglutinin__InfluenzaA__AHL98818

SEQ ID NO: 194676 - RNA, 1701 nt, Artificial Sequence; identical to SEQ ID NO: 192892
  derived and/or modified sequence opt5 from hemagglutinin__InfluenzaA__AHL98830

SEQ ID NO: 194677 - RNA, 1701 nt, Artificial Sequence; identical to SEQ ID NO: 192882
  derived and/or modified sequence opt5 from hemagglutinin__InfluenzaA__AHL98842

SEQ ID NO: 194678 - RNA, 1701 nt, Artificial Sequence; identical to SEQ ID NO: 192882
  derived and/or modified sequence opt5 from hemagglutinin__InfluenzaA__AHL98854

SEQ ID NO: 194679 - RNA, 1701 nt, Artificial Sequence
  derived and/or modified sequence opt5 from hemagglutinin__InfluenzaA__AHL98878
augaagaccaucauugcccugagcuacauccucugccugguguucacacagaaacuucccggcaacgacaauuccacggcuacccugugucucgggcaccaugccgucccuaacggaacaauuguuaagaccaucacaaaugauagaauugaggugaccaacgcgacagaacuggugcaaaauucuagcaucggcgagaucugcgacuccccgcaccagauucuugauggggaaaacuguacccugaucgacgcucuccugggagauccccagugcgacggcuuucagaauaaaaagugggaucuguucgucgagcggucuaaagccuauagcaacuguuacccuuaugacgugcccgauuacgccucccuccgcucucugguugcuagcuccgggacgcuugaauuuaauaacgagagcuucaauuggaccggagugacacaaaacggcaccucuuccgccugcauuagacggagcaauucuuccuuuuucagccgccugaacuggcucacacaucugaauuuuaaguauccugcucuuaacgucaccaugcccaacaaugagcaguucgacaagcuguacaucuggggcgugcaccauccugggacggauaaagaccagauuuuucucuaugcccagucuuccggaagaaucacaguuagcaccaagcggucccaacaggcggugauuccgaacaucggcucucgccccagaauccggaauauuccuagccgcaucuccauuuacuggacaaucgucaaacccggggauauucugcugaucaacagcaccggaaaucucaucgccccuagaggcuacuucaagauucggucugggaaauccagcaucaugcgcucugacgcucccauuggaaaguguaagagcgaaugcaucaccccgaacggcuccauuccuaaugacaaacccuuucagaacgugaauagaaucacauauggcgccuguccucgguacgugaagcagucuacgcugaaacuugcuaccgggaugcgcaacguccccgagaagcaaacaagaggaaucuucggcgccauugcgggguuuaucgaaaauggaugggagggcaugguugaugggugguauggauuccggcaccagaacagcgagggcagaggccaggccgcugaccugaaauccacccaagccgcuauugaucagaucaaugggaagcucaaccgccugauuggaaaaacaaaugaaaaguuccaccagaucgagaaggaauuuagcgagguggaaggccggauucaggaccuugagaaauacguggaggauaccaagaucgaccuguggucuuauaacgccgaacuccuggucgcccuggagaaccaacauacgaucgaucucacagacuccgaaaugaauaaacuguucgagaagaccaaaaagcagcuuagagaaaacgcugaggauauggggaauggaugcuuuaagauuuaccacaaaugugacaacgcgugcaucggcagcauucgcaaugggaccuaugaucauaacguguaccgggacgaggcccugaauaacagauuccagaucaagggcguugaacucaaaucuggauacaaggacuggauucuguggaucuccuuugcuaucagcugcuuccuucuguguguggcccuccugggcuuuauuaugugggccugccagaaagggaauauccgcuguaacauuugcaucuga

SEQ ID NO: 194680 - RNA, 1701 nt, Artificial Sequence
  derived and/or modified sequence opt5 from hemagglutinin__InfluenzaA__AHL98890
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugguugauggaugguauggcuucagacaccagaacagcgagggccgggggcaggccgcugaccugaaauccacccaagccgccauugaucagaucaauggaaagcucaacagacugauuggcaaaacaaaugaaaaguuccaccagaucgagaaggaauuuagcgagguggaagggcgcauucaggaccuugagaaauacguggaggauaccaagaucgaccuguggucuuauaacgcugaacuccuggucgcgcuggagaaccaacauacaaucgaucucaccgacuccgaaaugaauaaacuguucgagaagacgaaaaagcagcuucgggaaaacgccgaggauaugggaaauggcugcuuuaagauuuaccacaaaugugacaacgcuugcaucgggagcauuagaaauggcacauaugaucaugacguguaccgcgacgaggcccugaacaaucgguuccagaucaagggaguugaacucaaaucuggcuacaaggauuggauucuguggaucuccuuugccaucagcugccuucugcucuguguggcucugcugggguucauuaugugggccugccagaaaggaaacaucagauguaauauuugcaucuga

SEQ ID NO: 194681 - RNA, 1701 nt, Artificial Sequence
  derived and/or modified sequence opt5 from hemagglutinin__InfluenzaA__AHL98902
augaagaccaucauugcccugagcuacauccucugccugguguucgcucagaaacuucccggcaacgacaauuccacagccacgcugugucucgggcaccaugcggucccuaacggaaccguugugaagacaauuaccaaugauagaaucgaggugacaaacgcuaccgaacugguccaaaauucuagcauuggcgagaucugcgacuccccgcaccagauccuugauggggaaaacuguacacugauugacgcccuccugggagauccccagugcgacggcuuucagaauaaaaagugggaucuguucguggagcggucuaaagccuauagcaacuguuacccuuaugacguucccgauuacgcuucccuccgcucucugguggccagcuccgggacccuugaauuuaauaacgagagcuucaauugggcuggagucacgcaaaacggcaccucuuccgccugcaucagaggcagcaauucuuccuuuuucagccggcugaacuggcucacacaucugaauuuuaaguauccugcgcuuaacgugaccaugcccaacaaugagcaguucgacaagcuguacauuuggggaguucaccauccugggacagauaaagaccagaucuuucucuaugcccagucuuccggccgcauuaccgugagcacgaagagaucccaacaggcugucaucccgaacauugggucucggccccgcaucagaaauaucccuagccggauuuccaucuacuggacaauugugaaacccggagauauccugcugauuaacagcaccggcaaucucaucgccccucgcggguacuucaagaucagaucuggaaaauccagcauuaugcggucugacgcucccaucggcaaguguaagagcgaaugcauuacaccgaacggcuccaucccuaaugacaaacccuuucagaacgugaaucgcauuaccuauggggccuguccuagauacgucaagcagucuacccugaaacuugcgacaggaaugcggaacguucccgagaagcaaacgcgcggcaucuucggggccaucgcuggauuuauugaaaauggcugggaggggaugguggauggaugguauggcuucagacaccagaacagcgagggccgggggcaggccgcugaccugaaauccacccaagccgccaucgaucagauuaauggaaagcucaacagacugaucggcaaaacaaaugaaaaguuccaccagauugagaaggaauuuagcgagguggaagggcgcauccaggaccuugagaaauacgucgaggauaccaagauugaccuguggucuuauaacgcugaacuccugguggcgcuggagaaccaacauacaaucgaucucaccgacuccgaaaugaauaaacuguucgagaagacgaaaaagcagcuucgggaaaacgccgaggauaugggaaauggcugcuuuaagaucuaccacaaaugugacaacgcuugcauugggagcaucagaaauggcacauaugaucaugacguuuaccgcgacgaggcccugaacaaucgguuccagauuaagggaguggaacucaaaucuggcuacaaggauuggauccuguggauuuccuuugccaucagcugcuuccuucugugugucgcucuccugggguuuaucaugugggccugccagaaaggaaacauuagauguaauaucugcauuuga

SEQ ID NO: 194682 - RNA, 1701 nt, Artificial Sequence; identical to SEQ ID NO: 192892
  derived and/or modified sequence opt5 from hemagglutinin__InfluenzaA__AHL98913

SEQ ID NO: 194683 - RNA, 1701 nt, Artificial Sequence; identical to SEQ ID NO: 192882
  derived and/or modified sequence opt5 from hemagglutinin__InfluenzaA__AHL98925

SEQ ID NO: 194684 - RNA, 1701 nt, Artificial Sequence; identical to SEQ ID NO: 193021
  derived and/or modified sequence opt5 from hemagglutinin__InfluenzaA__AHL98937

SEQ ID NO: 194685 - RNA, 1701 nt, Artificial Sequence; identical to SEQ ID NO: 193018
  derived and/or modified sequence opt5 from hemagglutinin__InfluenzaA__AHL98961

SEQ ID NO: 194686 - RNA, 1701 nt, Artificial Sequence
  derived and/or modified sequence opt5 from hemagglutinin__InfluenzaA__AHL98973
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccguggucccgaacauuggcucucgccccagaauccggaauaucccuagccgcauuuccaucuacuggaccauugugaaacccggggauauccugcugauuaacagcacaggaaaucucaucgcuccuagaggcuacuucaagauccggucugggaaauccagcauuaugcgcucugacgcccccaucggaaaguguaagagcgaaugcauuaccccgaacggcuccaucccuaaugacaaacccuuucagaacgugaauagaauuaccuauggcgcuuguccucgguacgucaagcagucuacacugaaacuugccacggggaugcgcaacguucccgagaagcaaaccagaggaaucuucggcgcgaucgccggguuuauugaaaauggaugggagggcaugguggaugggugguauggauuccggcaccagaacagcgagggcagaggccaggcugccgaccugaaauccacacaagcugccaucgaucagauuaaugggaagcucaaccgccugaucggaaaaaccaaugaaaaguuccaccagauugagaaggaauuuagcgagguggaaggccggauccaggaccuugagaaauacgucgaggauacaaagauugaccuguggucuuauaacgccgaacuccugguggcucuggagaaccaacauaccaucgaucucacggacuccgaaaugaauaaacuguucgagaagaccaaaaagcagcuuagagaaaacgcggaggauauggggaauggaugcuuuaagaucuaccacaaaugugacaacgccugcauuggcagcauccgcaaugggacauaugaucaugacguuuaccgggacgaggcucugaacaauagauuccagauuaagggcguggaacucaaaucuggauacaaggauuggauccuguggauuuccuuugccaugagcugcuuccuucugugugucgcccuccugggcuuuaucaugugggcuugccagaaagggaacauccgcuguaauauuugcaucuga

SEQ ID NO: 194687 - RNA, 1701 nt, Artificial Sequence
  derived and/or modified sequence opt5 from hemagglutinin__InfluenzaA__AHL98985
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacaaucauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauugggcuggagugacgcaaaacggcaccucuuccgccugcaucagaggcagcaauucuuccuuuuucagccggcuuaacuggcugacacaucucaauuuuaaguauccugcgcugaacgucaccaugcccaacaaugagcaguucgacaaacuuuacauuuggggagugcaccauccugggacagauaaggaccagaucuuucuguaugcccagucuuccggccgcauuaccguuagcacgaagagaucccaacaggcugugaucccgaacaucgggucucggccccgcauuagaaauaucccuagccggauuuccaucuacuggacaauugucaaacccggagauauccuccugaucaacagcaccggcaaucugauugccccucgcggguacuucaagaucagaucuggaaaauccagcauuaugcggucugacgcucccaucggcaaguguaagagcgaaugcauuacaccgaacggcuccaucccuaaugacaaacccuuucagaacgugaaucgcaucaccuauggggccuguccuagauacgugaagcagucuacccucaaacuggcgacaggaaugcggaacguccccgagaagcaaacgcgcggcauuuucggggccaucgcuggauuuauugaaaauggcugggaggggaugguugauggaugguauggcuucagacaccagaacagcgagggccgggggcaggccgcugaccuuaaauccacccaagccgccaucgaucagauuaauggaaagcugaacagacucaucggcaaaacaaaugaaaaguuccaccagauugagaaggaauuuagcgagguggaagggcgcauccaggaccuggagaaauacguggaggauaccaagaucgaccuuuggucuuauaacgcugaacugcucgucgcgcuggagaaccaacauacaauugaucugaccgacuccgaaaugaauaaacucuucgagaagacgaaaaagcagcugcgggaaaacgccgaggauaugggaaauggcugcuuuaagaucuaccacaaaugugacaacgcuugcauugggagcaucagaaauggcacauaugaucaugacguguaccgcgacgaggcccuuaacaaucgguuccagauuaagggaguugaacugaaaucuggcuacaaggauuggauccucuggaucuccuuugccauuagcugcuuccugcuuuguguggcucugcucggguuuaucaugugggccugccagaaaggaaacauuagauguaauaucugcauuuga

SEQ ID NO: 194688 - RNA, 1701 nt, Artificial Sequence; identical to SEQ ID NO: 193018
  derived and/or modified sequence opt5 from hemagglutinin__InfluenzaA__AHL98997

SEQ ID NO: 194689 - RNA, 1701 nt, Artificial Sequence; identical to SEQ ID NO: 192882
  derived and/or modified sequence opt5 from hemagglutinin__InfluenzaA__AHL99009

SEQ ID NO: 194690 - RNA, 1701 nt, Artificial Sequence; identical to SEQ ID NO: 192892
  derived and/or modified sequence opt5 from hemagglutinin__InfluenzaA__AHL99021

SEQ ID NO: 194691 - RNA, 1701 nt, Artificial Sequence
  derived and/or modified sequence opt5 from hemagglutinin__InfluenzaA__AHL99045
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcaauucuuccuuuuucagccgccuuaacuggcugacccaucucaauuuuaaguauccugcccugaacgucacaaugcccaacaaugagcaguucgacaaacuuuacauuuggggcgugcaccauccugggaccgauaaagaccagaucuuucuguaugcgcagucuuccggaagaauuacgguuagcacaaagcggucccaacaggccgugaucccgaacaucggcucucgcccccggauuagaaauaucccuagccgcauuuccaucuacuggaccauugucaaacccggggauauccuccugaucaacagcacaggaaaucugauugcuccuagaggcuacuucaagauccggucugggaaauccagcauuaugcgcucugacgcccccaucggaaaguguaagagcgaaugcauuaccccgaacggcuccaucccuaaugacaaacccuuucagaacgugaauagaaucaccuauggcccuuguccccgguacgugaagcagucuacacucaaacuggcuacggggaugcgcaacguccccgagaagcaaaccagaggaauuuucggcgccaucgcgggguuuauugaaaauggaugggagggcaugguugaugggugguauggauuccggcaccagaacagcgagggcagaggccaggccgcugaccuuaaauccacacaagccgcuaucgaucagauuaaugggaagcugaaccgccucaucggaaaaaccaaugaaaaguuccaccagauugagaaggaauuuagcgagguggaaggccggauccaggaccuggagaaauacguggaggauacaaagaucgaccuuuggucuuauaacgccgaacugcucgucgcccuggagaaccaacauaccauugaucugacggacuccgaaaugaauaaacucuucgagaagacaaagaagcagcugagagaaaacgcugaggauauggggaauggaugcuuuaagaucuaccacaaaugugacaacgcgugcauuggcagcauccgcaaugggaccuaugaucaugacguguaccgggacgaggcccuuaacaauagauuccagauuaagggcguugaacugaaaucuggauacaaggauuggauccucuggaucuccuuugcuauuagcugcuuccugcuuuguguggcccugcucggcuuuaucaugugggccugccagaaagggaacauucgcuguaauaucugcauuuga

SEQ ID NO: 194692 - RNA, 1701 nt, Artificial Sequence
  derived and/or modified sequence opt5 from hemagglutinin__InfluenzaA__AHL99057
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauuaucgauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauugggcuggagugacgcaaaacggcaccucuuccgccugcaucagaggcagcaauucuuccuuuuucagccggcuuaacuggcugacacaucucaauuuuaaguauccugcgcugaacgucaccaugcccaacaaugagcaguucgacaaacuuuacauuuggggagugcaccauccugggacagauaaggaccagaucuuucuguaugcccagucuuccggccgcauuaccguuagcacgaagagaucccaacaggcugugaucccgaacaucgggucucggccccgcauuagaaauaucccuagccggauuuccaucuacuggacaauugucaaacccggagauauccuccugaucaacagcaccggcaaucugauugccccucgcggguacuucaagaucagaucuggaaaauccagcauuaugcggucugacgcucccaucggcaaguguaagagcgaaugcauuacaccgaacggcuccaucccuaaugacaaacccuuucagaacgugaaucgcaucaccuauggggccuguccuagauacgugaagcagucuacccucaaacuggcgacaggaaugcggaacguccccgagaagcaaacgcgcggcauuuucggggccaucgcuggauuuauugaaaauggcugggaggggaugguugauggaugguauggcuucagacaccagaacagcgagggccgggggcaggccgcugaccuuaaauccacccaagccgccaucgaucagauuaauggaaagcugaacagacucaucggcaaaacaaaugaaaaguuccaccagauugagaaggaauuuagcgagguggaagggcgcauccaggaccuggagaaauacguggaggauaccaagaucgaccuuuggucuuauaacgcugaacugcucgucgcgcuggagaaccaacauacaauugaucugaccgacuccgaaaugaauaaacucuucgagaagacgaaaaagcagcugcgggaaaacgccgaggauaugggaaauggcugcuuuaagaucuaccacaaaugugacaacgcuugcauugggagcaucagaaauggcacauaugaucaugacguguaccgcgacgaggcccuuaacaaucgguuccagauuaagggaguugaacugaaaucuggcuacaaggauuggauccucuggaucuccuuugccauuagcugcuuccugcuuuguguggcucugcucggguuuaucaugugggccugccagaaaggaaacauuagauguaauaucugcauuuga

SEQ ID NO: 194693 - RNA, 1701 nt, Artificial Sequence
  derived and/or modified sequence opt5 from hemagglutinin__InfluenzaA__AHL99069
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauacccugcugauuaacagcacaggcaaucucaucgccccucgcggguacuucaagaucagaucuggaaaauccagcauuaugcggucugacgcucccaucggcaaguguaagagcgaaugcauuaccccgaacggcuccaucccuaaugacaaacccuuucagaacgugaaucgcauuaccuauggggccuguccuagauacgugaagcagucuacacugaaacuugcgacgggaaugcggaacguccccgagaagcaaacccgcggcaucuucggggccaucgcuggauuuauugaaaauggcugggaggggaugguugauggaugguauggcuucagacaccagaacagcgagggccgggggcaggccgcugaccugaaauccacacaagccgccaucgaucagauuaauggaaagcucaacagacugaucggcaaaaccaaugaaaaguuccaccagauugagaaggaauuuagcgagguggaagggcgcauccaggaccuugagaaauacguggaggauacaaagauugaccuguggucuuauaacgcugaacuccuggucgcgcuggagaaccaacauaccaucgaucucacggacuccgaaaugaauaaacuguucgagaagaccaaaaagcagcuucgggaaaacgccgaggauaugggaaauggcugcuuuaagaucuaccacaaaugugacaacgcuugcauugggagcaucagaaauggcacauaugaucauaacguguaccgcgacgaggcccugaauaaccgguuccagauuaagggaguugaacucaaaucuggcuacaaggacuggauccuguggauuuccuuugccaucagcugcuuccuucuguguguggcucuccugggguuuaucaugugggccugccagaaaggaaauauuagauguaacaucugcauuuga

SEQ ID NO: 194694 - RNA, 1701 nt, Artificial Sequence
  derived and/or modified sequence opt5 from hemagglutinin__InfluenzaA__AHL99081
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcaggggacacugaaacuugccacgggaaugcgcaacguccccgagaagcaaaccagaggcaucuucggggcgauugccggauuuaucgaaaauggcugggaggggaugguugauggaugguauggcuuccggcaccagaacucugagggcagagggcaggcugccgaccugaaaagcacacaagcugccauugaucagaucaauggaaagcucaaccgccugauuggcaaaaccaaugaaaaguuccaccagaucgagaaggaauuuuccgagguggaagggcggauucaggaccuugagaaauacguggaggauacaaagaucgaccuguggagcuauaacgccgaacuccuggucgcucuggagaaccaacauaccaucgaucucacggacucugaaaugaauaaacuguucgagaagaccaaaaagcagcuuagagaaaacgcggaggauaugggaaauggcugcuuuaagauuuaccacaaaugugacaacgccugcaucggguccauucgcaauggcacauaugaucauaacguguaccgggacgaggcucugaauaacagauuccagaucaagggaguugaacucaaaagcggcuacaaggacuggauucuguggaucucuuuugccaucuccugcuuccuucuguguguggcccuccugggguuuauuaugugggcuugccagaaaggaaauauccgcuguaacauuugcaucuga

SEQ ID NO: 194695 - RNA, 1701 nt, Artificial Sequence
  derived and/or modified sequence opt5 from hemagglutinin__InfluenzaA__AHL99093
augaagaccaucauugcccugagcuacauccucugccugauuuucgcucagaaacuucccggcaacgacaauuccacagccacgcugugucucgggcaccaugcggugccuaacggaaccaucgucaagacaauuaccaaugauagaaucgagguuacaaacgcuaccgaacuggugcaaaauucuagcaucggcgagauuugcgacuccccgcaccagauccuugauggggaaaacuguacacugauugacgcccuccugggagauccccagugcgacggcuuucagaauaaaaagugggaucuguucguggagcggucuaaagccuauagcaacuguuacccuuaugacguccccgauuacgcuucccuccgcucucugguggccagcuccgggacccuugaauuuaauaacgagagcuucaauuggacgggaguuacccaaaacggcacaucuuccgcuugcaucagacggagcaauucuuccuuuuucagccgccugaacuggcucacccaucugaauuuuaaguauccugcccuuaacgugacaaugcccaacaaugagcaguucgacaagcuguacauuuggggcguccaccauccugggaccgauaaagaccagaucuuucucuaugcgcagucuuccggaagaauuacggugagcacaaagcggucccaacaggccguuaucccgaacaucggcucucgcccccggauuagaaauaucccuagccgcauuuccaucuacuggaccauugugaaacccggggauauccugcugaucaacagcacaggaaaucucauugcuccuagaggcuacuucaagauccggucugggaaauccagcauuaugcgcucugacgcccccaucggaaaguguaagagcgaaugcauuaccccgaacggcuccaucccuaaugacaaacccuuucagaacgucaauagaaucaccuauggcgcuuguccucgguacgugaagcagucuacacugaaacuugccacggggaugcgcaacgugcccgagaagcaaaccagaggaauuuucggcgcgaucgccggguuuauugaaaauggaugggagggcauggucgaugggugguauggauuccggcaccagaacagcgagggcagaggccaggcugccgaccugaaauccacacaagcugccaucgaucagauuaaugggaagcucaaccgccugaucggaaaaaccaaugaaaaguuccaccagauugagaaggaauuuagcgagguugaaggccggauccaggaccuugagaaauacguggaggauacaaagaucgaccuguggucuuauaacgccgaacuccugguggcucuggagaaccaacauaccauugaucucacggacuccgaaaugaauaaacuguucgagaagaccaaaaagcagcuuagagaaaacgcggaggauauggggaauggaugcuuuaagaucuaccacaaaugugacaacgccugcauuggcagcauccgcaaugggacauaugaucauaacgucuaccgggacgaggcucugaauaacagauuccagauuaagggcguggaacucaaaucuggauacaaggacuggauccuguggaucuccuuugccauuagcugcuuccuucuguguguugcccuccugggcuuuaucaugugggcuugccagaaagggaauauuaaguguaacaucugcauuuga

SEQ ID NO: 194696 - RNA, 1701 nt, Artificial Sequence; identical to SEQ ID NO: 192882
  derived and/or modified sequence opt5 from hemagglutinin__InfluenzaA__AHL99117

SEQ ID NO: 194697 - RNA, 1701 nt, Artificial Sequence
  derived and/or modified sequence opt5 from hemagglutinin__InfluenzaA__AHL99129
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagucuacacugaaacuugccacggggaugcgcaacguccccgagaagcaaaccagaggaaucuucggcgcgauugccggguuuaucgaaaauggaugggagggcaugguugaugggugguauggauuccggcaccagaacagcgagggcagaggccaggcugccgaccugaaauccacacaagcugccauugaucagaucaaugggaagcucaaccgccugauuggaaaaaccaaugaaaaguuccaccagaucgagaaggaauuuagcgagguggaaggccggauucaggacaucgagaaauacguggaggauacaaagaucgaccuuuggucuuauaacgccgaacugcucgucgcucuggagaaccaacauaccauugaucugacggacuccgaaaugaauaaacucuucgagaagaccaaaaagcagcugagagaaaacgcggaggauauggggaauggaugcuuuaagaucuaccacaaaugugacaacgccugcauuggcagcauccgcaaugggacauaugaucauaacguguaccgggacgaggcucuuaauaacagauuccagauuaagggcguugaacugaaaucuggauacaaggacuggauccucuggaucuccuuugccauuagcugcuuccugcuuuguguggcccugcucggcuuuaucauuugggcuugccagaaagggaauauccgcuguaacauuugcaucuga

SEQ ID NO: 194698 - RNA, 1701 nt, Artificial Sequence
  derived and/or modified sequence opt5 from hemagglutinin__InfluenzaA__AHL99141
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacccuugaauuuaauaacgagagcuucaauuggacgggagugacccagaacggcacaucuuccgcuugcauucgcagaagcaauucuuccuuuuucagccggcugaacuggcucacccaucuggacuuuaaguauccugcccuuaaugucacaaugcccaacaacgagcaguucgauaagcuguacaucuggggcgugcaccauccugggaccgacaaagaucagauuuuucucuaugcgcaaucuuccggacgcaucacgguuagcacaaagagaucccagcaggccgugauuccgaauaucggcucucggccccgcaucagaaacauuccuagccggaucuccauuuacuggaccaucgucaaacccggggacauucugcugaucaauagcacaggaaaccucaucgcuccucgcggcuacuucaagauuagaucugggaaauccagcaucaugcggucugacgcccccauuggaaaguguaagagcgaaugcaucaccccgaauggcuccauuccuaacgauaaacccuuucagaaugugaaccgcaucaccuauggcgcuuguccuagauacgugaagcaaucuacacugaaacuugccacggggaugcggaauguccccgagaagcagacccgcggaaucuucggcgcgauugccggguuuaucgaaaacggaugggagggcaugguugacgggugguauggauucagacaccagaauagcgagggccggggccaagcugccgaucugaaauccacacaggcugccauugaccagaucaacgggaagcucaauagacugauuggaaaaaccaacgaaaaguuccaccagaucgagaaggaauuuagcgagguggaaggccgcauucaagaucuugagaaauacguggaggacacaaagaucgaucuguggucuuauaaugccgaacuccuggucgcucuggagaaccagcauaccaucgaccucacggauuccgaaaugaacaaacuguucgagaagaccaaaaagcagcuucgggaaaaugcggaggacauggggaacggaugcuuuaagauuuaccacaaaugugauaaugccugcaucggcagcauuagaaacgggacauaugaccaugacguguaccgcgaugaggcucugaauaaccgguuccagaucaagggcguugaacucaaaucuggauacaaggacuggauucuguggaucuccuuugccaucagcugcuuccuucuguguguggcccuccugggcuuuauuaugugggcuugccaaaaagggaauaucagauguaacauuugcaucuga

SEQ ID NO: 194699 - RNA, 1701 nt, Artificial Sequence
  derived and/or modified sequence opt5 from hemagglutinin__InfluenzaA__AHL99153
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugacaccgaacauugggucucggccccgcaucagagauaucccuagccggauuuccaucuacuggaccauugucaaacccggagacauccugcugauuaauagcacaggcaaccucaucgccccucgcggguacuucaagaucagaucuggaaaauccagcauuaugcggucugacgcucccaucggcaaguguaagagcgaaugcauuaccccgaauggcuccaucccuaacgauaaacccuuucagaaugugaaccgcauuaccuauggggccuguccuagauacgugaagcagucuacacugaaacuugcgacgggaaugcggaauguccccgagaagcaaacccgcggcaucuucggggccaucgcuggauuuauugaaaacggcugggaggggaugauggacggaugguauggcuucagacaccagaauagcgagggccgggggcaggccgcugaucugaaauccacacaagccgccaucgaccagauuaacggaaagcucaauagacugaucggcaaaaccaacgaaaaguuccaccagauugagaaggaauuuagcgagguugaagggcgcauccaggaucuugagaaauacguggaggacacaaagauugaucuguggucuuauaaugcugaacuccugguggcgcuggagaaccaacauaccaucgaccucacggauuccgaaaugaacaaacuguucgagaagaccaaaaagcagcuucgggaaaaugccgaggacaugggaaacggcugcuuuaagaucuaccacaaaugugauaaugcuugcauugggagcaucagaaacggcacauaugaccaugacgucuaccgcgaugaggcccugaauaaccgguuccagauuaagggaguggaacucaaaucuggcuacaaggacuggauccuguggauuuccuuugccaucagcugcuuccuucuguguguugcucuccugggguuuaucaugugggccugccagaaaggaaauauuagauguaacaucugcauuuga

SEQ ID NO: 194700 - RNA, 1701 nt, Artificial Sequence; identical to SEQ ID NO: 193021
  derived and/or modified sequence opt5 from hemagglutinin__InfluenzaA__AHL99165

SEQ ID NO: 194701 - RNA, 1701 nt, Artificial Sequence; identical to SEQ ID NO: 193506
  derived and/or modified sequence opt5 from hemagglutinin__InfluenzaA__AHL99177

SEQ ID NO: 194702 - RNA, 1701 nt, Artificial Sequence; identical to SEQ ID NO: 192882
  derived and/or modified sequence opt5 from hemagglutinin__InfluenzaA__AHL99189

SEQ ID NO: 194703 - RNA, 1701 nt, Artificial Sequence; identical to SEQ ID NO: 193018
  derived and/or modified sequence opt5 from hemagglutinin__InfluenzaA__AHL99225

SEQ ID NO: 194704 - RNA, 1701 nt, Artificial Sequence; identical to SEQ ID NO: 193491
  derived and/or modified sequence opt5 from hemagglutinin__InfluenzaA__AHL99237

SEQ ID NO: 194705 - RNA, 1701 nt, Artificial Sequence; identical to SEQ ID NO: 192892
  derived and/or modified sequence opt5 from hemagglutinin__InfluenzaA__AHL99249

SEQ ID NO: 194706 - RNA, 1701 nt, Artificial Sequence; identical to SEQ ID NO: 192882
  derived and/or modified sequence opt5 from hemagglutinin__InfluenzaA__AHL99261

SEQ ID NO: 194707 - RNA, 1701 nt, Artificial Sequence; identical to SEQ ID NO: 193021
  derived and/or modified sequence opt5 from hemagglutinin__InfluenzaA__AHL99273

SEQ ID NO: 194708 - RNA, 1701 nt, Artificial Sequence
  derived and/or modified sequence opt5 from hemagglutinin__InfluenzaA__AHL99285
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucagucugggaaauccagcaucaugcggucugacgcccccauuggaaaguguaagagcgaaugcaucaccccgaacggcuccauuccuaaugacaaacccuuucagaacgugaaucgcaucaccuauggcgcuuguccuagauacgugaagcaaucuacacugaaacuugccacggggaugcggaacguccccgagaagcagacccgcggaaucuucggcgcgauugccggguuuaucgaaaauggaugggagggcaugguugaugggugguauggauucagacaccagaacagcgagggccggggccaagcugccgaccugaaauccacacaggcugccauugaucagaucaaugggaagcucaacagacugauuggaaaaaccaaugaaaaguuccaccagaucgagaaggaauuuagcgagguggaaggccgcauucaagaccuugagaaauacguggaggauacaaagaucgaccuguggucuuauaacgccgaacuccuggucgcucuggagaaccagcauaccaucgaucucacggacuccgaaaugaauaaacuguucgagaagaccaaaaagcagcuucgggaaaacgcggaggauauggggaauggaugcuuuaagauuuaccacaaaugugacaacgccugcaucggcagcauuagaaaugggacauaugaucauaacguguaccgcgacgaggcucugaauaaccgguuccagaucaagggcguugaacucaaaucuggauacaaggacuggauucuguggaucuccuuugccaucagcugcuuccuucuguguguggcccuccugggcuuuauuaugugggcuugccaaaaagggaauaucagauguaacauuugcaucuga

SEQ ID NO: 194709 - RNA, 1701 nt, Artificial Sequence; identical to SEQ ID NO: 193047
  derived and/or modified sequence opt5 from hemagglutinin__InfluenzaA__AHL99297

SEQ ID NO: 194710 - RNA, 1701 nt, Artificial Sequence; identical to SEQ ID NO: 192892
  derived and/or modified sequence opt5 from hemagglutinin__InfluenzaA__AHL99309

SEQ ID NO: 194711 - RNA, 1701 nt, Artificial Sequence
  derived and/or modified sequence opt5 from hemagglutinin__InfluenzaA__AHL99321
augaagaccaucauugcccugagcuacauccucugccugguguucacacagaaacuucccggcaacgacaauuccacggcuacccugugucucgggcaccaugccgucccuaacggaacaauuguuaagaccaucacaaaugaucaaauugaggugaccaacgcgacagaacuggugcaaaauucuagcaucggcgagaucugcgacuccccgcaccagauucuugauggggaaaacuguacccugaucgacgcucuccugggagauccccagugcgacggcuuucagaauaaaaagugggaucuguucgucgagagaucuaaagccuauagcaacuguuacccuuaugacgugcccgauuacgccucccuccggucucugguugcuagcuccgggacgcuugaauuuaauaacgagagcuucaauugggccggagugacccagaacggcacaucuuccgcuugcauucgcggcagcaauucuuccuuuuucagcagacugaacuggcucacccaucugaauuuuaaguauccugcccuuaacgucacaaugcccaacaaugagcaguucgacaagcuguacaucuggggagugcaccauccugggaccgauaaagaccagauuuuucucuaugcgcaaucuuccggccggaucacgguuagcacaaagcgcucccagcaggccgugauuccgaacaucgggucuagaccccggauccgcaauauuccuagcagaaucuccauuuacuggaccaucgucaaacccggagauauucugcugaucaacagcacaggcaaucucaucgcuccucggggguacuucaagauucgcucuggaaaauccagcaucaugagaucugacgcccccauuggcaaguguaagagcgaaugcaucaccccgaacggcuccauuccuaaugacaaacccuuucagaacgugaaucggaucaccuauggggcuuguccucgcuacgugaagcaaucuacacugaaacuugccacgggaaugagaaacguccccgagaagcagacccggggcaucuucggggcgauugccggauuuaucgaaaauggcugggaggggaugguugauggaugguauggcuuccgccaccagaacagcgagggcagagggcaagcugccgaccugaaauccacacaggcugccauugaucagaucaauggaaagcucaaccggcugauuggcaaaaccaaugaaaaguuccaccagaucgagaaggaauuuagcgagguggaagggcgcauucaagaccuugagaaauacguggaggauacaaagaucgaccuguggucuuauaacgccgaacuccuggucgcucuggagaaccagcauaccaucgaucucacggacuccgaaaugaauaaacuguucgagaagaccaaaaagcagcuuagagaaaacgcggaggauaugggaaauggcugcuuuaagauuuaccacaaaugugacaacgccugcaucgggagcauucggaauggcacauaugaucaugacguguacagagacgaggcucugaacaaucgcuuccagaucaagggaguugaacucaaaucuggcuacaaggauuggauucuguggaucuccuuugccaucagcugcuuccuucuguguguggcccuccugggguuuauuaugugggcuugccaaaaaggaaacauccgguguaauauuugcaucuga

SEQ ID NO: 194712 - RNA, 1701 nt, Artificial Sequence
  derived and/or modified sequence opt5 from hemagglutinin__InfluenzaA__AHL99333
augaagaccaucauugcccugagcuacauccucugccugguguucgcucaggagcuucccggcaacgacgauuccacagccacgcugugucucgggcaccaugcggucccuaauggaaccauuguuaaaacaaucaccaacgaccaaauugaagugacaaaugcuaccgagcuggugcagucuagcuccacaggcgaaaucugcaacucuccgcaccagauccuugauggggagaauuguacccugauugacgcccuccugggagauccccagugcgacggcuuucaaaacaagaaaugggaucuguucgucgaaagaagcaaggcccauuccaauuguuauccuuacgacgugcccgauuaugcuucucuccggagccugguugccuccagcgggacgcuugaguuuaacaaugagucuuucaacuggaccggagugacacagaauggcaccuccagcgcuugcauccgcagaucuaacaauuccuuuuucagccggcugaacuggcucacacaccugaauuuuaaauacccugcccuuaacgucaccaugcccaacaaugaacaguucgacaagcuguauauuuggggcgugcaucacccugggacggauaaggaccagaucuuucucuacgcgcaagccucuggacgcauuacaguuuccaccaaaagaagccagcaggcugugaucccgaacauuggcucccggccccgcgucagaaauaucccuucucgggugagcaucuauuggacaauugugaagcccggggauauccugcugauuaacuccaccggaaaucucaucgccccucgcggcuacuucaaaauuagaagcgggaagucuuccaucaugcggagcgacgcucccaucggaaaauguaacucugccugcauuaccccgaauggcagcaucccuaacgacaagcccuuucagaaugucaaccgcauuacauacggcgcguguccuagauauguuaagcaaaauacgcugaaacuugccaccgggaugcggaacgugcccgagaagcagacacgcggaaucuucggcgcuauugccggguuuaucgaaaauggaugggagggcaugguggaugggugguacggauucagacaccagaacuccgagggccggggccaagcugccgaccugaaaucuacccaggccgcuaucgaucagauuaaugggaagcucaacagacugaucggaaaaacaaacgaaaaguuccaucagauugagaaagaauuuagcgaggucgaaggccgcauccaagaccuugagaaguauguggaggauaccaagauugaccugugguccuacaaugcggaacuccugguugcccuggagaaccagcacacgaucgaucucacagacagcgaaaugaauaaacuguucgagaagaccaaaaagcagcuucgggaaaacgcugaggauauggggaauggaugcuuuaaaauuuaucauaagugugacaacgccugcaucggcucuaucagaaaugggaccuacgaucacaacguguaucgcgacgaggcccugaauaaccgguuccagauuaagggcgucgaacucaaauccggauacaaggacuggauccuguggauuagcuuugcuaucucuugcuuccuucuguguguggcccuccugggcuuuauuaugugggcgugccaaaaagggaauaucagauguaacaucugcauuuga

SEQ ID NO: 194713 - RNA, 1701 nt, Artificial Sequence
  derived and/or modified sequence opt5 from hemagglutinin__InfluenzaA__AHL99356
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacagccgaccaacagucucucuaccagaaugcugaugccuacguguucgugggcaccagcaaguauuccaaaaaguuuaaaccugagauugcuaucagaccgaagguccgggaccaggaggggcgcaugaacuacuauuggacgcugauugaacccggagauaaaaucacauucgaggccaccggcaaccugguugugccuagauacgcguuugccauggaacggaaugcugggagcggaauuaucaucucugacacacccgugcaugauugcaacaccaccugucaaacaccugagggcgccauuaauacgucccuccccuuccagaacauccacccgauuaccaucggcaagugcccuaaguaugucaaaagcacaaagcugcgccuugcuaccgggcugagaaaugugcccucuauucagagccggggacucuuuggcgccaucgccggguucaucgaaggaggcuggacagggaugguugacggaugguacggcuaucaucaccagaacgagcaaggcuccggguacgcugcggaccugaaaucuacccagaaugccauugauaagaucacgaacaaagugaauagcgucauugagaagaugaacacacaguuuaccgcugugggaaaggaguucaaucaccuugagaaacgcaucgaaaaccugaauaagaaaguugacgauggcuuccucgacauuuggaccuacaacgccgagcugcuggugcuccuggaaaaugagagaacacuugauuaucaugacuccaacgucaagaaccuguacgagaaagugcggaaucagcucaagaacaaugccaaggaaaucgggaacggauguuuugaguucuaucacaaaugcgauaauaccuguauggaaagcgucaagaacggcacauacgacuauccuaaauacucugaggaagcuaagcugaaucgcgagaaaaucgauggggugaaacuugaguccacgagaauuuaucaaauccuggccauuuacagcaccguugcgucuucccucgugcuggucgugagccugggcgcuaucuccuuuuggaugugcucuaacggaagccuccagugccggauuuguaucuga

SEQ ID NO: 194714 - RNA, 1701 nt, Artificial Sequence; identical to SEQ ID NO: 192907
  derived and/or modified sequence opt5 from hemagglutinin__InfluenzaA__AHL99367

SEQ ID NO: 194715 - RNA, 1701 nt, Artificial Sequence
  derived and/or modified sequence opt5 from hemagglutinin__InfluenzaA__AHL99379
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaagugcaacaucgccggguggauucugggaaauccugagugugaaucucugagcacagccuccucuuggagcuacaucguggagaccuccggcucugacaacgggacgugcuauccgggagauuuuauugacuacgaggagcuccgggagcagcugagcuccgucagcucuuucgaacgcuuugagaucuuccccaagaccuccagcuggccuaaucacgauucuaacaagggcgugacagccgcuuguccccaugccggcgcgaaaggguuuuauaagaaucuuaucuggcugguuaaaaagggaaacuccuacccuaaacucagcauuucuuauaucaaugacaagggcaaggaagugcugguccuuugggggauucaccaccccuccaccacagccgaucaacagagccuguaccagaacgcugacaccuacguguucgugggaacguccagauauucuaaaaaguuuaaaccugagaucgccauucggccgaagguccgcgaucaggagggcagaaugaauuacuauuggacacucguugaacccggggacaaaaucaccuucgaggcuacaggaaaccugguggugccucgguacgccuuugcgauggaacgcaacgccggcagcggcauuaucaucuccgauacccccguccaugacugcaauaccacaugucaaacgccuaagggggcuauuaacaccagccugcccuuccagaauauccacccgauuacaaucggaaaaugcccuaaguaugugaagucuaccaaacucagacuggccacaggccuucggaacguucccuccauucagagccgcgggcuguuuggagcuaucgccggcuucaucgaagggggauggaccggcaugguggacggcugguacggguaucaucaccagaaugaacaaggaucuggcuacgccgcugaucucaagagcacgcagaacgcgauugacaaaaucacaaauaaggucaacuccgugauugagaaaaugaauacccaguuuaccgccguugggaaggaguucaaccaccuggaaaagagaaucgagaaucuuaacaaaaagguggaugacggauuccuggauauuuggacauacaaugcugaacuccugguccugcucgagaacgaacggacccuggacuaucaugauucuaaugugaaaaaccuuuacgagaagguccgcaaccagcugaaaaauaacgccaaggagaucggcaauggguguuuugaguucuaucacaagugcgacaacacauguauggaaagcgugaaaaauggcacguacgauuauccuaaguacuccgaagaggccaaacucaacagagaaaagaucgacggaguuaaacuggagagcacccggauuuaucaaauccuugcuauuuacucuacagccgcguccagccuggugcucgucgugucucugggcgcuaucuccuuuuggaugugcagcaaugggucccugcagugccgcauuuguaucuga

SEQ ID NO: 194716 - RNA, 1701 nt, Artificial Sequence; identical to SEQ ID NO: 194708
  derived and/or modified sequence opt5 from hemagglutinin__InfluenzaA__AHL99390

SEQ ID NO: 194717 - RNA, 1701 nt, Artificial Sequence; identical to SEQ ID NO: 192882
  derived and/or modified sequence opt5 from hemagglutinin__InfluenzaA__AHL99402

SEQ ID NO: 194718 - RNA, 1701 nt, Artificial Sequence
  derived and/or modified sequence opt5 from hemagglutinin__InfluenzaA__AHL99426
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaugaugcgcucugacgcccccaucggaaaguguaagagcgaaugcauuaccccgaacggcuccaucccuaaugacaaacccuuucagaacgugaauagaauuaccuauggcgcuuguccucgguacgugaagcagucuacacugaaacuugccacggggaugcgcaacguccccgagaagcaaaccagaggaaucuucggcgcgaucgccggguuuauugaaaauggaugggagggcaugguugaugggugguauggauuccggcaccagaacagcgagggcagaggccaggcugccgaccugaaauccacacaagcugccaucgaucagauuaaugggaagcucaaccgccugaucggaaaaaccaaugaaaaguuccaccagauugagaaggaauuuagcgagguggaaggccggauccaggaccuugagaaauacguggaggauacaaagauugaccuguggucuuauaacgccgaacuccuggucgcucuggagaaccaacauaccaucgaucucacggacuccgaaaugaauaaacuguucgagaagaccaaaaagcagcuuagagaaaacgcggaggauauggggaauggaugcuuuaagaucuaccacaaaugugacaacgccugcauuggcagcauccgcaaugggacauaugaucaugacguguaccgggacgaggcucugaacaauagauuccagauuaagggcguugaacucaaaucuggauacaaggauuggauccuguggauuuccuuugccaucagcugcuuccuucuguguguggcccuccugggcuuuaucaugugggcuugccagaaagggaacauucgcuguaauaucugcauuuga

SEQ ID NO: 194719 - RNA, 1701 nt, Artificial Sequence
  derived and/or modified sequence opt5 from hemagglutinin__InfluenzaA__AHL99438
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucagucugggaaauccagcaucaugcggucugacgcccccauuggaaaguguaagagcgaaugcaucaccccgaacggcuccauuccuaaugacaaacccuuucagaacgugaaucgcaucaccuauggcgcuuguccuagauacgugaagcaaucuacacugaaacuugccacggggaugcggaacguccccgagaagcagacccgcggaaucuucggcgcgauugccggguuuaucgaaaauggaugggagggcaugguugaugggugguauggauucagacaccagaacagcgagggccggggccaagcugccgaccugaaauccacacaggcugccauugaucagaucaaugggaagcucaacagacugauuggaaaaaccaaugaaaaguuccaccagaucgagaaggaauuuagcgagguggaaggccgcauucaagaccuugagaaauacguggaggauacaaagaucgaccuguggucuuauaacgccgaacuccuggucgcucuggagaaccagcauaccaucgaucucacggacuccgaaaugaauaaacuguucgagaagaccaaaaagcagcuucgggaaaacgcggaggauauggggaauggaugcuuuaagauuuaccacaaaugugacaacgccugcaucggcagcauuagaaaugggacauaugaucaugacguguaccgcgacgaggcucugaacaaucgguuccagaucaagggcguugaacucaaaucuggauacaaggauuggauucuguggaucuccuuugccaucagcugcuuccuucuguguguggcccuccugggcuuuauuaugugggcuugccaaaaagggaacaucagauguaauauuugcaucuga

SEQ ID NO: 194720 - RNA, 1701 nt, Artificial Sequence; identical to SEQ ID NO: 193018
  derived and/or modified sequence opt5 from hemagglutinin__InfluenzaA__AHL99450

SEQ ID NO: 194721 - RNA, 1701 nt, Artificial Sequence; identical to SEQ ID NO: 193491
  derived and/or modified sequence opt5 from hemagglutinin__InfluenzaA__AHL99462

SEQ ID NO: 194722 - RNA, 1701 nt, Artificial Sequence; identical to SEQ ID NO: 193021
  derived and/or modified sequence opt5 from hemagglutinin__InfluenzaA__AHL99474

SEQ ID NO: 194723 - RNA, 1701 nt, Artificial Sequence; identical to SEQ ID NO: 193047
  derived and/or modified sequence opt5 from hemagglutinin__InfluenzaA__AHL99486

SEQ ID NO: 194724 - RNA, 1701 nt, Artificial Sequence; identical to SEQ ID NO: 193018
  derived and/or modified sequence opt5 from hemagglutinin__InfluenzaA__AHL99498

SEQ ID NO: 194725 - RNA, 1701 nt, Artificial Sequence; identical to SEQ ID NO: 192882
  derived and/or modified sequence opt5 from hemagglutinin__InfluenzaA__AHL99510

SEQ ID NO: 194726 - RNA, 1701 nt, Artificial Sequence; identical to SEQ ID NO: 192882
  derived and/or modified sequence opt5 from hemagglutinin__InfluenzaA__AHL99522

SEQ ID NO: 194727 - RNA, 1701 nt, Artificial Sequence; identical to SEQ ID NO: 192907
  derived and/or modified sequence opt5 from hemagglutinin__InfluenzaA__AHL99534

SEQ ID NO: 194728 - RNA, 1701 nt, Artificial Sequence; identical to SEQ ID NO: 192882
  derived and/or modified sequence opt5 from hemagglutinin__InfluenzaA__AHL99546

SEQ ID NO: 194729 - RNA, 1701 nt, Artificial Sequence; identical to SEQ ID NO: 192882
  derived and/or modified sequence opt5 from hemagglutinin__InfluenzaA__AHL99558

SEQ ID NO: 194730 - RNA, 1701 nt, Artificial Sequence
  derived and/or modified sequence opt5 from hemagglutinin__InfluenzaA__AHL99570
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcuccuguuacccuuaugacgugcccgauuacgcuucucuccgcagccugguugccuccagcgggacccuugaauuuaacaaugagucuuucaacuggacgggagugacccaaaauggcacauccagcgcuugcauuagacggucuaacuccagcuuuuucucucgccugaauuggcucacccaucugaacuuuaaguauccugcccuuaaugucacaaugcccaacaacgagcaguucgacaagcuguacaucuggggcgugcaccauccugggaccgauaaagaccagauuuuucucuaugcgcaguccagcggaagaaucacgguuuccacaaagcggucucaacaggccgugauuccgaauaucggcagccgccccagaauccggaacauuccuucccgcaucagcauuuacuggaccaucgucaaacccggggauauucugcugaucaauucuacaggaaaccucaucgcuccuagaggcuacuucaagauucgguccgggaaaagcucuaucaugcgcagcgacgcccccauuggaaaguguaaguccgaaugcaucaccccgaauggcucuauuccuaacgacaaacccuuucagaaugugaacagaaucaccuauggcgcuuguccucgguacaucaagcagagcacacugaaacuugccacggggaugcgcaaugugcccgagaagcaaaccagaggaauuuucggcgcgaucgccggguuuauugaaaacggaugggagggcauggucgaugggugguauggauuccggcaccaaaauuccgagggcagaggccaggcugccgaccugaaaagcacacaggcugccaucgaucagauuaacgggaagcucaaucgccugaucggaaaaaccaacgaaaaguuccaccagauugagaaggaauuuucugagguugaaggccggauccaggaccuugagaaauacguggaggauacaaagaucgaccugugguccuauaaugccgaacuccugguggcucuggagaaccaacauaccauugaucucacggacagcgaaaugaacaaacuguucgagaagaccaaaaagcagcuuagagaaaaugcggaggauauggggaacggaugcuuuaagaucuaccacaaaugugacaaugccugcauuggcucuauccgcaacgggacauaugaucaugacgucuaccgggacgaggcucugaauaacagauuccagauuaagggcguggaacucaaauccggauacaaggauuggauccuguggaucagcuuugccauuuccugcuuccuucuguguguugcccuccugggcuuuaucaugugggcuugccagaaagggaauauucgcuguaacaucugcauuuga

SEQ ID NO: 194731 - RNA, 1701 nt, Artificial Sequence; identical to SEQ ID NO: 192882
  derived and/or modified sequence opt5 from hemagglutinin__InfluenzaA__AHL99582

SEQ ID NO: 194732 - RNA, 1701 nt, Artificial Sequence
  derived and/or modified sequence opt5 from hemagglutinin__InfluenzaA__AHL99594
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaagugcaacaucgccggguggauucugggaaauccugagugugaaucucugagcacagccuccucuuggagcuacaucguggagaccuccggcucugacaacgggacgugcuauccgggagauuuuauugacuacgaggagcuccgggagcagcugagcuccgucagcucuuucgaacgcuuugagaucuuccccaagaccuccagcuggccuaaucacgauucuaacaagggcgugacagccgcuugucccagagccggcgcgaaaggguuuuauaagaaucuuaucuggcugguuaaaaagggaaacuccuacccuaaacucagcauuucuuauaucaaugacaagggcaaggaagugcugguccuuugggggauucaucaccccuccaccacagccgaucaacagagccuguaccagaacgcugacaccuacguguucgugggaacgucccgguauucuaaaaaguuuaaaccugagaucgccauucgcccgaaggucagagaucaggagggccggaugaauuacuauuggacacucguugaacccggggacaaaaucaccuucgaggcuacaggaaaccugguggugccucgcuacgccuuugcgauggaaagaaacgccggcagcggcauuaucaucuccgauacccccguccacgacugcaauaccacaugucaaacgccuaagggggcuauuaacaccagccugcccuuccagaauauccauccgauuacaaucggaaaaugcccuaaguaugugaagucuaccaaacuccggcuggccacaggccuucgcaacguucccuccauucagagcagagggcuguuuggagcuaucgccggcuucaucgaagggggauggaccggcaugguggacggcugguacggguaucaccaucagaaugaacaaggaucuggcuacgccgcugaucucaagagcacgcagaacgcgauugacaaaaucacaaauaaggucaacuccgugauugagaaaaugaauacccaguuuaccgccguugggaaggaguucaaccaccuggaaaagcggaucgagaaucuuaacaaaaagguggaugacggauuccuggauauuuggacauacaaugcugaacuccugguccugcucgagaacgaacgcacccuggacuaucacgauucuaaugugaaaaaccuuuacgagaaggucagaaaccagcugaaaaauaacgccaaggagaucggcaauggguguuuugaguucuaucauaagugcgacaacacauguauggaaagcgugaaaaauggcacguacgauuauccuaaguacuccgaagaggccaaacucaaccgggaagagaucgacggaguuaagcuggagagcacccgcauuuaucaaauccuugcuauuuacucuacagccgcguccagccuggugcucgucgugucucugggcgcuaucuccuuuuggaugugcagcaaugggucccugcagugcagaauuuguaucuga

SEQ ID NO: 194733 - RNA, 1701 nt, Artificial Sequence; identical to SEQ ID NO: 193491
  derived and/or modified sequence opt5 from hemagglutinin__InfluenzaA__AHL99605

SEQ ID NO: 194734 - RNA, 1701 nt, Artificial Sequence; identical to SEQ ID NO: 193021
  derived and/or modified sequence opt5 from hemagglutinin__InfluenzaA__AHL99617

SEQ ID NO: 194735 - RNA, 1701 nt, Artificial Sequence; identical to SEQ ID NO: 192882
  derived and/or modified sequence opt5 from hemagglutinin__InfluenzaA__AHL99629

SEQ ID NO: 194736 - RNA, 1701 nt, Artificial Sequence
  derived and/or modified sequence opt5 from hemagglutinin__InfluenzaA__AHL99641
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccguggucccgaacauuggcucucgccccagaauccggaauaucccuagccgcauuuccaucuacuggaccauugugaaacccggggauauccugcugauuaacagcacaggaaaucucaucgcuccuagaggcuacuucaagauccggucugggaaauccagcauuaugcgcucugacgcccccaucggaaaguguaagagcgaaugcauuaccccgaacggcuccaucccuaaugacaaacccuuucagaacgugaauagaauuaccuauggcgcuuguccucgguacgucaagcagucuacacugaaacuugccacggggaugcgcaacguucccgagaagcaaaccagaggaaucuucggcgcgaucgccggguuuauugaaaauggaugggagggcaugguggaugggugguauggauuccggcaccagaacagcgagggcagaggccaggcugccgaccugaaauccacacaagcugccaucgaucagauuaaugggaagcucaaccgccugaucggaaaaaccaaugaaaaguuccaccagauugagaaggaauuuagcgagguggaaggccggauccaggaccuugagaaauacgucgaggauacaaagauugaccuguggucuuauaacgccgaacuccugguggcucuggagaaccaacauaccaucgaucucacggacuccgaaaugaauaaacuguucgagaagaccaaaaagcagcuuagagaaaacgcggaggauauggggaauggaugcuuuaagaucuaccacaaaugugacaacgccugcauuggcagcauccgcaaugggacauauaaccaugauguuuaccgggacgaggcucugaauaacagauuccagauuaagggcguggaacucaaaucuggauacaaggacuggauccuguggauuuccuuugccaugagcugcuuccuucugugugucgcccuccugggcuuuaucaugugggcuugccagaaagggaauauccgcuguaacauuugcaucuga

SEQ ID NO: 194737 - RNA, 1701 nt, Artificial Sequence
  derived and/or modified sequence opt5 from hemagglutinin__InfluenzaA__AHL99665
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacaucaagcagucuacacugaaacuugccacggggaugcgcaacgugcccgagaagcaaaccagaggaauuuucggcgcgaucgccggguuuauugaaaauggaugggagggcauggucgaugggugguauggauuccggcaccagaacagcgagggcagaggccaggcugccgaccugaaauccacacaagcugccaucgaucagauuaaugggaagcucaaccgccugaucggaaaaaccaaugaaaaguuccaccagauugagaaggaauuuagcgagguugaaggccggauccaggaccuugagaaauacguggaggauacaaagaucgaccuguggucuuauaacgccgaacuccugguggcucuggagaaccaacauaccauugaucucacggacuccgaaaugaauaaacuguucgagaagaccaaaaagcagcuuagagaaaacgcggaggauauggggaauggaugcuuuaagaucuaccacaaaugugacaacgccugcauuggcagcauccgcaaugggacauaugaucaugacgucuaccgggacgaggcucugaacaauagauuccagauuaagggcguggaacucaaaucuggauacaaggauuggauccuguggaucuccuuugccauuagcugcuuccuucuguguguugcccuccugggcuuuaucaugugggcuugccagaaagggaacauucgcuguaauaucugcauuuga

SEQ ID NO: 194738 - RNA, 1701 nt, Artificial Sequence; identical to SEQ ID NO: 192882
  derived and/or modified sequence opt5 from hemagglutinin__InfluenzaA__AHL99677

SEQ ID NO: 194739 - RNA, 1701 nt, Artificial Sequence; identical to SEQ ID NO: 192882
  derived and/or modified sequence opt5 from hemagglutinin__InfluenzaA__AHL99689

SEQ ID NO: 194740 - RNA, 1701 nt, Artificial Sequence
  derived and/or modified sequence opt5 from hemagglutinin__InfluenzaA__AHL99701
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugacaccgaacauugggucucggccccgcaucagaaauaucccuagccggauuuccaucuacuggaccauugucaaacccggagauauccugcugauuaacagcacaggcaaucucaucgccccucgcggguacuucaagaucagaucuggaaaauccagcauuaugcggucugacgcucccaucggcaaguguaagagcgaaugcauuaccccgaacggcuccaucccuaaugacaaacccuuucagaacgugaaucgcauuaccuauggggccuguccuagauacgugaagcagucuacacugaaacuugcgacgggaaugcggaacguccccgagaagcaaacccgcggcaucuucggggccaucgcuggauuuauugaaaauggcugggaggggaugauggauggaugguauggcuucagacaccagaacagcgagggccgggggcaggccgcugaccugaaauccacacaagccgccaucgaucagauuaauggaaagcucaacagacugaucggcaaaaccaaugaaaaguuccaccagauugagaaggaauuuagcgagguugaagggcgcauccaggaccuugagaaauacguggaggauacaaagauugaccuguggucuuauaacgcugaacuccugguggcgcuggagaaccaacauaccaucgaucucacggacuccgaaaugaauaaacuguucgagaagaccaaaaagcagcuucgggaaaacgccgaggauaugggaaauggcugcuuuaagaucuaccacaaaugugacaacgcuugcauugggagcaucagaaauggcacauaugaucaugacgucuaccgcgacgaggcccugaacaaucgguuccagauuaagggaguggaacucaaaucuggcuacaaggauuggauccuguggauuuccuuugccaucagcugcuuccuucuguguguugcucuccugggguuuaucaugugggccugccagaaaggaaacauuagauguaauaucugcauuuga

SEQ ID NO: 194741 - RNA, 1701 nt, Artificial Sequence
  derived and/or modified sequence opt5 from hemagglutinin__InfluenzaA__AHL99713
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacaccucccuccgcucucugguugcuagcuccgggacgcuugaauuuaauaacgagagcuucaauuggaccggagugacacaaaacggcaccucuuccgccugcauuagacggagcaauucuuccuuuuucagccgccugaacuggcucacacaucugaauuuuaaguauccugcucuuaacgucaccaugcccaacaaugagcaguucgacaagcuguacaucuggggcgugcaccauccugggacggauaaagaccagauuuuucucuaugcccagucuuccggaagaaucacaguuagcaccaagcggucccaacaggcggugauuccgaacaucggcucucgccccagaauccggaauauuccuagccgcaucuccauuuacuggacaaucgucaaacccggggauauucugcugaucaacagcaccggaaaucucaucgccccuagaggcuacuucaagauucggucugggaaauccagcaucaugcgcucugacgcucccauuggaaaguguaagagcgaaugcaucaccccgaacggcuccauuccuaaugacaaacccuuucagaacgugaauagaaucacauauggcgccuguccucgguacgugaagcagucuacgcugaaacuugcuaccgggaugcgcaacguccccgagaagcaaacaagaggaaucuucggcgccauugcgggguuuaucgaaaauggaugggagggcaugguugaugggugguauggauuccggcaccagaacagcgagggcagaggccaggccgcugaccugaaauccacccaagccgcuauugaucagaucaaugggaagcucaaccgccugauuggaaaaacaaaugaaaaguuccaccagaucgagaaggaauuuagcgagguggaaggccggauucaggaccuugagaaauacguggaggauaccaagaucgaccuguggucuuauaacgccgaacuccuggucgcccuggagaaccaacauacgaucgaucucacagacuccgaaaugaauaaacuguucgagaagaccaaaaagcagcuuagagaaaacgcugaggauauggggaauggaugcuuuaagauuuaccacaaaugugacaacgcgugcaucggcagcauucgcaaugggaccuaugaucaugacguguaccgggacgaggcccugaacaauagauuccagaucaagggcguugaacucaaaucuggauacaaggauuggauucuguggaucuccuuugcuaucacaugcuuccuucuguguguggcccuccugggcuuuauuaugugggccugccagaaagggaacauccgcuguaauauuugcaucuga

SEQ ID NO: 194742 - RNA, 1701 nt, Artificial Sequence; identical to SEQ ID NO: 192882
  derived and/or modified sequence opt5 from hemagglutinin__InfluenzaA__AHL99725

SEQ ID NO: 194743 - RNA, 1701 nt, Artificial Sequence; identical to SEQ ID NO: 193084
  derived and/or modified sequence opt5 from hemagglutinin__InfluenzaA__AHL99737

SEQ ID NO: 194744 - RNA, 1701 nt, Artificial Sequence; identical to SEQ ID NO: 192882
  derived and/or modified sequence opt5 from hemagglutinin__InfluenzaA__AHL99748

SEQ ID NO: 194745 - RNA, 1701 nt, Artificial Sequence; identical to SEQ ID NO: 192882
  derived and/or modified sequence opt5 from hemagglutinin__InfluenzaA__AHL99760

SEQ ID NO: 194746 - RNA, 1701 nt, Artificial Sequence; identical to SEQ ID NO: 192892
  derived and/or modified sequence opt5 from hemagglutinin__InfluenzaA__AHL99772

SEQ ID NO: 194747 - RNA, 1701 nt, Artificial Sequence; identical to SEQ ID NO: 192907
  derived and/or modified sequence opt5 from hemagglutinin__InfluenzaA__AHL99784

SEQ ID NO: 194748 - RNA, 1701 nt, Artificial Sequence; identical to SEQ ID NO: 193047
  derived and/or modified sequence opt5 from hemagglutinin__InfluenzaA__AHL99796

SEQ ID NO: 194749 - RNA, 1701 nt, Artificial Sequence; identical to SEQ ID NO: 192882
  derived and/or modified sequence opt5 from hemagglutinin__InfluenzaA__AHL99808

SEQ ID NO: 194750 - RNA, 1701 nt, Artificial Sequence
  derived and/or modified sequence opt5 from hemagglutinin__InfluenzaA__AHL99820
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagucuacacugaaacuugccacggggaugcgcaacguccccgagaagcaaaccagaggaaucuucggcgcgauugccggguuuaucgaaaauggaugggagggcaugguugaugggugguauggauuccggcaccagaacagcgacggcagaggccaggcugccgaucugaaauccacacaagcugccauugaccagaucaaugggaagcucaaccgccugauuggaaaaaccaaugagaaguuccaccagaucgaaaaggaguuuagcgaaguggagggccggauucaggaucuugaaaaauacguggaggacacaaagaucgaucuguggucuuauaacgccgagcuccuggucgcucuggaaaaccaacauaccaucgaccucacggauuccgagaugaauaaacuguucgaaaagaccaaaaagcagcuuagagagaacgcggaagacauggggaauggaugcuuuaagauuuaccacaaaugugauaacgccugcaucggcagcauucgcaaugggacauaugaccaugacguguaccgggaugaggcucugaacaauagauuccagaucaagggcguugagcucaaaucuggauacaaggacuggauucuguggaucuccuuugccaucagcugcuuccuucugugugugguccuccugggcuuuauuaugugggccugccagaaagggaacauccgcuguaauauuugcaucuga

SEQ ID NO: 194751 - RNA, 1701 nt, Artificial Sequence; identical to SEQ ID NO: 192882
  derived and/or modified sequence opt5 from hemagglutinin__InfluenzaA__AHL99832

SEQ ID NO: 194752 - RNA, 1701 nt, Artificial Sequence; identical to SEQ ID NO: 192907
  derived and/or modified sequence opt5 from hemagglutinin__InfluenzaA__AHL99844

SEQ ID NO: 194753 - RNA, 1701 nt, Artificial Sequence; identical to SEQ ID NO: 192859
  derived and/or modified sequence opt5 from hemagglutinin__InfluenzaA__AHL99856

SEQ ID NO: 194754 - RNA, 1701 nt, Artificial Sequence
  derived and/or modified sequence opt5 from hemagglutinin__InfluenzaA__AHL99868
augaagaccaucauugcccugagcuacauccucugccugguguucgcucaggagcuucccggcaacgacgauuccacagccacgcugugucucgggcaccaugcggucccuaauggaaccauuguuaaaacaaucaccaacgaccaaauugaagugacaaaugcuaccgagcuggugcagucuagcuccacaggcgaaaucugcaacucuccgcaccagauccuugauggggagaauuguacccugauugacgcccuccugggagauccccagugcgacggcuuucaaaacaagaaaugggaucuguucgucgaaagaagcaaggcccauuccaauuguuauccuuacgacgugcccgauuaugcuucucuccggagccugguugccuccagcgggacgcuugaguuuaacaaugagucuuucaacuggaccggagugacacagaauggcaccuccagcgcuugcauccgcagaucuaacaauuccuuuuucagccggcugaacuggcucacacaccugaauuuuaaauacccugcccuuaacgucaccaugcccaacaaugaacaguucgacaagcuguauauuuggggcgugcaucacccugggacggauaaggaccagaucuuucucuacgcgcaagccucuggacgcauuacaguuuccaccaaaaagagccagcaggcugugaucccgaacauuggcuccagaccccggguccgcaauaucccuucuagagugagcaucuauuggacaauugugaaacccggggauauccugcugauuaacuccaccggaaaucucaucgccccucggggcuacuucaagauucgcagcgggaaaucuuccaucaugagaagcgacgcucccaucggaaaguguaacucugccugcauuaccccgaauggcagcaucccuaacgacaagcccuuucagaaugucaaccggauuacauacggcgcguguccucgcuauguuaaacaaaauacgcugaaacuugccaccgggaugagaaacgugcccgagaagcagacacggggaaucuucggcgcuauugccggguuuaucgaaaauggaugggagggcaugguggaugggugguacggauuccgccaccagaacuccgagggcagaggccaagcugccgaccugaagucuacccaggccgcuaucgaucagauuaaugggaaacucaaccggcugaucggaaagacaaacgaaaaauuccaucagauugagaaggaauuuagcgaggucgaaggcagaauccaagaccuugagaaguauguggaggauaccaaaauugaccugugguccuacaaugcggaacuccugguugcccuggagaaccagcacacgaucgaucucacagacagcgaaaugaauaagcuguucgagaaaaccaagaaacagcuucgcgaaaacgcugaggauauggggaauggaugcuuuaagauuuaucauaagugugacaacgccugcaucggcucuauccggaaugggaccuacgaucacgacguguauagagacgaggcccugaacaaucgcuuccagauuaaaggcgucgaacucaaguccggauacaaagauuggauccuguggauuagcuuugcuaucucuugcuuccuucuguguguggcccuccugggcuuuauuaugugggcgugccaaaaggggaacauccgguguaauaucugcauuuga

SEQ ID NO: 194755 - RNA, 1701 nt, Artificial Sequence; identical to SEQ ID NO: 193021
  derived and/or modified sequence opt5 from hemagglutinin__InfluenzaA__AHL99880

SEQ ID NO: 194756 - RNA, 1701 nt, Artificial Sequence; identical to SEQ ID NO: 192882
  derived and/or modified sequence opt5 from hemagglutinin__InfluenzaA__AHL99892

SEQ ID NO: 194757 - RNA, 1701 nt, Artificial Sequence; identical to SEQ ID NO: 193018
  derived and/or modified sequence opt5 from hemagglutinin__InfluenzaA__AHL99904

SEQ ID NO: 194758 - RNA, 1701 nt, Artificial Sequence
  derived and/or modified sequence opt5 from hemagglutinin__InfluenzaA__AHL99916
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagaugagaucuggaaaauccagcauuaugcggucugacgcucccaucggcaaguguaagagcgaaugcauuacaccgaacggcuccaucccuaaugacaaacccuuucagaacgugaaucgcauuaccuauggggccuguccuagauacgugaagcagucuacccugaaacuugcgacaggaaugcggaacguccccgagaagcaaacgcgcggcaucuucggggccaucgcuggauuuauugaaaauggcugggaggggaugauggauggaugguauggcuucagacaccagaacagcgagggccgggggcaggccgcugaccugaaauccacccaagccgccaucgaucagauuaauggaaagcucaacagacugaucggcaaaacaaaugaaaaguuccaccagauugagaaggaauuuagcgagguugaagggcgcauccaggaccuugagaaauacguggaggauaccaagauugaccuguggucuuauaacgcugaacuccugguggcgcuggagaaccaacauacaaucgaucucaccgacuccgaaaugaauaaacuguucgagaagacgaaaaagcagcuucgggaaaacgccgaggauaugggaaauggcugcuuuaagaucuaccacaaaugugacaacgcuugcauugggagcaucagaaauggcacauaugaucaugacgucuaccgcgacgaggcccugaacaaucgguuccagauuaagggaguggaacucaaaucuggcuacaaggauuggauccuguggauuuccuuugccaucagcugcuuccuucuguguguugcucuccugggguuuaucaugugggccugccagaaaggaaacauuagauguaauaucugcauuuga

SEQ ID NO: 194759 - RNA, 1701 nt, Artificial Sequence; identical to SEQ ID NO: 192907
  derived and/or modified sequence opt5 from hemagglutinin__InfluenzaA__AHL99928

SEQ ID NO: 194760 - RNA, 1701 nt, Artificial Sequence
  derived and/or modified sequence opt5 from hemagglutinin__InfluenzaA__AHL99940
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagucuacacugaaacuugccacggggaugcgcaacguccccgagaagcaaaccagaggaaucuucggcgcgauugccggguuuaucgaaaauggaugggagggcaugguugaugggugguauggauuccggcaccagaacagcgagggcagaggccaggcugccgaccugaaauccacacaagcugccauugaucagaucaaugggaagcucaaccgccugauuggaaaaaccaaugaaaaguuccaccagaucgagaaggaauuuagcggcguggaggggcggauucaggaccuugaaaaauacguggaggauacaaagaucgaccuguggucuuauaacgccgagcuccuggucgcucuggaaaaccaacauaccaucgaucucacggacuccgagaugaauaaacuguucgaaaagaccaaaaagcagcuuagagagaacgcggaagauaugggaaauggcugcuuuaagauuuaccacaaaugugacaacgccugcaucgggagcauucgcaauggcacauaugaucaugacguguaccgggacgaggcucugaacaauagauuccagaucaagggaguugagcucaaaucuggcuacaaggauuggauucuguggaucuccuuugccaucagcugcuuccuucuguguguggcccuccugggguuuauuaugugggcuugccagaaaggaaacauccgcuguaauauuugcaucuga

SEQ ID NO: 194761 - RNA, 1701 nt, Artificial Sequence; identical to SEQ ID NO: 192882
  derived and/or modified sequence opt5 from hemagglutinin__InfluenzaA__AHL99952

SEQ ID NO: 194762 - RNA, 1701 nt, Artificial Sequence; identical to SEQ ID NO: 192907
  derived and/or modified sequence opt5 from hemagglutinin__InfluenzaA__AHL99964

SEQ ID NO: 194763 - RNA, 1701 nt, Artificial Sequence; identical to SEQ ID NO: 192907
  derived and/or modified sequence opt5 from hemagglutinin__InfluenzaA__AHL99976

SEQ ID NO: 194764 - RNA, 1701 nt, Artificial Sequence; identical to SEQ ID NO: 192907
  derived and/or modified sequence opt5 from hemagglutinin__InfluenzaA__AHL99988

SEQ ID NO: 194765 - RNA, 1701 nt, Artificial Sequence; identical to SEQ ID NO: 192882
  derived and/or modified sequence opt5 from hemagglutinin__InfluenzaA__AHM00001

SEQ ID NO: 194766 - RNA, 1701 nt, Artificial Sequence; identical to SEQ ID NO: 192882
  derived and/or modified sequence opt5 from hemagglutinin__InfluenzaA__AHM00013

SEQ ID NO: 194767 - RNA, 1701 nt, Artificial Sequence; identical to SEQ ID NO: 192892
  derived and/or modified sequence opt5 from hemagglutinin__InfluenzaA__AHM00025

SEQ ID NO: 194768 - RNA, 1701 nt, Artificial Sequence; identical to SEQ ID NO: 192907
  derived and/or modified sequence opt5 from hemagglutinin__InfluenzaA__AHM00037

SEQ ID NO: 194769 - RNA, 1701 nt, Artificial Sequence; identical to SEQ ID NO: 192907
  derived and/or modified sequence opt5 from hemagglutinin__InfluenzaA__AHM00061

SEQ ID NO: 194770 - RNA, 1701 nt, Artificial Sequence; identical to SEQ ID NO: 192882
  derived and/or modified sequence opt5 from hemagglutinin__InfluenzaA__AHM00073

SEQ ID NO: 194771 - RNA, 1701 nt, Artificial Sequence; identical to SEQ ID NO: 192882
  derived and/or modified sequence opt5 from hemagglutinin__InfluenzaA__AHM00085

SEQ ID NO: 194772 - RNA, 1701 nt, Artificial Sequence
  derived and/or modified sequence opt5 from hemagglutinin__InfluenzaA__AHM00097
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaauuccuauauuaacgacaagggaaaggaagugcuuguccuguggggcauccaccaccccagcaccacagccgaucaacagucccucuaccagaaugcugacaccuacguguucguggggacgucuagauauagcaaaaaguuuaaaccugagauugccauccggccgaagguccgcgaucaggagggaagaaugaacuacuauuggacacugguugaacccggcgacaaaauuaccuucgaggcuacagggaaccugguggugccucgguacgccuuugcgauggaacgcaaugccggauccggcaucauuaucagcgauaccaccguccaugacugcaacacaacgugucaaacccccaagggcgcuaucaauacaucucucccuuuccagaacauucaccccaucaccauugggaaaugcccgaaguaugugaaguccacaaaacugagacuugccaccggacugcggaauguuccuagcauccagucucgcggccucuuuggggcuauugccggauucaucgagggcggguggacgggaaugguggacggcugguacggcuaucaucaccagaacgaacaagggagcggauacgccgcugaucugaaguccacacagaaugcgaucgacaaaauuaccaacaaggucaauucugugaucgagaaaaugaacacccaguuuacagccguuggcaaggaguucaaucaccuugaaaagagaauugagaaccugaauaaaaagguggaugacggguuccucgauaucuggaccuacaacgcugaacugcugguccuccuggagaaugaacggacacuugacuaucaugauagcaacgugaaaaaccuguacgagaagguccgcaaucagcucaaaaacaaugccaaggagauuggaaacggcuguuuugaguucuaucacaagugcgacaauauguguauggaguccgugaaaaacgggacguacgauuaucccaaguacagcgaagaggccaaacugaauagagaaaagaucgacggcguuaaacuugagucuacccggaucuaucaaauucuggcuaucuacuccacaguggccagcucucucguccuggugguuucccugggagcgauuagcuuuuggaugugcuccaacggcucucuccagugccgcaucuguauuuga

SEQ ID NO: 194773 - RNA, 1701 nt, Artificial Sequence; identical to SEQ ID NO: 192907
  derived and/or modified sequence opt5 from hemagglutinin__InfluenzaA__AHM00108

SEQ ID NO: 194774 - RNA, 1701 nt, Artificial Sequence; identical to SEQ ID NO: 192907
  derived and/or modified sequence opt5 from hemagglutinin__InfluenzaA__AHM00120

SEQ ID NO: 194775 - RNA, 1701 nt, Artificial Sequence
  derived and/or modified sequence opt5 from hemagglutinin__InfluenzaA__AHM00132
augaagaccaucauugcccugagcuacauccucugccugguguucgcucaggagcuucccggcaacgacgauuccacagccacgcugugucucgggcaccaugcggucccuaauggaaccauuguuaaaacaaucaccaacgaccaaauugaagugacaaaugcuaccgagcuggugcagucuagcuccacaggcgaaaucugcaacucuccgcaccagauccuugauggggagaauuguacccugauugacgcccuccugggagauccccagugcgacggcuuucaaaacaagaaaugggaucuguucgucgaaagaagcaaggcccauuccaauuguuauccuuacgacgugcccgauuaugcuucucuccggagccugguugccuccagcgggacgcuugaguuuaacaaugagucuuucaacuggaccggagugacacagaauggcaccuccagcgcuugcauccgcagaucuaacaauuccuuuuucagccggcugaacuggcucacacaccugaauuuuaaauacccugcccuuaacgucaccaugcccaacaaugaacaguucgacaagcuguauauuuggggcgugcaucacccugggacggauaaggaccagaucucucucuacgcgcaagccuccggacgcauuacaguuagcaccaaaagaucccagcaggcugugaucccgaacauuggcucucggccccgcgucagaaauaucccuagccggguguccaucuauuggacaauugugaagcccggggauauccugcugauuaacagcaccggaaaucucaucgccccucgcggcuacuuuaaaauuagaucugggaaguccagcaucaugcggucugacgcucccaucggaaaauguaacagcgccugcauuaccccgaauggcuccaucccuaacgacaagcccuuccagaaugucaaccgcauuacauacggcgcguguccuagauauguuaagcaaaauacgcugaaacuugccaccgggaugcggaacgugcccgagaagcagacacgcggaaucuuuggcgcuauugccggguucaucgaaaauggaugggagggcaugguggaugggugguacggauuuagacaccagaacucugagggccggggccaagcugccgaccugaaaagcacccaggccgcuaucgaucagauuaaugggaagcucaacagacugaucggaaaaacaaacgaaaaguuccaucagauugagaaagaguucuccgaagucgaaggccgcauccaagaccuugagaaguauguggaggauaccaagauugaccuguggagcuacaaugcggaacuccugguugcccuggagaaccagcacacgaucgaucucacagacucugaaaugaauaaacuguuugagaagaccaaaaagcagcuucgggaaaacgcugaggauauggggaauggaugcuucaaaauuuaucauaagugugacaacgccugcaucggcuccaucagaaaugggaccuacgaucacgacguguaucgcgacgaggcccugaacaaucgguuucagauuaagggcgucgaacucaaaagcggauacaaggauuggauccuguggauuucuuucgcuaucuccugcuuucuucuguguguggcccuccugggcuucauuaugugggcgugccaaaaagggaacaucagauguaauaucugcauuuga

SEQ ID NO: 194776 - RNA, 1701 nt, Artificial Sequence; identical to SEQ ID NO: 192882
  derived and/or modified sequence opt5 from hemagglutinin__InfluenzaA__AHM00144

SEQ ID NO: 194777 - RNA, 1701 nt, Artificial Sequence; identical to SEQ ID NO: 192907
  derived and/or modified sequence opt5 from hemagglutinin__InfluenzaA__AHM00156

SEQ ID NO: 194778 - RNA, 1701 nt, Artificial Sequence; identical to SEQ ID NO: 192882
  derived and/or modified sequence opt5 from hemagglutinin__InfluenzaA__AHM00168

SEQ ID NO: 194779 - RNA, 1701 nt, Artificial Sequence
  derived and/or modified sequence opt5 from hemagglutinin__InfluenzaA__AHM00180
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacaacccgcaccagauucuugauggggaaaauuguacacugaucgacgcccuccugggagauccccagugcgacggcuuucagaacaaaaagugggaucuguucgucgagcgguccaaagccuauucuaauuguuacccuuaugacgugcccgauuacgcuagccuccgcucccugguugccucuagcgggacccuugaauuuaacaaugaguccuucaacuggacgggagugacccaaaauggcacaagcucugcuugcauuagacgguccaacagcuccuuuuucucucgccugaauuggcucacccaucugaacuuuaaguauccugcccuuaacgucacaaugcccaauaacgagcaguucgacaagcuguacaucuggggcgugcaccauccugggaccgauaaagaccagauuuuucucuaugcgcagagcucuggaagaaucacgguuuccacaaagcggagccaacaggccgugauuccgaauaucggcucccgccccagaauccggaacauuccuucucgcaucagcauuuacuggaccaucgucaaacccggggauauucugcugaucaauuccacaggaaaccucaucgcuccuagaggcuacuucaagauucggagcgggaaaucuuccaucaugcgcagcgacgcccccauuggaaaguguaagucugaaugcaucaccccgaauggcagcauuccuaacgacaaacccuuucagaaugugaacagaaucaccuauggcgcuuguccucgguacgugaagcaguccacacugaaacuugccacggggaugcgcaauguccccgagaagcaaaccagaggaaucuucggcgcgauugccggguuuaucgaaaacggaugggagggcaugguugaugggugguauggauuccggcaccaaaauucugagggcagaggccaggcugccgaccugaaaagcacacaggcugccauugaucagaucaacgggaagcucaaucgccugauuggaaaaaccaacgaaaaguuccaccagaucgagaaggaauuuuccgagguggaaggccggauucaggaccuugagaaauacguggaggauacaaagaucgaccuguggagcuauaacgccgaacuccuggucgcucuggagaaucaacauaccaucgaucucacggacucugaaaugaacaaacuguucgagaagaccaaaaagcagcuuagagaaaaugcggaggauauggggaacggaugcuuuaagauuuaccacaaaugugacaaugccugcaucggcuccauucgcaacgggacauaugaucauaauguguaccgggacgaggcucugaacaauagauuccagaucaagggcguugaacucaaaagcggauacaaggacuggauucuguggaucucuuuugccaucuccugcuuccuucuguguguggcccuccugggcuuuauuaugugggcuugccagaaagggaacauccgcuguaauauuugcaucuga

SEQ ID NO: 194780 - RNA, 1701 nt, Artificial Sequence; identical to SEQ ID NO: 192859
  derived and/or modified sequence opt5 from hemagglutinin__InfluenzaA__AHM00192

SEQ ID NO: 194781 - RNA, 1701 nt, Artificial Sequence; identical to SEQ ID NO: 192907
  derived and/or modified sequence opt5 from hemagglutinin__InfluenzaA__AHM00204

SEQ ID NO: 194782 - RNA, 1701 nt, Artificial Sequence; identical to SEQ ID NO: 192907
  derived and/or modified sequence opt5 from hemagglutinin__InfluenzaA__AHM00216

SEQ ID NO: 194783 - RNA, 1701 nt, Artificial Sequence; identical to SEQ ID NO: 192882
  derived and/or modified sequence opt5 from hemagglutinin__InfluenzaA__AHM00228

SEQ ID NO: 194784 - RNA, 1701 nt, Artificial Sequence; identical to SEQ ID NO: 192882
  derived and/or modified sequence opt5 from hemagglutinin__InfluenzaA__AHM00240

SEQ ID NO: 194785 - RNA, 1701 nt, Artificial Sequence; identical to SEQ ID NO: 192882
  derived and/or modified sequence opt5 from hemagglutinin__InfluenzaA__AHM00252

SEQ ID NO: 194786 - RNA, 1701 nt, Artificial Sequence; identical to SEQ ID NO: 192882
  derived and/or modified sequence opt5 from hemagglutinin__InfluenzaA__AHM00264

SEQ ID NO: 194787 - RNA, 1701 nt, Artificial Sequence; identical to SEQ ID NO: 192859
  derived and/or modified sequence opt5 from hemagglutinin__InfluenzaA__AHM00276

SEQ ID NO: 194788 - RNA, 1701 nt, Artificial Sequence; identical to SEQ ID NO: 192882
  derived and/or modified sequence opt5 from hemagglutinin__InfluenzaA__AHM00288

SEQ ID NO: 194789 - RNA, 1701 nt, Artificial Sequence; identical to SEQ ID NO: 192882
  derived and/or modified sequence opt5 from hemagglutinin__InfluenzaA__AHM00300

SEQ ID NO: 194790 - RNA, 1701 nt, Artificial Sequence; identical to SEQ ID NO: 192907
  derived and/or modified sequence opt5 from hemagglutinin__InfluenzaA__AHM00312

SEQ ID NO: 194791 - RNA, 1701 nt, Artificial Sequence; identical to SEQ ID NO: 192859
  derived and/or modified sequence opt5 from hemagglutinin__InfluenzaA__AHM00324

SEQ ID NO: 194792 - RNA, 1701 nt, Artificial Sequence; identical to SEQ ID NO: 192859
  derived and/or modified sequence opt5 from hemagglutinin__InfluenzaA__AHM00336

SEQ ID NO: 194793 - RNA, 1701 nt, Artificial Sequence; identical to SEQ ID NO: 192907
  derived and/or modified sequence opt5 from hemagglutinin__InfluenzaA__AHM00348

SEQ ID NO: 194794 - RNA, 1701 nt, Artificial Sequence
  derived and/or modified sequence opt5 from hemagglutinin__InfluenzaA__AHM00360
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacccuugaauuuaauaacgagagcuucaauuggacgggagugacccagaacggcacaucuuccgcuugcauucgcagaagcaauucuuccuuuuucagccggcugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcaaucuuccggacgcaucacgguuagcacaaagagaucccagcaggccgugauuccgaacaucggcucucggccccgcaucagaaauauuccuagccggaucuccauuuacuggaccaucgucaaacccggggauauucugcugaucaacagcacaggaaaucucaucgcuccucgcggcuacuucaagauuagaucugggaaauccagcaucaugcggucugacgcccccauuggaaaguguaagagcgaaugcaucaccccgaacggcuccauuccuaaugacaaacccuuucagaacgugaaucgcaucaccuauggcgcuuguccuagauacgugaagcaaucuacacugaaacuugccacggggaugcggaacguccccgagaagcagacccgcggaaucuucggcgcgauugccggguuuaucgaaaauggaugggagggcaugguugaugggugguauggauucagacaccagaacagcgagggccggggccaagcugccgaccugaaauccacacaggcugccauugaucagaucaaugggaagcucaacagacugauuggaaaaaccaaugaaaaguuccaccagaucgagaaggaauuuagcgagguggaaggccgcauucaagaccuugagaaauacguggaggauacaaagaucgaccuguggucuuauaacgccgaacuccuggucgcucuggagaaccagcauaccaucgaucucacggacuccgaaaugaauaaacuguucgagaagaccaaaaagcagcuucgggaaaacgcggaggauauggggaauggaugcuuuaagauuuaccacaaaugugacaacgccugcaucggcagcauuagaaaugggacauaugaucaugacguguaccgcgacgaggcucugaacaaucgguuccagaucaagggcguugaacucaaaucuggauacaaggauuggauucuguggaucuccuuugccaucagcugcuuccuucuguguguggcccuccugggcuuuauuaugugggcuugccaaaaagggaacaucagauguaauauuugcaucuga

SEQ ID NO: 194795 - RNA, 1701 nt, Artificial Sequence; identical to SEQ ID NO: 192907
  derived and/or modified sequence opt5 from hemagglutinin__InfluenzaA__AHM00372

SEQ ID NO: 194796 - RNA, 1701 nt, Artificial Sequence; identical to SEQ ID NO: 192907
  derived and/or modified sequence opt5 from hemagglutinin__InfluenzaA__AHM00395

SEQ ID NO: 194797 - RNA, 1701 nt, Artificial Sequence; identical to SEQ ID NO: 192882
  derived and/or modified sequence opt5 from hemagglutinin__InfluenzaA__AHM00407

SEQ ID NO: 194798 - RNA, 1701 nt, Artificial Sequence; identical to SEQ ID NO: 192882
  derived and/or modified sequence opt5 from hemagglutinin__InfluenzaA__AHM00419

SEQ ID NO: 194799 - RNA, 1701 nt, Artificial Sequence; identical to SEQ ID NO: 192882
  derived and/or modified sequence opt5 from hemagglutinin__InfluenzaA__AHM00443

SEQ ID NO: 194800 - RNA, 1701 nt, Artificial Sequence; identical to SEQ ID NO: 192907
  derived and/or modified sequence opt5 from hemagglutinin__InfluenzaA__AHM00455

SEQ ID NO: 194801 - RNA, 1701 nt, Artificial Sequence; identical to SEQ ID NO: 192907
  derived and/or modified sequence opt5 from hemagglutinin__InfluenzaA__AHM00467

SEQ ID NO: 194802 - RNA, 1701 nt, Artificial Sequence; identical to SEQ ID NO: 192907
  derived and/or modified sequence opt5 from hemagglutinin__InfluenzaA__AHM00479

SEQ ID NO: 194803 - RNA, 1701 nt, Artificial Sequence; identical to SEQ ID NO: 192907
  derived and/or modified sequence opt5 from hemagglutinin__InfluenzaA__AHM00491

SEQ ID NO: 194804 - RNA, 1701 nt, Artificial Sequence; identical to SEQ ID NO: 192882
  derived and/or modified sequence opt5 from hemagglutinin__InfluenzaA__AHM00503

SEQ ID NO: 194805 - RNA, 1701 nt, Artificial Sequence; identical to SEQ ID NO: 192882
  derived and/or modified sequence opt5 from hemagglutinin__InfluenzaA__AHM00515

SEQ ID NO: 194806 - RNA, 1701 nt, Artificial Sequence
  derived and/or modified sequence opt5 from hemagglutinin__InfluenzaA__AHM00527
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuccgaucggcgagaucugcgacagcccccaccagauucuugauggggaaaacuguacacugaucgacgcccuccugggagauccucagugcgacggcuuucagaauaaaaagugggaucuguucgucgagcgguccaaagccuauucuaacuguuaccccuaugacgugccugauuacgcuagccuccgcucccugguugccucuagcgggacccuugaauuuaauaacgaguccuucaauuggacgggagugacccaaaacggcacaagcucugcuugcauuagacgguccaauagcuccuuuuucucucgccugaacuggcucacccaucugaauuuuaaguaucccgcccuuaacgucacaaugccuaacaaugagcaguucgacaagcuguacaucuggggcgugcaccauccggggaccgauaaagaccagauuuuucucuaugcgcagagcucuggaagaaucacgguuuccacaaagcggagccaacaggccgugauucccaacaucggcucccgcccuagaauccggaauauucccucucgcaucagcauuuacuggaccaucgucaaaccuggggauauucugcugaucaacuccacaggaaaucucaucgcucccagaggcuacuucaagauucggagcgggaaaucuuccaucaugcgcagcgacgccccgauuggaaaguguaagucugaaugcaucaccccuaacggcagcauucccaaugacaaaccuuuucagaacgugaauagaaucaccuauggcgcuuguccccgguacgugaagcaguccacacugaaacuugccacggggaugcgcaacguccccgagaagcaaaccagaggaaucuucggcgcgauugccggguuuaucgaaaauggaugggagggcaugguugaugggugguauggauuccggcaccagaacucugagggcagaggccaggcugccgaccugaaaagcacacaagcugccauugaucagaucaaugggaagcucaaccgccugauuggaaaaaccaaugaaaaguuccaccagaucgagaaggaauuuuccgagguggaaggccggauucaggaccuugagaaauacguggaggauacaaagaucgaccuguggagcuauaacgccgaacuccuggucgcucuggagaaccaacauaccaucgaucucacggacucugaaaugaauaaacuguucgagaagaccaaaaagcagcuuagagaaaacgcggaggauauggggaauggaugcuuuaagauuuaccacaaaugugacaacgccugcaucggcuccauucgcaaugggacauaugaucauaacguguaccgggacgaggcucugaauaacagauuccagaucaagggcguugaacucaaaagcggauacaaggacuggauucuguggaucucuuuugccaucuccugcuuccuucuguguguggcccuccugggcuuuauuaugugggcuugccagaaagggaauauccgcuguaacauuugcaucuga

SEQ ID NO: 194807 - RNA, 1701 nt, Artificial Sequence; identical to SEQ ID NO: 192859
  derived and/or modified sequence opt5 from hemagglutinin__InfluenzaA__AHM00539

SEQ ID NO: 194808 - RNA, 1701 nt, Artificial Sequence
  derived and/or modified sequence opt5 from hemagglutinin__InfluenzaA__AHM00543
augaagaccaucauugcccugagcuacauccucugccugguguucgcucaggagcuucccggcaacgacgauuccacagccacgcugugucucgggcaccaugcggucccuaauggaaccauuguuaaaacaaucaccaacgaccaaauugaagugacaaaugcuaccgagcuggugcagucuagcuccacaggcgaaaucugcaacucuccgcaccagauccuugauggggagaauuguacccugauugacgcccuccugggagauccccagugcgacggcuuucaaaacaagaaaugggaucuguucgucgaaagaagcaaggcccauuccaauuguuauccuuacgacgugcccgauuaugcuucucuccggagccugguugccuccagcgggacgauggaguuuaacaaugagucuuucaacuggaccggagugacacagaauggcaccuccagcgcuugcauccgcagaucuaacaauuccuuuuucagccggcuuaacuggcugacacaccucaauuuuaaauacccugcccugaacgucaccaugcccaacaaugaacaguucgacaaacuuuauauuuggggcgugcaucacccugggacggauaaggaccagaucuuucuguacgcgcaagccucuggacgcauuacaguuuccaccaagagaagccagcaggcugugaucccgaacauuggcucccggccccgcgucagaaauaucccuucucgggugagcaucuauuggacaauugugaagcccggggauauccuccugauuaacuccaccggaaaucugaucgccccucgcggcuacuucaaaauuagaagcgggaagucuuccaucaugcggagcgacgcucccaucggaaaauguaacucugccugcauuaccccgaauggcagcaucccuaacgacaagcccuuucagaaugucaaccgcauuacauacggcgcguguccuagauauguuaagcaaaauacgcucaaacuggccaccgggaugcggaacgugcccgagaagcagacacgcggaaucuucggcgcuauugccggguuuaucgaaaauggaugggagggcaugguggaugggugguacggauucagacaccagaacuccgagggccggggccaagcugccgaccuuaaaucuacccaggccgcuaucgaucagauuaaugggaagcugaacagacucaucggaaaaacaaacgaaaaguuccaucagauugagaaagaauuuagcgaggucgaaggccgcauccaagaccuggagaaguauguggaggauaccaagauugaccuuugguccuacaaugcggaacugcucguugcccuggagaaccagcacacgaucgaucugacagacagcgaaaugaauaaacucuucgagaagaccaaaaagcagcugcgggaaaacgcugaggauauggggaauggaugcuuuaaaauuuaucauaagugugacaacgccugcaucggcucuaucagaaaugggaccuacgaucacgacguguaucgcgacgaggcccuuaacaaucgguuccagauuaagggcgucgaacugaaauccggauacaaggauuggauccucuggauuagcuuugcuaucucuugcuuccugcuuuguguggcccugcucggcuuuauuaugugggcgugccaaaaagggaacaucagauguaauaucugcauuuga

SEQ ID NO: 194809 - RNA, 1701 nt, Artificial Sequence; identical to SEQ ID NO: 192882
  derived and/or modified sequence opt5 from hemagglutinin__InfluenzaA__AHM00555

SEQ ID NO: 194810 - RNA, 1701 nt, Artificial Sequence
  derived and/or modified sequence opt5 from hemagglutinin__InfluenzaA__AHM00567
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagaaagagcaauucuuccuuuuucagccggcugaacuggcucacccaucugaauuuuaaguauccugcccuuaacgucacaaugcccaacaaugagcaguucgacaaacuguacaucuggggcgugcaccauccugggaccgauaaggaccagauuuuucucuaugcgcagucuuccggacgcaucacgguuagcacaaaaagaucccaacaggccgugauuccgaacaucggcucucggccccgcaucagaaauauuccuagccggaucuccauuuacuggaccaucgucaagcccggggauauucugcugaucaacagcacaggaaaucucaucgcuccucgcggcuacuucaaaauuagaucugggaaguccagcaucaugcggucugacgcccccauuggaaaguguaaaagcgaaugcaucaccccgaacggcuccauuccuaaugacaagcccuuucagaacgugaaucgcaucaccuauggcgcuuguccuagauacgugaaacagucuacacugaaacuugccacggggaugcggaacguccccgagaagcaaacccgcggaaucuucggcgcgauugccggguuuaucgaaaauggaugggagggcaugguugaugggugguauggauucagacaccagaacagcgagggccggggccaggcugccgaccugaaguccacacaagcugccauugaucagaucaaugggaaacucaacagacugauuggaaagaccaaugaaaaguuccaccagaucgagaaagaauuuagcgagguggaaggccgcauucaggaccuugagaaguacguggaggauacaaaaaucgaccuguggucuuauaacgccgaacuccuggucgcucuggagaaccaacauaccaucgaucucacggacuccgaaaugaauaagcuguucgagaaaacaaagaagcagcuucgggaaaacgcggaggauauggggaauggaugcuuuaaaauuuaccacaagugugacaacgccugcaucggcagcauuagaaaugggaccuaugaucaugacguguaccgcgacgaggcucugaacaaucgguuccagaucaaaggcguugaacucaagucuggauacaaagauuggauucuguggaucuccuuugccaucagcugcuuccuucuguguguggcccuccugggcuuuauuaugugggcuugccagaaggggaacaucagauguaauauuugcaucuga

SEQ ID NO: 194811 - RNA, 1701 nt, Artificial Sequence; identical to SEQ ID NO: 192882
  derived and/or modified sequence opt5 from hemagglutinin__InfluenzaA__AHM00579

SEQ ID NO: 194812 - RNA, 1701 nt, Artificial Sequence; identical to SEQ ID NO: 192907
  derived and/or modified sequence opt5 from hemagglutinin__InfluenzaA__AHM00591

SEQ ID NO: 194813 - RNA, 1701 nt, Artificial Sequence; identical to SEQ ID NO: 192882
  derived and/or modified sequence opt5 from hemagglutinin__InfluenzaA__AHM00603

SEQ ID NO: 194814 - RNA, 1701 nt, Artificial Sequence; identical to SEQ ID NO: 192882
  derived and/or modified sequence opt5 from hemagglutinin__InfluenzaA__AHM00615

SEQ ID NO: 194815 - RNA, 1701 nt, Artificial Sequence
  derived and/or modified sequence opt5 from hemagglutinin__InfluenzaA__AHM00627
augaagaccacaaucgcccugagcuacauucucugccugguguucgcucagaaacuucccggcaacgacaauuccacggccacccugugucucgggcaccaugcggucccuaacggaacaaucguuaagaccauuacaaaugauagaaucgaggugaccaacgcuacagaacuggugcaaaauucuagcauuggcgagaucugcgacuccccgcaccagauccuugauggggaaaacuguacccugauugacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacgcuugaauuuaauaacgagagcuucaauuggaccggagugacacaaaacggcaccucuuccgcuugcaucagacggagcaauucuuccuuuuucagccgccugaacuggcucacacaucugaauuuuaaguauccugcccuuaacgucaccaugcccaacaaugagcaguucgacaagcuguacauuuggggcgugcaccauccugggacggauaaagaccagaucuuucucuaugcgcagucuuccggaagaauuacaguuagcaccaagcggucccaacaggccgugaucccgaacauuggcucucgccccagaauccggaauaucccuagccgcauuuccaucuacuggacaauugucaaacccggggauauccugcugauuaacagcaccggaaaucucaucgcuccuagaggcuacuucaagauccggucugggaaauccagcauuaugcgcucugacgcccccaucggaaaguguaagagcgaaugcauuaccccgaacggcuccaucccuaaugacaaacccuuucagaacgugaauagaauuacauauggcgcuuguccucgguacgugaagcagucuacgcugaaacuugccaccgggaugcgcaacguccccgagaagcaaacaagaggaaucuucggcgcgaucgccggguuuauugaaaauggaugggagggcaugguugaugggugguauggauuccggcaccagaacagcgagggcagaggccaggcugccgaccugaaauccacccaagcugccaucgaucagauuaaugggaagcucaaccgccugaucggaaaaacaaaugaaaaguuccaccagauugagaaggaauuuagcgagguggaaggccggauccaggaccuugagaaauacguggaggauaccaagauugaccuguggucuuauaacgccgaacuccuggucgcucuggagaaccaacauacgaucgaucucacagacuccgaaaugaauaaacuguucgagaagaccaaaaagcagcuuagagaaaacgcggaggauauggggaauggaugcuuuaagaucuaccacaaaugugacaacgccugcauuggcagcauccgcaaugggaccuaugaucauaacguguaccgggacgaggcucugaauaacagauuccagauuaagggcguugaacucaaaucuggauacaaggacuggauccuguggauuuccuuugccaucagcugcuuccuucuguguguggcccuccugggcuuuaucaugugggcuugccagaaagggaauauucgcuguaacaucugcauuuga

SEQ ID NO: 194816 - RNA, 1701 nt, Artificial Sequence; identical to SEQ ID NO: 192882
  derived and/or modified sequence opt5 from hemagglutinin__InfluenzaA__AHM00639

SEQ ID NO: 194817 - RNA, 1701 nt, Artificial Sequence; identical to SEQ ID NO: 192859
  derived and/or modified sequence opt5 from hemagglutinin__InfluenzaA__AHM00651

SEQ ID NO: 194818 - RNA, 1701 nt, Artificial Sequence; identical to SEQ ID NO: 193018
  derived and/or modified sequence opt5 from hemagglutinin__InfluenzaA__AHM00663

SEQ ID NO: 194819 - RNA, 1701 nt, Artificial Sequence; identical to SEQ ID NO: 192907
  derived and/or modified sequence opt5 from hemagglutinin__InfluenzaA__AHM00675

SEQ ID NO: 194820 - RNA, 1701 nt, Artificial Sequence; identical to SEQ ID NO: 193969
  derived and/or modified sequence opt5 from hemagglutinin__InfluenzaA__AHM00687

SEQ ID NO: 194821 - RNA, 1701 nt, Artificial Sequence
  derived and/or modified sequence opt5 from hemagglutinin__InfluenzaA__AHM00698
augaagaccaucauugcccugagcuacauccucugccugguguucgcucaggagcuucccggcaacgacgauuccacagccacgcugugucucgggcaccaugcggucccuaauggaaccauuguuaaaacaaucaccaacgaccaaauugaagugacaaaugcuaccgagcuggugcagucuagcuccacaggcgaaaucugcaacucuccgcaccagauccuugauggggagaauuguacccugauugacgcccuccugggagauccccagugcgacggcuuucaaaacaagaaaugggaucuguucgucgaaagaagcaaggcccauuccaauuguuauccuuacgacgugcccgauuaugcuucucuccggagccugguugccuccagcgggacgcuugaguuuaacaaugagucuuucaacuggaccggagugacacagaauggcaccuccagcgcuugcacacgcagaucuaacaauuccuuuuucagccggcugaacuggcucacccaccugaauuuuaaauacccugcccuuaacgucacgaugcccaacaaugaacaguucgacaagcuguauaucuggggcgugcaucacccugggacagauaaggaccagauuuuucucuacgcgcaagccucuggacgcaucaccguuuccacaaaaagaagccagcaggcugugauuccgaacaucggcucccggccccgcgucagaaauauuccuucucgggugagcaucuauuggaccaucgugaagcccggggauauucugcugaucaacuccaccggaaaucucauugccccucgcggcuacuucaaaaucagaagcgggaagucuuccauuaugcggagcgacgcucccaucggaaaauguaacucugccugcaucacaccgaauggcagcauuccuaacgacaagcccuuucagaaugucaaccgcaucacguacggcgcguguccuagauauguuaagcaaaauacccugaaacuugccacagggaugcggaacgugcccgagaagcagacccgcggaauuuucggcgcuaucgccggguuuauugaaaauggaugggagggcaugguggaugggugguacggauucagacaccagaacuccgagggccggggccaagcugccgaccugaaaucuacacaggccgcuaucgaucagaucaaugggaagcucaacagacugauuggaaaaaccaacgaaaaguuccaucagaucgagaaagaauuuagcgaggucgaaggccgcauucaagaccuugagaaguauguggaggauacgaagaucgaccugugguccuacaaugcggaacuccugguugcccuggagaaccagcacacaauugaucucaccgacagcgaaaugaauaaacuguucgagaagaccaaaaagcagcuucgggaaaacgcugaggauauggggaauggaugcuuuaaaaucuaucauaagugugacaacgccugcauuggcucuaucagaaaugggacauacgaucacgacguguaucgcgacgaggcccugaacaaucgguuccagaucaagggcgucgaacucaaauccggauacaaggauuggauucuguggaucagcuuugcuauuucuugcuuccuucuguguguggcccuccugggcuuuaucaugugggcgugccaaaaagggaacauuagauguaauaucugcaucuga

SEQ ID NO: 194822 - RNA, 1701 nt, Artificial Sequence; identical to SEQ ID NO: 192882
  derived and/or modified sequence opt5 from hemagglutinin__InfluenzaA__AHM00710

SEQ ID NO: 194823 - RNA, 1701 nt, Artificial Sequence; identical to SEQ ID NO: 192882
  derived and/or modified sequence opt5 from hemagglutinin__InfluenzaA__AHM00722

SEQ ID NO: 194824 - RNA, 1701 nt, Artificial Sequence; identical to SEQ ID NO: 192882
  derived and/or modified sequence opt5 from hemagglutinin__InfluenzaA__AHM00734

SEQ ID NO: 194825 - RNA, 1701 nt, Artificial Sequence; identical to SEQ ID NO: 193017
  derived and/or modified sequence opt5 from hemagglutinin__InfluenzaA__AHM00746

SEQ ID NO: 194826 - RNA, 1701 nt, Artificial Sequence; identical to SEQ ID NO: 192882
  derived and/or modified sequence opt5 from hemagglutinin__InfluenzaA__AHM00758

SEQ ID NO: 194827 - RNA, 1701 nt, Artificial Sequence; identical to SEQ ID NO: 193050
  derived and/or modified sequence opt5 from hemagglutinin__InfluenzaA__AHM00770

SEQ ID NO: 194828 - RNA, 1701 nt, Artificial Sequence; identical to SEQ ID NO: 192859
  derived and/or modified sequence opt5 from hemagglutinin__InfluenzaA__AHM00782

SEQ ID NO: 194829 - RNA, 1701 nt, Artificial Sequence
  derived and/or modified sequence opt5 from hemagglutinin__InfluenzaA__AHM00794
augaagaccaucauugcccugagcuacauccucugccugguguucacacagaaacuucccggcaacgacaauuccacggcuacccugugucucgggcaccaugccgucccuaacggaacaauuguuaagaccaucacaaaugauagaauugaggugaccaacgcgacagaacuggugcaaaauucuagcaucggcgagaucugcgacuccccgcaccagauucuugauggggaaaacuguacccugaucgacgcucuccugggagauccccagugcgacggcuuucagaauaaaaagugggaucuguucgucgagcggucuaaagccuauagcaacuguuacccuuaugacgugcccgauuacgccucccuccgcucucugguugcuagcuccgggacgcuugaauuuaauaacgagagcuucaauuggaccggagugacacaaaacggcaccucuuccgccugcauuagacggagcaauucuuccuuuuucagccgccugaacuggcucacacaucugaauuuuaaguauccugcucuuaacgucaccaugcccaacaaugagcaguucgacaagcuguacaucuggggcgugcaccauccugggacggauaaagaccagauuuuucucuaugcccagucuuccggaagaaucacaguuagcaccaagcggucccaacaggcggugauuccgaacaucggcucucgccccagaauccggaauauuccuagccgcaucuccauuuacuggacaaucgucaaacccggggauauucugcugaucaacagcaccggaaaucucaucgccccuagaggcuacuucaagauucggucugggaaauccagcaucaugcgcucugacgcucccauuggaaaguguaagagcgaaugcaucaccccgaacggcuccauuccuaaugacaaacccuuucagaacgugaauagaaucacauauggcgccuguccucgguacgugaagcagucuacgcugaaacuugcuaccgggaugcgcaacguccccgagaagcaaacaagaggaaucuucggcgccauugcgggguuuaucgaaaauggaugggagggcaugguugaugggugguauggauuccggcaccagaacagcgagggcagaggccaggccgcugaccugaaauccacccaagccgcuauugaucagaucaaugggaagcucaaccgccugauuggaaaaacaaaugaaaaguuccaccagaucgagaaggaauuuagcgagguggaaggccggauucaggaccuugagaaauacguggaggauaccaagaucgaccuguggucuuauaacgccgaacuccuggucgcccuggagaaccaacauacgaucgaucucacagacuccgaaaugaauaaacuguucgagaagaccaaaaagcagcuuagagaaaacgcugaggauauggggaauggaugcuuuaagauuuaccacaaaugugacaacgcgugcaucggcagcauucgcaaugggaccuaugaucaugacguguaccgggacgaggcccugaacaauagauuccagaucaagggcguugaacucaaaucuggauacaaggauuggauucuguggaucuccuuugcuaucagcugcuuccuucuguguguggcccuccugggcuuuauuaugugggccugccagaaagggaacauccgcuguaauauuugcaucuga

SEQ ID NO: 194830 - RNA, 1701 nt, Artificial Sequence; identical to SEQ ID NO: 193050
  derived and/or modified sequence opt5 from hemagglutinin__InfluenzaA__AHM00806

SEQ ID NO: 194831 - RNA, 1701 nt, Artificial Sequence
  derived and/or modified sequence opt5 from hemagglutinin__InfluenzaA__AHM00818
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagaauuucaacuggacgggagugacccaaaauggcacaagcucugcuugcauuagacgguccaacagcuccuuuuucucucgccugaauuggcucacccaucugaacuuuaaguauccugcccuuaacgucacaaugcccaauaacgagcaguucgacaagcuguacaucuggggcgugcaccauccugggaccgauaaagaccagauuuuucucuaugcgcagagcucuggaagaaucacgguuuccacaaagcggagccaacaggccgugauuccgaauaucggcucccgccccagaauccggaacauuccuucucgcaucagcauuuacuggaccaucgucaaacccggggauauucugcugaucaauuccacaggaaaccucaucgcuccuagaggcuacuucaagauucggagcgggaaaucuuccaucaugcgcagcgacgcccccauuggaaaguguaagucugaaugcaucaccccgaauggcagcauuccuaacgacaaacccuuucagaaugugaacagaaucaccuauggcgcuuguccucgguacgugaagcaguccacacugaaacuugccacggggaugcgcaauguccccgagaagcaaaccagaggaaucuucggcgcgauugccggguuuaucgaaaacggaugggagggcaugguugaugggugguauggauuccggcaccaaaauucugagggcagaggccaggcugccgaccugaaaagcacacaggcugccauugaucagaucaacgggaagcucaaucgccugauuggaaaaaccaacgaaaaguuccaccagaucgagaaggaauuuuccgagguggaaggccggauucaggaccuugagaaauacguggaggauacaaagaucgaccuguggagcuauaacgccgaacuccuggucgcucuggagaaucaacauaccaucgaucucacggacucugaaaugaacaaacuguucgagaagaccaaaaagcagcuuagagaaaaugcggaggauauggggaacggaugcuuuaagauuuaccacaaaugugacaaugccugcaucggcuccauucgcaacgggacauaugaucaugacguguaccgggacgaggcucugaauaacagauuccagaucaagggcguugaacucaaaagcggauacaaggauuggauucuguggaucucuuuugccaucuccugcuuccuucuguguguggcccuccugggcuuuauuaugugggcuugccagaaagggaauauccgcuguaacauuugcaucuga

SEQ ID NO: 194832 - RNA, 1701 nt, Artificial Sequence; identical to SEQ ID NO: 192907
  derived and/or modified sequence opt5 from hemagglutinin__InfluenzaA__AHM00830

SEQ ID NO: 194833 - RNA, 1701 nt, Artificial Sequence; identical to SEQ ID NO: 192907
  derived and/or modified sequence opt5 from hemagglutinin__InfluenzaA__AHM00842

SEQ ID NO: 194834 - RNA, 1701 nt, Artificial Sequence; identical to SEQ ID NO: 194810
  derived and/or modified sequence opt5 from hemagglutinin__InfluenzaA__AHM00854

SEQ ID NO: 194835 - RNA, 1701 nt, Artificial Sequence; identical to SEQ ID NO: 194810
  derived and/or modified sequence opt5 from hemagglutinin__InfluenzaA__AHM00866

SEQ ID NO: 194836 - RNA, 1701 nt, Artificial Sequence; identical to SEQ ID NO: 192882
  derived and/or modified sequence opt5 from hemagglutinin__InfluenzaA__AHM00878

SEQ ID NO: 194837 - RNA, 1701 nt, Artificial Sequence; identical to SEQ ID NO: 192859
  derived and/or modified sequence opt5 from hemagglutinin__InfluenzaA__AHM00890

SEQ ID NO: 194838 - RNA, 1701 nt, Artificial Sequence; identical to SEQ ID NO: 192892
  derived and/or modified sequence opt5 from hemagglutinin__InfluenzaA__AHM00902

SEQ ID NO: 194839 - RNA, 1701 nt, Artificial Sequence; identical to SEQ ID NO: 192882
  derived and/or modified sequence opt5 from hemagglutinin__InfluenzaA__AHM00914

SEQ ID NO: 194840 - RNA, 1701 nt, Artificial Sequence; identical to SEQ ID NO: 192882
  derived and/or modified sequence opt5 from hemagglutinin__InfluenzaA__AHM00926

SEQ ID NO: 194841 - RNA, 1701 nt, Artificial Sequence; identical to SEQ ID NO: 192859
  derived and/or modified sequence opt5 from hemagglutinin__InfluenzaA__AHM00938

SEQ ID NO: 194842 - RNA, 1701 nt, Artificial Sequence
  derived and/or modified sequence opt5 from hemagglutinin__InfluenzaA__AHM00950
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacguuucccuccgcucucugguggcuagcuccgggacccuugaauuuaauaacgagagcuucaauuggacgggagucacccaaaacggcacaucuuccgccugcauuagacggagcaauucuuccuuuuucagccgccugaacuggcucacccaucugaauuuuaaguauccugcucuuaacgugacaaugcccaacaaugagcaguucgacaagcuguacaucuggggcguucaccauccugggaccgauaaagaccagauuuuucucuaugcccagucuuccggaagaaucacggugagcacaaagcggucccaacaggcggucauuccgaacaucggcucucgccccagaauccggaauauuccuagccgcaucuccauuuacuggaccaucgugaaacccggggauauucugcugaucaacagcacaggaaaucucaucgccccuagaggcuacuucaagauucggucugggaaauccagcaucaugcgcucugacgcucccauuggaaaguguaagagcgaaugcaucaccccgaacggcuccauuccuaaugacaaacccuuucagaacgugaauagaaucaccuauggcgccuguccucgguacgucaagcagucuacacugaaacuugcuacggggaugcgcaacguucccgagaagcaaaccagaggaaucuucggcgccauugcgggguuuaucgaaaauggaugggagggcaugguggaugggugguauggauuccggcaccagaacagcgagggcagaggccaggccgcugaccugaaauccacacaagccgcuauugaucagaucaaugggaagcucaaccgccugauuggaaaaaccaaugaaaaguuccaccagaucgagaaggaauuuagcgagguggaaggccggauucaggaccuugagaaauacgucgaggauacaaagaucgaccuguggucuuauaacgccgaacuccugguggcccuggagaaccaacauaccaucgaucucacggacuccgaaaugaauaaacuguucgagaagaccaaaaagcagcuuagagaaaacgcugaggauauggggaauggaugcuuuaagauuuaccacaaaugugacaacgcgugcaucggcagcauucgcaaugggacauaugaucauaacguuuaccgggacgaggcccugaauaacagauuccagaucaagggcguggaacucaaaucuggauacaaggacuggauucuguggaucuccuuugcuaugagcugcuuccuucugugugucgcccuccugggcuuuaucaugugggccugccagaaagggaauauucgcuguaacaucugcauuuga

SEQ ID NO: 194843 - RNA, 1701 nt, Artificial Sequence; identical to SEQ ID NO: 192859
  derived and/or modified sequence opt5 from hemagglutinin__InfluenzaA__AHM00962

SEQ ID NO: 194844 - RNA, 1701 nt, Artificial Sequence
  derived and/or modified sequence opt5 from hemagglutinin__InfluenzaA__AHM00974
augaagaccaucauugcccugagcuacauccucugccugguguucgcucaggagcuucccggcaacgacgauuccacagccacgcugugucucgggcaccaugcggucccuaauggaaccauuguuaaaacaaucaccaacgaccaaauugaagugacaaaugcuaccgagcuggugcagucuagcuccacaggcgaaaucugcaacucuccgcaccagauccuugauggggagaauuguacccugauugacgcccuccugggagauccccagugcgacggcuuucaaaacaagaaaugggaucuguucgucgaaagaagcaaggcccauuccaauuguuauccuuacgacgugcccgauuaugcuucucuccggagccugguugccuccagcgggacgcuugaguuuaacaaugagucuuucaacuggaccggagugacacagaauggcaccuccagcgcuugcauccgcagaucuaacaauuccuuuuucagccggcugaacuggcucacacaccugaauuuuaaauacccugcccuuaacgucaccaugcccaacaaugaacaguucgacaagcuguauauuuggggcgugcaucacccugggacggauaaggaccagaucuuucucuacgcgcaagccucuggaggcauuacaguuuccaccaaacgcagccagcaggcugugaucccgaacauuggguccagaccccggguccgcaauaucccuucuagagugagcaucuauuggacaauugugaagcccggagauauccugcugauuaacuccaccggcaaucucaucgccccucggggguacuucaaaauucgcagcggaaagucuuccaucaugagaagcgacgcucccaucggcaaauguaacucugccugcauuaccccgaauggcagcaucccuaacgacaagcccuuucagaaugucaaccggauuacauacggggcguguccucgcuauguuaagcaaaauacgcugaaacuugccaccggaaugagaaacgugcccgagaagcagacacggggcaucuucggggcuauugccggauuuaucgaaaauggcugggaggggaugguggauggaugguacggcuuccgccaccagaacuccgagggcagagggcaagcugccgaccugaaaucuacccaggccgcuaucgaucagauuaauggaaagcucaaccggcugaucggcaaaacaaacgaaaaguuccaucagauugagaaagaauuuagcgaggucgaagggagaauccaagaccuugagaaguauguggaggauaccaagauugaccugugguccuacaaugcggaacuccugguugcccuggagaaccagcacacgaucgaucucacagacagcgaaaugaauaaacuguucgagaagaccaaaaagcagcuucgcgaaaacgcugaggauaugggaaauggcugcuuuaaaauuuaucauaagugugacaacgccugcaucgggucuauccggaauggcaccuacgaucacgacguguauagagacgaggcccugaacaaucgcuuccagauuaagggagucgaacucaaauccggcuacaaggauuggauccuguggauuagcuuugcuaucucuugcuuccuucuguguguggcccuccugggguuuauuaugugggcgugccaaaaaggaaacauccgguguaauaucugcauuuga

SEQ ID NO: 194845 - RNA, 1683 nt, Artificial Sequence
  derived and/or modified sequence opt5 from hemagglutinin__InfluenzaA__AHM24224
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccaauauuccucgcaucuguuccaagggcaaaagaacaguugaucuggggcaaugcggacuccugggcaccaucacggggccgccccagugugaccaguuucuugaguucucugccgaucugauuaucgaacggcgcgagggaagcgacgugugcuacccuggcaaguuugucaaagaggaagcccucagacagauucugcgggaguccggcgggaucgauaaggaagcuaugggauucaccuauucuggcauucgcacaaacggggccaccagcgcuuguagacgguccggaucuagcuuuuacgccgagaugaaguggcugcucuccaauacagacaacgcggccuucccccaaaugaccaaaagcuauaagaauacgcgcaaaucuccugcucugaucguguggggcauucaccauuccguuagcacagccgagcagaccaaacuuuacgggucuggaaacaagcuggugacagucggcuccagcaauuaucagcagucuuuugugcccuccccuggcgcuagaccgcaagugaacgggcucagcggacggaucgauuuccacuggcugaugcuuaaucccaacgacaccgucaccuuuuccuucaauggcgccuuuaucgcgccugaucgcgccucuuuccugagaggaaagagcauggggauucaguccggcguucagguggacgcuaacugcgaaggggauuguuaccauagcggaggcacaaucauuucuaaccuccccuuucagaauaucgacucccgggccgugggcaagugcccucgcuaugucaaacaaagaagccugcugcucgcuacggggaugaagaacgugcccgagauuccgaaaggacggggccuguucggggccaucgccggauucaucgaaaauggcugggaggggcuuauugauggcugguacggauuuagacaccagaacgcucagggcgaagggaccgcggccgacuacaagucuacacaaagcgcuaucgaccagauuaccggaaaacugaaucgccucaucgagaagacaaaccagcaguucgagcugauugauaaugaauuuaacgagguugaaaaacaaaucggcaaugugaucaacuggacccgggacuccauuacggaggucuggucuuauaaugccgaacuucugguggccauggagaaccagcacacaaucgaucucgcugacagcgagauggauaagcuguacgaaagaguuaagcgccagcugcgggagaaugccgaagaggacgggaccggauguuucgaaauuuuucauaaaugcgaugacgauuguauggcguccaucagaaacaauaccuaugaccacagcaaguaccgcgaggaggcuaugcagaaccggauucaaaucgauccugugaaacucucuuccggcuauaaggacgucauucugugguucagcuuuggggccucuugcuucauccuucuggccaucgugaugggccucgucuuuauuugcgugaaaaacggaaauaugagauguacaaucugcauuuga

SEQ ID NO: 194846 - RNA, 1683 nt, Artificial Sequence; identical to SEQ ID NO: 193012
  derived and/or modified sequence opt5 from hemagglutinin__InfluenzaA__AHM24236

SEQ ID NO: 194847 - RNA, 1683 nt, Artificial Sequence; identical to SEQ ID NO: 193012
  derived and/or modified sequence opt5 from hemagglutinin__InfluenzaA__AHM24248

SEQ ID NO: 194848 - RNA, 1701 nt, Artificial Sequence
  derived and/or modified sequence opt5 from hemagglutinin__InfluenzaA__AHM98309
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagguguuccccaagaccagcucuuggccuaaccacgacuccaauaagggaguuacagccgcuuguccccaugccggcgcgaaaucuuuuuauaagaaccugaucuggcucgugaaaaagggcaauagcuacccuaaacuguccaagagcuauaucaacgauaaggggaaagaaguccuugugcuguggggcauucaccaccccuccaccacagccgaccaacagucucucuaccagaaugcugaugccuacguguucgucggaaccagcagauauuccaagaaauuuaagccugagaucgcuauucggccgaaaguucgcgaccaggaggggagaaugaacuacuauuggacgcugguggaacccggagauaagaucacauucgaggccaccggcaaccugguggucccucgguacgcguuugccauggaacgcaaugcugggagcggaauuaucauuucugacacacccgugcaugauugcaacaccaccugucaaacaccuaaaggcgccaucaauacgucccuccccuuccagaacauccacccgauuaccaucggcaagugcccuaaguauguuaaaagcacaaagcugagacuugcuaccgggcugcggaaugugcccucuauucagagccgcggacucuuuggcgccaucgccggguucauugagggaggcuggacagggauggucgacggaugguacggcuaucaucaccagaacgaacaaggcuccggguacgcugcggaccugaaaucuacccagaaugccaucgauaagaucacgaacaaagugaauagcguuauugagaagaugaacacacaguuuaccgcugugggaaaggaguucaaucaccuugagaaaagaaucgagaaccugaauaagaaagucgacgauggcuuccucgacauuuggaccuacaacgccgaacugcuggugcuccuggagaaugaacggacacuugauuaucaugacuccaacgucaagaaccuguacgagaaagugcgcaaucagcucaagaacaaugccaaggagaucgggaacggauguuuugaguucuaucacaaaugcgauaauaccuguauggaaagcguuaagaacggcacauacgacuauccuaaauacucugaagaggcuaagcugaauagagaagagauugauggggugaaacuugaguccacgcggaucuaucaaauccuggccauuuacagcaccgucgcgucuucccucgugcugguugugagccugggcgcuaucuccuuuuggaugugcucuaacggaagccuccagugccgcauuuguaucuga

SEQ ID NO: 194849 - RNA, 1710 nt, Artificial Sequence
  derived and/or modified sequence opt5 from hemagglutinin__InfluenzaA__AHM98339
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccacagccgaucaacagucucucuaccagaacgcugacgccuacguguucgugggcaccagcagauauuccaagaaauuuaagccugagauugcuauccggccgaaaguccgcgaucaggaggggagaaugaauuacuauuggacgcugguugaacccggagacaagauuacauucgaggccaccggcaaccugguggugccucgguacgcguuugccauggaacgcaacgcugggagcggaaucauuaucucugauacacccguccaugacugcaauaccaccugucaaacaccuaaaggcgccaucaacacgucccucaccagccugcccuuccagaauauucacccgaucacaauuggcaagugcccuaaguaugugaaaucuaccaaacuuagacuggcuacagggcuccggaacguucccagcauccagucccgcggacuguuuggcgccauugccggguucaucgagggaggcuggaccgggaugguggacggaugguacggcuaucaucaccagaaugaacaaggcucuggguacgcugcggaucuuaaaagcacgcagaacgccaucgacaagauuacaaauaaagucaacuccgugaucgagaagaugaauacccaguuuaccgcuguuggaaaggaguucaaccaccuggaaaagagaauugagaaucucaacaagaaaguggaugacggcuuccuggauaucuggacauacaaugccgaacugcucguccugcuugagaacgaacggacccuggacuaucaugauagcaaugugaagaaccucuacgagaaaguccgcaaccagcugaagaauaacgccaaggagauugggaauggauguuuugaguucuaucacaaaugcgacaacacauguauggagucugugaagaauggcacguacgauuauccuaaauacuccgaagaggcuaaacuuaacagagaagagaucgacgggguuaagcuggagagcacccggaucuaucaaauucucgccaucuacucuacaguggcguccagccugguccuggugguuucccucggcgcuauuucuuuuuggaugugcagcaauggaucccugcagugccgcaucuguauuuga

SEQ ID NO: 194850 - RNA, 1701 nt, Artificial Sequence
  derived and/or modified sequence opt5 from hemagglutinin__InfluenzaA__AHM98350
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaaaugcaacaucgccggguggauucugggaaauccugagugugaaucucugagcacagccuccucuuggagcuacaucguggagaccuccucuagcgacaacggcacgugcuauccgggggauuuuauugacuacgaagaacuccgggagcagcuguccagcgucucuuccuucgaacgcuuugagaucuuccccaagaccagcucuuggccuaaucacgaugccaacaagggagugacagcugccuguccccaugcgggcgccaaaggcuuuuauaagaaucuuaucuggcugguuaaaaaggggaacuccuacccuaaacucagcaagucuuauauuaaugacaagggaaaagaagugcugguccuuuggggcauccaccaccccuccaccacagcugaucaacagagccuguaccagaacgccgacaccuacguguucguggggacguccagauauucuaagaaauuuaagccugagauugcuauccggccgaaaguccgcgaucaggagggaagaaugaauuacuauuggacacucguugaacccggcgacaagauuaccuucgaggccacagggaaccugguggugccucgguacgcguuugccauggaacgcaacgcuggaagcggcaucauuaucuccgauacccccguccaugacugcaauaccacaugucaaacgccuaaaggcgccaucaacaccagccugcccuuccagaauauucacccgaucacaauugggaagugcccuaaguaugugaaaucuaccaagcucagacuggcuacaggacuucggaacguucccuccauccagagccgcggccuguuuggggccauugccggauucaucgagggcggguggaccggaaugguggacggcugguacggcuaucaucaccagaaugaacaagggucuggauacgcugcggaucucaaaagcacgcagaacgccaucgacaagauuacaaauaaagucaacuccgugaucgagaagaugaauacccaguuuaccgcuguuggcaaggaguucaaccaccuggaaaagagaauugagaaucuuaacaagaaaguggaugacggguuccuggauaucuggacauacaaugccgaacuccugguccugcucgagaacgaacggacccuggacuaucaugauucuaaugugaagaaccuuuacgagaaaguccgcaaccagcugaagaauaacgccaaggagauuggaaauggcuguuuugaguucuaucacaaaugcgacaacacauguauggagagcgugaagaaugggacguacgauuauccuaaauacuccgaagaggcuaagcucaacagagaagagaucgacggcguuaaacuggagagcacccggaucuaucaaauucuugccaucuacucuacaguggcguccagccugguccucgugguuucucugggagcuauuuccuuuuggaugugcagcaauggcucccugcagugccgcaucuguauuuga

SEQ ID NO: 194851 - RNA, 1701 nt, Artificial Sequence; identical to SEQ ID NO: 189478
  derived and/or modified sequence opt5 from hemagglutinin__InfluenzaA__AHM98361

SEQ ID NO: 194852 - RNA, 1701 nt, Artificial Sequence; identical to SEQ ID NO: 189891
  derived and/or modified sequence opt5 from hemagglutinin__InfluenzaA__AHM98372

SEQ ID NO: 194853 - RNA, 1701 nt, Artificial Sequence; identical to SEQ ID NO: 189891
  derived and/or modified sequence opt5 from hemagglutinin__InfluenzaA__AHM98383

SEQ ID NO: 194854 - RNA, 1701 nt, Artificial Sequence; identical to SEQ ID NO: 189848
  derived and/or modified sequence opt5 from hemagglutinin__InfluenzaA__AHM98394

SEQ ID NO: 194855 - RNA, 1701 nt, Artificial Sequence
  derived and/or modified sequence opt5 from hemagglutinin__InfluenzaA__AHM98405
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggaacugcgggagcagcuuuccagcgucucuuccuucaagcgcuuugaaaucuuccccaagaccagcucuuggccuaaucacgauuccaacaaaggagugacagccgcuuguccccaugccggcgcgaagggcuuuuauaaaaaucugaucuggcucguuaagaaagggaacagcuacccuaagcugucuaaguccuauauuaaugacaaaggaaaggaggugcuuguccuguggggcauccaccaccccagcaccacagccgaucaacagucccucuaccagaacgcugacaccuacguguucguggggacgucuagauauagcaaaaaguuuaaaccugaaauugccauccggccgaagguccgcgaucaggagggaagaaugaauuacuauuggacacugguugagcccggcgacaaaauuaccuucgaagcuacagggaaccugguggugccucgguacgccuuugcgauggagcgcaacgccggauccggcaucauuaucagcgauacccccguccaugacugcaauaccacaugucaaacgccuaagggcgcuaucaacaccucucuccccuuccagaauauucacccgaucacaauugggaagugcccuaaauaugugaaguccaccaaacugagacuugccacaggacugcggaacguucccagcauccagucucgcggccucuuuggggcuauugccggauucaucgaaggcggguggaccggaaugguggacggcugguacggcuaucaucaccagaaugagcaagggagcggauacgccgcugaucugaaguccacgcagaacgcgaucgacaaaauuacaaauaaggucaacucugugaucgaaaagaugaauacccaguuuaccgccguuggcaaagaguucaaccaccuugagaagagaauugaaaaucugaacaaaaagguggaugacggguuccucgauaucuggacauacaaugcugagcugcugguccuccuggaaaacgagcggacccuugacuaucaugauagcaaugugaaaaaccuguacgaaaagguccgcaaccagcucaagaauaacgccaaagagauuggaaauggcuguuuugaguucuaucacaagugcgacaacacauguauggaauccgugaaaaaugggacguacgauuauccuaaguacagcgaggaagccaaacugaacagagaggaaaucgacggcguuaaacuugagucuacccggaucuaucaaauucuggcuaucuacuccacaguggccagcucucucguccuggugguuucccugggagcgauuagcuuuuggaugugcuccaauggcucucuccagugccgcaucuguauuuga

SEQ ID NO: 194856 - RNA, 1701 nt, Artificial Sequence; identical to SEQ ID NO: 194855
  derived and/or modified sequence opt5 from hemagglutinin__InfluenzaA__AHM98416

SEQ ID NO: 194857 - RNA, 1701 nt, Artificial Sequence; identical to SEQ ID NO: 189848
  derived and/or modified sequence opt5 from hemagglutinin__InfluenzaA__AHM98427

SEQ ID NO: 194858 - RNA, 1701 nt, Artificial Sequence; identical to SEQ ID NO: 190066
  derived and/or modified sequence opt5 from hemagglutinin__InfluenzaA__AHM98438

SEQ ID NO: 194859 - RNA, 1701 nt, Artificial Sequence; identical to SEQ ID NO: 191210
  derived and/or modified sequence opt5 from hemagglutinin__InfluenzaA__AHM98449

SEQ ID NO: 194860 - RNA, 1701 nt, Artificial Sequence
  derived and/or modified sequence opt5 from hemagglutinin__InfluenzaA__AHM98460
augaaggccauccuggugguccuccugugcaccuucgcuacagccaacgcggacacgcuuuguauuggcuaccacgcuaauaacagcaccgauacaguugacaccgugcuggagaaaaaugugacagucacccauuccgugaaccuccuggaagauaagcacaaugggaaacuuugcaagcugagaggaguugcuccccuccaucugggcaaauguaacaucgccggguggauucugggaaauccugagugcgaaucucucagcacagccuccucuuggagcuauaucguggagaccuccucuagcgacaacggcacguguuacccgggggauuuuauugacuaugaagaacugcgggagcagcuuuccagcgucucuuccuucgaacgcuuugagaucuuccccaagaccagcucuuggccuaaucacgauuccaacaagggagugacagccgcuugcccccaugccggcgcgaaaggcuuuuacaagaaucugaucuggcucguuaaaaaggggaacagcuauccuaaacugucuaaguccuacauuaaugacaagggaaaagaagugcuuguccuguggggcauccaccaccccagcaccacagccgaucaacagucccucuaucagaacgcugacaccuacguguucguggggacgucuagauacagcaagaaauuuaagccugagauugccauccggccgaaaguccgcgaucaggagggaagaaugaauuauuacuggacacugguugaacccggcgacaagauuaccuucgaggcuacagggaaccugguggugccucgguaugccuuugcgauggaacgcaacgccggauccggcaucauuaucagcgauaccaccguccaugacuguaauacaacgugccaaacccccaaaggcgcuaucaacacaucucucccuuuccagaauauucaccccaucaccauugggaaguguccgaaguacgugaaauccacaaagcugagacuugccaccggacugcggaacguuccuagcauccagucucgcggccucuuuggggcuauugccggauucaucgagggcggguggacgggaaugguggacggcugguauggcuaccaucaccagaaugaacaagggagcggauaugccgcugaucugaaauccacacagaacgcgaucgacaagauuaccaauaaagucaacucugugaucgagaagaugaauacccaguuuacagccguuggcaaggaguucaaccaccuugaaaagagaauugagaaucugaacaagaaaguggaugacggguuccucgauaucuggaccuacaaugcugaacugcugguccuccuggagaacgaacggacacuugacuaccaugauagcaaugugaagaaccuguaugagaaaguccgcaaccagcucaagaauaacgccaaggagauuggaaauggcugcuuugaguucuaccacaaaugugacaacacgugcauggaguccgugaagaaugggaccuaugauuaccccaaauauagcgaagaggccaagcugaacagagagaaaaucgacggcguuaaacuugaaucuacacggaucuaccaaauucuggcuaucuauuccaccguggccagcucucucguccuggugguuucccugggagcgauuagcuuuuggaugugcuccaauggcucucuccagugucgcaucugcauuuga

SEQ ID NO: 194861 - RNA, 1701 nt, Artificial Sequence; identical to SEQ ID NO: 189891
  derived and/or modified sequence opt5 from hemagglutinin__InfluenzaA__AHM98471

SEQ ID NO: 194862 - RNA, 1701 nt, Artificial Sequence
  derived and/or modified sequence opt5 from hemagglutinin__InfluenzaA__AHM98482
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccacagccgaucaacagucccucuaccagaacgcugacaccuacguguucguggggacgucuagauauagcaagaaauuuaagccugagauugccauccggccgaaaguccgcgaucaggagggaagaaugaauuacuauuggacacugguugaacccggcgacaagauuaccuucgaggcuacagggaaccugguggugccucgguacgccuuugcgauggaacgcaacgccggauccggcaucauuaucagcgauacccccguccaugacugcaauaccacaugucaaacgccuaaaggcgcuaucaacaccucucuccccuuccagaauauucacccgaucacaauugggaagugcccuaaguaugugaaauccaccaagcugagacuugccacaggacugcggaacguucccagcauccagucucgcggccucuuuggggcuauugccggauucaucgagggcggguggaccggaaugguggacggcugguacggcuaucaucaccagaaugaacaagggagcggauacgccgcugaucugaaauccacgcagaacgcgaucgacaagauuacaaauaaagucaacucugugaucgauaagaugaauacccaguuuaccgccguuggcaaggaguucaaccaccuugagaaaagaauugaaaaucugaacaagaaaguggacgauggguuccucgacaucuggacauacaaugcugagcugcugguccuccuggaaaacgagcggacccuugauuaucaugacagcaaugugaagaaccuguacgaaaaaguccgcaaccagcucaagaauaacgccaaggagauuggaaauggcuguuuugaguucuaucacaaaugcgauaacacauguauggaauccgugaagaaugggacguacgacuauccuaaauacagcgaggaagccaagcugaacagagaggaaaucgauggcguuaaacuugagucuacccggaucuaucaaauucuggcuaucuacuccacaguggccagcucucucguccuggugguuucccugggagcgauuagcuuuuggaugugcuccaauggcucucuccagugccgcaucuguauuuga

SEQ ID NO: 194863 - RNA, 1701 nt, Artificial Sequence
  derived and/or modified sequence opt5 from hemagglutinin__InfluenzaA__AHM98493
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccaaguauagcaaaaaguuuaaaccugagauugcugucagaccgaagguucgggaccaggaggggcgcaugaacuacuauuggacccugguggaacccggagauaaaaucacguucgaggccacaggcaaccugcucgugccuagauacgcguuugccauggaacggaaugcugggucuggaauuaucauuuccgacacccccguccaugauugcaacacaaccugucaaaccccuaagggcgccaucaauacaagccugcccuuccagaacauccacccgauuacgaucggcaaguauccuaaauacgugaagucuaccaaacuucgccuggcuacagggcucagaaauguucccagcauucagucccggggacuguuuggcgccaucgccggguucauugagggaggcuggaccgggaugguggacggaugguauggcuaccaucaccagaacgaacaaggcucuggguacgcugcggaccuuaagagcacacagaaugccaucgauaaaaucaccaacaaggucaauuccgugauugagaagaugaacacgcaguuuacagcuguuggaaaagaguucaaucaccuggaaaagcgcaucgagaaccucaauaaaaagguggacgauggcuuccuggacauuuggaccuauaacgccgaacugcucguccugcuugagaaugaaagaacccuggauuaccaugacagcaacgugaaaaaccucuaugagaagguccggucucagcugaagaauaacgccaaagagaucgggaauggaugcuuugaguucuaccacaagugugauaacacaugcauggaguccgugaaaaauggcaccuaugacuacccuaaguauagcgaagaggcuaaacuuaaccgcgaagagauugaugggguuaagcuggagucuacaagaaucuaccaaauccucgccauuuacuccacgguggcgagcucccugguccuggugguuucucucggcgcuaucagcuuuuggauguguuccaauggaucucugcagugccggauuugcaucuga

SEQ ID NO: 194864 - RNA, 1701 nt, Artificial Sequence
  derived and/or modified sequence opt5 from hemagglutinin__InfluenzaA__AHM98504
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacagccgaccaacagucucucuaccagaaugcugaugccuacguguucgugggcaccagcagauauuccaagaaauuuaagccugagauugcuauccggccgaaaguccgcgaccaggaggggagaaugaacuacuauuggacgcugguugaacccggagauaagauuacauucgaggccaccggcaaccugguggugccucgguacgcguuugccauggaacgcaaugcugggagcggaaucauuaucucugacacacccguccaugauugcaacaccaccugucaaacaccuaaaggcgccaucaauacgucccuccccuuccagaacauucacccgaucaccauuggcaagugcccuaaguaugugaaaagcacaaagcugagacuugcuaccgggcugcggaauguucccucuauccagagccgcggacucuuuggcgccauugccggguucaucgagggaggcuggacagggaugguggacggaugguacggcuaucaucaccagaacgaacaaggcuccggguacgcugcggaccugaaaucuacccagaaugccaucgauaagauuacgaacaaagucaauagcgugaucgagaagaugaacacacaguuuaccgcuguuggaaaggaguucaaucaccuugaaaagagaauugagaaccugaauaagaaaguggacgauggcuuccucgacaucuggaccuacaacgccgaacugcugguccuccuggagaaugaacggacacuugauuaucaugacuccaacgugaagaaccuguacgagaaaguccgcaaucagcucaagaacaaugccaaggagauugggaacggauguuuugaguucuaucacaaaugcgauaauaccuguauggagagcgugaagaacggcacauacgacuauccuaaauacucuaaggaagcuaaacugaauagagaggaaaucgaugggguuaaacuugaguccacgcggaucuaucaaauucuggccaucuacagcaccguggcgucuucccucguccuggugguuagccugggcgcuauuuccuuuuggaugugcucuaacggaagccuccagugccgcaucuguauuuga

SEQ ID NO: 194865 - RNA, 1701 nt, Artificial Sequence; identical to SEQ ID NO: 189478
  derived and/or modified sequence opt5 from hemagglutinin__InfluenzaA__AHM98515

SEQ ID NO: 194866 - RNA, 1701 nt, Artificial Sequence
  derived and/or modified sequence opt5 from hemagglutinin__InfluenzaA__AHM98526
augaaggccauccuggugguccuccugcacaccuucgcuacagccaacgcggacacgcuuugcauuggcuaccaugcuaauaacagcaccgauacaguugacaccgugcuggagaagaaugugacagucacccacuccgugaaccuccuggaagauaagcauaaugggaaacuuuguaagcugagaggaguugcuccccuccaccugggcaaaugcaacaucgccggguggauucugggaaauccugagugugaaucucucagcacagccuccucuuggagcuauaucguggagaccuccucuagcgacaacggcacgugcuacccgggggauuuuauugacuaugaagaacugcgggagcagcuuuccagcgucucuuccuucgaacgcuuugagaucuuccccaagaccagcucuuggccuaaucaugauuccaacaagggagugacagccgcuuguccccacgccggcgcgaaaggcuuuuacaagaaucugaucuggcucguuaaaaaggggaacagcuauccuaaacugucuaaguccuacauuaaugacaagggaaaagaagugcuuguccuguggggcauccaccaucccagcaccacagccgaucaacagucccucuaucagaacgcugacaccuacguguucguggggacgucuagauacagcaagaaauuuaagccugagauugccauccggccgaaaguccgcgaucaggagggaagaaugaauuauuacuggacacugguugaacccggcgacaagauuaccuucgaggcuacagggaaccugguggugccucgguaugccuuugcgauggaacgcaacgccggauccggcaucauuaucagcgauacccccguccacgacugcaauaccacaugucaaacgccuaaaggcgcuaucaacaccucucuccccuuccagaauauucauccgaucacaauugggaagugcccuaaguacgugaaauccaccaagcugagacuugccacaggacugcggaacguucccagcauccagucucgcggccucuuuggggcuauugccggauucaucgagggcggguggaccggaaugguggacggcugguauggcuaccaccaccagaaugaacaagggagcggauaugccgcugaucugagauccacgcagaacgcgaucgacaaaauuacaaauaaggucaacucugugaucgagaaaaugaauacccaguuuaccgccguuggcaaggaguucaaccaucuugaaaagcggauugagaaucugaacaaaaagguggaugacggguuccucgauaucuggacauacaaugcugaacugcugauucuccuggagaacgaacgcacccuugacuaccacgauagcaaugucaaaaaccuguaugagaaggugagaaaccagcucaaaaauaacgccaaggagaucggaaauggcuguuuugaguucuaccauaagugcgacaacacauguauggaguccgucaaaaaugggacguaugauuacccuaaguauagcgaagaggccaaacugaaccgggaagagaucgacggcgugaaacuugagucuacccgcauuuaccaaauccuggcuauuuauuccacaguugccagcucucucgugcuggucgugucccugggagcgaucagcuuuuggaugugcuccaauggcucucuccagugcagaauuuguaucuga

SEQ ID NO: 194867 - RNA, 1701 nt, Artificial Sequence; identical to SEQ ID NO: 189478
  derived and/or modified sequence opt5 from hemagglutinin__InfluenzaA__AHM98537

SEQ ID NO: 194868 - RNA, 1701 nt, Artificial Sequence
  derived and/or modified sequence opt5 from hemagglutinin__InfluenzaA__AHM98548
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacagccgaccaacagucucucuaccagaaugcugaugccuacguguucgugggcaccagcagauauuccaagaaauuuaagccugagauugcuauccggccgaaaguccgcgaccaggaggggagaaugaacuacuauuggacgcugguugaacccggagauaagauuacauucgaggccaccggcaaccugguggugccucgguacgcguuugccauggaacgcaaugcugggagcggaaucauuaucucugacacacccguccaugauugcaacaccaccugucaaacaccuaaaggcgccaucaauacgucccuccccuuccagaacauucacccggugaccaucggcaagugcccuaaguauguuaaaagcacaaagcugagacuugcuaccgggcugcggaaugugcccucuauucagagccgcggacucuuuggcgccaucgccggguucauugagggaggcuggacagggauggucgacggaugguacggcuaucaucaccagaacgaacaaggcuccggguacgcugcggaccugaaaucuacccagaaugccaucgauaagaucacgaacaaagugaauagcguuauugagaagaugaacacacaguuuaccgcugugggaaaggaguucaaucaccuugagaaaagaaucgagaaccugaauaagaaagucgacgauggcuuccucgacauuuggaccuacaacgccgaacugcuggugcuccuggagaaugaacggacacuugauuaucaugacuccaacgucaagaaccuguacgagaaagugcgcaaucagcucaagaacaaugccaaggagaucgggaacggauguuuugaguucuaucacaaaugcgauaauaccuguauggaaagcguuaagaacggcacauacgacuauccuaaauacucugaagaggcuaagcugaauagagaagagauugauggggugaaacuugaguccacgcggaucuaucaaauccuggccauuuacagcaccgucgcgucuucccucgugcugguugugagccugggcgcuaucuccuuuuggaugugcucuaacggaagccuccagugccgcauuuguaucuga

SEQ ID NO: 194869 - RNA, 1701 nt, Artificial Sequence
  derived and/or modified sequence opt5 from hemagglutinin__InfluenzaA__AHM98559
augaaggccauccuggugguccuccuguacaccuucgcuacagccaaggcggacacgcuuugcauuggcuaucacgcuaacaauagcaccgauacaguugacaccgugcuggagaagaacgugacagucacccauuccgugaaucuccuggaagauaaacacaacgggaaacuuuguaagcugagaggaguugcgccccuccaucugggcaagugcaauaucgccggguggauucugggaaacccugagugugaaucucucagcacagcuuccucuuggagcuacaucguggagaccuccucuagcgacaauggcacgugcuauccgggggauuuuauuaacuacgaagaacugcgggagcagcuuuccagcgucucuuccuucgaacgcuuugagaucuuccccaagaccagcucuuggccuaaucacgacuccaacaaaggagugacagccgcuuguccccaugccggcgccaagagcuuuuauaaaaaucugaucuggcucguuaagaaaggcaacucuuacccuaagcuguccaagagcuauauuaaugauaaagggaaggaagugcuuguccuguggggaauccaccaccccuccaccacagccgaccaacagucucucuaccagaacgcugaugccuacguguucgugggcaccagcagauauuccaaaaaguuuaaaccugagauugcuauccggccgaagguccgcgaccaggaggggagaaugaauuacuauuggacgcugguugaacccggagauaaaauuacauucgaggccaccggcaaccugguggugccucgguacgcguuugccauggaacgcaacgcugggagcggaaucauuaucucugacacacccguccaugauugcaauaccaccugucaaacaccuaagggcgccaucaacacgucccuccccuuccagaauauucacccgaucaccauuggcaagugcccuaaauauguuaagagcacaaaacugagacuugcuaccgggcugcggaacgugcccucuauccagagccgcggacucuuuggcgccauugccggguucaucgagggaggcuggacagggaugguggacggaugguacggcuaucaucaccagaaugaacaaggcuccggguacgcugcggaccugaagucuacccagaacgccaucgauaaaauuacgaauaaggucaacagcgugaucgagaagaugaauacacaguuuaccgcuguuggaaaagaguucaaccaccuugaaaagagaauugagaaucugaacaaaaagguggacgauggcuuccucgacaucuggaccuacaaugccgaacugcugguccuccuggagaacgaacggacacuugauuaucaugacuccaaugugaaaaaccuguacgagaagguccgcaaccagcucaagaauaacgccaaagagauugggaauggauguuuugaguucuaucacaagugcgauaacaccuguauggagagcgugaaaaauggcacauacgacuauccuaaguacucugaagaggcuaaacugaacagagaagagaucgaugggguuaaacuugaguccacgcggaucuaucaaauucuggccaucuacagcaccguggcgucuucccucguccuggugguuagccugggcgcuauuuccuuuuggaugugcucuaauggaagccuccagugccgcaucuguauuuga

SEQ ID NO: 194870 - RNA, 1701 nt, Artificial Sequence; identical to SEQ ID NO: 189848
  derived and/or modified sequence opt5 from hemagglutinin__InfluenzaA__AHM98570

SEQ ID NO: 194871 - RNA, 1701 nt, Artificial Sequence
  derived and/or modified sequence opt5 from hemagglutinin__InfluenzaA__AHM98581
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagcccgguccuggucuuacaucguggagaccagcuccucugacaacggcacgugcuauccgggggauuuuauugacuacgaggaacugcgcgagcagcuuagcuccgucagcucuuucaagagauuugaaaucuuccccaagaccuccagcuggccuaaucacgauucuaacaaaggagugacagccgcuuguccccaugccggcgcgaagggcuuuuauaaaaaucugaucuggcucguuaagaaagggaacuccuacccuaagcugagcaagucuuauauuaaugacaaaggaaaggaggugcuuguccuguggggcauccaccaccccuccaccacagccgaucaacagagccucuaccagaacgcugacaccuacguguucguggggacgucccgguauucuaaaaaguuuaaaccugaaauugccauccgcccgaaggucagagaucaggagggacggaugaauuacuauuggacacugguugagcccggcgacaaaauuaccuucgaagcuacagggaaccugguggugccucgcuacgccuuugcgauggagagaaacgccggaagcggcaucauuaucuccgauacccccguccaugacugcaauaccacaugucaaacgccuaagggcgcuaucaacaccagccuccccuuccagaauauucacccgaucacaauugggaagugcccuaaauaugugaagucuaccaaacugcggcuugccacaggacugcgcaacguucccuccauccagagcagaggccucuuuggggcuauugccggauucaucgaaggcggguggaccggaaugguggacggcugguacggcuaucaucaccagaaugagcaagggucuggauacgccgcugaucuuaagagcacgcagaacgcgaucgacaaaauuacaaauaaggucaacuccgugaucgaaaagaugaauacccaguuuaccgccguuggcaaagaguucaaccaccuugagaagcggauugaaaaucugaacaaaaagguggaugacggguuccucgauaucuggacauacaaugcugagcugcugguccuccuggaaaacgagcgcacccuugacuaucaugauucuaaugugaaaaaccuguacgaaaaggucagaaaccagcucaagaauaacgccaaagagauuggaaauggcuguuuugaguucuaucacaagugcgacaacacauguauggaaagcgugaaaaaugggacguacgauuauccuaaguacuccgaggaagccaaacugaaccgggaggaaaucgacggcguuaagcuggagagcacccgcaucuaucaaauucuggcuaucuacucuacaguggccuccagccucguccuggugguuucucugggagcgauuuccuuuuggaugugcagcaauggcucccuccagugcagaaucuguauuuga

SEQ ID NO: 194872 - RNA, 1701 nt, Artificial Sequence; identical to SEQ ID NO: 189848
  derived and/or modified sequence opt5 from hemagglutinin__InfluenzaA__AHM98592

SEQ ID NO: 194873 - RNA, 1701 nt, Artificial Sequence; identical to SEQ ID NO: 189891
  derived and/or modified sequence opt5 from hemagglutinin__InfluenzaA__AHM98603

SEQ ID NO: 194874 - RNA, 1701 nt, Artificial Sequence; identical to SEQ ID NO: 189478
  derived and/or modified sequence opt5 from hemagglutinin__InfluenzaA__AHM98614

SEQ ID NO: 194875 - RNA, 1701 nt, Artificial Sequence; identical to SEQ ID NO: 194855
  derived and/or modified sequence opt5 from hemagglutinin__InfluenzaA__AHM98625

SEQ ID NO: 194876 - RNA, 1701 nt, Artificial Sequence; identical to SEQ ID NO: 194855
  derived and/or modified sequence opt5 from hemagglutinin__InfluenzaA__AHM98636

SEQ ID NO: 194877 - RNA, 1701 nt, Artificial Sequence
  derived and/or modified sequence opt5 from hemagglutinin__InfluenzaA__AHM98647
augaaggccauccuggugguccuccuguacaccuucgcuacagccaaagcggacacgcuuugcauuggcuaucacgcuaacaauagcaccgauacaguugacaccgugcuggagaagaacgugacagucacccauuccgugaaucuccuggaagauaaacacaacgggaaacuuuguaaacugagaggaguugcgccccuccaucugggcaagugcaauaucgccggguggauucugggaaacccugagugugaaucucucagcacagcuuccucuuggagcuacaucguggagaccuccucuagcgacaauggcacgugcuauccgggggauuuuauuaacuacgaagaacugcgggagcagcuuuccagcgucucuuccuucgaacgcuuugagaucuuccccaagaccagcucuuggccuaaucacgacuccaacaaaggagugacagccgcuuguccccaugccggcgccaagagcuuuuauaaaaaucugaucuggcucguuaagaaaggcaacucuuacccuaagcugucccaaagcuauauuaaugauaaggggaaagaagugcuuguccuguggggaauccaccaccccuccaccacagccgaccagcagucucucuaccagaacgcugaugccuacguguucgugggcaccagcagauauuccaagaaauuuaagccugagauugcuauccggccgaaaguccgcgaccaagaggggagaaugaauuacuauuggacgcugguugaacccggagauaagauuacauucgaggccaccggcaaccugguggugccucgguacgcguuugccauggaacgcaacgcugggagcggaaucauuaucucugacacacccguccaugauugcaauaccaccugucagacaccuaaaggcgccaucaacacgucccuccccuuccagaauauucacccgaucaccauuggcaagugcccuaaguaugugaaaagcacaaagcugagacuugcuaccgggcugcggaacguucccucuauccagagccgcggacucuuuggcgccauugccggguucaucgagggaggcuggacagggaugguggacggaugguacggcuaucaucaccaaaaugaacagggcuccggguacgcugcggaccugaaaucuacccagaacgccaucgauaagauuacgaauaaagucaacagcgugaucgagaagaugaauacacaguuuaccgcuguuggaaaggaguucaaccaccuugaaaagagaauugagaaucugaacaagaaaguggacgauggcuuccucgacaucuggaccuacaaugccgaacugcugguccuccuggagaacgaacggacacuugauuaucaugacuccaaugugaagaaccuguacgagaaaguccgcaaccaacucaagaauaacgccaaggagauugggaauggauguuuugaguucuaucacaaaugcgauaacaccuguauggagagcgugaagaauggcacauacgacuauccuaaauacucugaagaggcuaagcugaacagagaagagaucgaugggguuaaacuugaguccacgcggaucuaucagauucuggccaucuacagcaccguggcgucuucccucguccuggugguuagccugggcgcuauuuccuuuuggaugugcucuaauggaagccuccagugccgcaucuguauuuga

SEQ ID NO: 194878 - RNA, 1701 nt, Artificial Sequence; identical to SEQ ID NO: 189891
  derived and/or modified sequence opt5 from hemagglutinin__InfluenzaA__AHM98658

SEQ ID NO: 194879 - RNA, 1701 nt, Artificial Sequence; identical to SEQ ID NO: 189848
  derived and/or modified sequence opt5 from hemagglutinin__InfluenzaA__AHM98669

SEQ ID NO: 194880 - RNA, 1701 nt, Artificial Sequence; identical to SEQ ID NO: 191210
  derived and/or modified sequence opt5 from hemagglutinin__InfluenzaA__AHM98701

SEQ ID NO: 194881 - RNA, 1701 nt, Artificial Sequence; identical to SEQ ID NO: 191210
  derived and/or modified sequence opt5 from hemagglutinin__InfluenzaA__AHM98712

SEQ ID NO: 194882 - RNA, 1701 nt, Artificial Sequence
  derived and/or modified sequence opt5 from hemagglutinin__InfluenzaA__AHM98723
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaacugcaauaucgccggguggauucugggaaacccugagugugaaucucucagcacagcuuccucuuggagcuacaucguggagaccuccucuagcgacaauggcacgugcuauccgggggauuuuauuaacuacgaggaacugcgggagcagcuuuccagcgucucuuccuucgaacgcuuugagauccugcccaaaaccagcucuuggccuaaucacgacuccaacaagggagugacagccgcuuguccccaagccggcgccaagagcuucuauaaaaaucucaucuggcugguuaagaaaggcaacucuuacccuaaacuuuccaagagcuauauuaaugauaaggggaaggaagugcugguccucuggggaauccaucaccccuccaccucugccgaccagcagagccuguaccagaacgcugaugccuacguguuugugggcacauccaaauauagcaagaaauucaagccugagauugcugucagaccgaaaguucgggaccaagaggggcgcaugaacuacuauuggacccugaucgaacccggagauaagauuacguuugaggccacaggcaaucuccuggugccuagauacgcguucgccauggaacggaacgcugggucuggaaucauuaucuccgacacccccgugcacgauugcaauacaaccugucagaccccuaaaggcgccaucaacacaagccuucccuuucagaauauucauccgaucacgauuggcaagugcccuaaguaugucaaaucuaccaagcugcgccucgcuacagggcugagaaacgugcccagcauccagucccggggacuuuucggcgccauugccggguuuaucgagggaggcuggaccgggaugguugacggaugguacggcuaucaccaucaaaaugcucagggcucuggguacgcggccgaccugaaaagcacacagaacgcuaucgauaagauuaccaauaaagugaacuccgucaucgaaaagaugaauacgcaguucacagccgugggaaaggaguuuaaccaccucgagaaacgcauugaaaaucugaacaagaaaguugacgauggcuuccuggacaucuggaccuacaaugccgagcuccuggugcuucuggaaaacgagagaacccucgauuaucacgacagcaacgucaagaaucuguacgaaaaagugcggucucaacuuaagaacaaugcuaaggagauugggaacggauguuucgaguuuuaucauaaaugcgauaauacauguauggaauccgucaagaacggcaccuacgacuauccucgcuacagcgaggaagccaaacugaauagagaggaaaucgauggggugaagcucgagucuacacggaucuaucagauucuggcgaucuacuccacgguugcuagcucccuggugcucauugucucucugggcgccaucagcuucuggaugugcuccaacggaucucuucagugccgcauuuguaucuga

SEQ ID NO: 194883 - RNA, 1701 nt, Artificial Sequence
  derived and/or modified sequence opt5 from hemagglutinin__InfluenzaA__AHM98734
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaacacucucuaccgccagcuccuggucuuacaucguggagacgagcaacuccgacaaugggaccugcuauccgggggauuuuauugacuacgaagaacugcgggagcagcuuucuagcgucuccagcuucgaacgcuuugagaucuuccccaagacaucuuccuggccuaaccacgauagcaauaagggagugaccgccgcuuguccccaugccggcucuaaaggcuuuuauaagaaccugaucuggcucguuaaaaagggcaauuccuacccuaaacugagcaagucuuauauuaacgacaagggaaaagaagugcuuguccuguggggcauccaccaccccuccacaaccgcggaucaacagagccucuaccagaaugccgacacguacguguucguggggacauccagauauucuaagaaauuuaagccugagauugcuauccggccgaaaguccgcgaucaggagggaagaaugaacuacuauuggacccugguugaacccggcgacaagauuacauucgaggccaccgggaaccugguggugccucgguacgcuuuugccauggaacgcgaugcgggaagcggcaucauuaucuccgacacccccguccaugacugcaauacaacgugucaaaccccuaaaggcgccaucaacacaagccuccccuuccagaauauucacccgaucaccauugggaagugcccuaaguaugugaaaucuacaaagcugagacuugcuaccggacugcggaacguucccuccauccagagccgcggccucuuuggggccauugcuggauucaucgagggcggguggacgggaaugguggauggcugguacggcuaucaucaccagaaugaacaagggucuggauacgccgccgaccugaaaagcacacagaacgcuaucgauaagauuaccaauaaagucaacuccgugaucgagaagaugaauacccaguuuacagcgguuggcaaggaguucaaccaccuugagaaaagaauugagaaucugaacaagaaaguggacgauggguuccucgacaucuggaccuacaaugccgaacugcugguccuccuggagaacgaacggacacuugauuaucaugacucuaaugugaagaaccuguacgagaaaguccgcaaccagcucaagaauaacgcuaaggagauuggaaauggcuguuuugaguucuaucacaaaugcgauaacacguguauggaaagcgugaagaaugggaccuacgacuauccuaaauacuccgaagaggccaagcugaacagagaagagaucgauggcguuaaacuugagagcacacggaucuaucaaauucuggccaucuacucuaccgcugccuccagccucgugcuggucgugucucugggagcgauuuccuuuuggaugugcagcaauggcucccuccagugccgcaucuguauuuga

SEQ ID NO: 194884 - RNA, 1701 nt, Artificial Sequence; identical to SEQ ID NO: 191210
  derived and/or modified sequence opt5 from hemagglutinin__InfluenzaA__AHM98745

SEQ ID NO: 194885 - RNA, 1701 nt, Artificial Sequence
  derived and/or modified sequence opt5 from hemagglutinin__InfluenzaA__AHM98756
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaacacucucuaccgccagcuccuggucuuacaucguggagacgagcuccucugacaacgggaccugcuauccgggcgauuuuauugacuacgaggaacugcgggagcagcuuagcuccgucagcucuuucgaacgcuuugagaucuuccccaagacauccagcuggccuaaucacgauucuaacaagggagugaccgccgcuuguccccaugccggcgcgaaaggcuuuuauaagaaucugaucuggcucguuaaaaaggggaacuccuacccuaaacugagcaagucuuauauuaaugacaagggaaaagaagugcuuguccuguggggcauccaccaccccuccacaaccgccgaucaacagagccucuaccagaacgcugacacguacguguucguggggacauccagauauucuaagaaauuuaagccugagauugccauccggccgaaaguccgcgaucaggagggaagaaugaauuacuauuggacccugguugaacccggcgacaagauuacauucgaggcuaccgggaaccugguggugccucgguacgccuuugcgauggaacgcgaugccggaagcggcaucauuaucuccgacacccccguccaugacugcaacacaacgugucaaaccccuaaaggcgcuaucaauacaagccuccccuuccagaacauucacccgaucaccauugggaagugcccuaaguaugugaaaucuacaaagcugagacuugccaccggacugcggaauguucccuccauccagagccgcggccucuuuggggcuauugccggauucaucgagggcggguggacgggaaugguggauggcugguacggcuaucaucaccagaacgaacaagggucuggauacgccgcugaccugaaaagcacacagaaugcgaucgauaagauuaccaacaaagucaauuccgugaucguuaagaugaacacccaguuuacagccgugggcaaggaguucaaucaccuugagaaaagaauugaaaaccugaauaagaaagucgacgauggguuccucgacaucuggaccuacaacgcugagcugcuggugcuccuggaaaaugagcggacacuugauuaucaugacucuaacgucaagaaucuguacgaaaaagugcgcaaccagcucaagaacaaugccaaggagauuggaaacggcuguuuugaguucuaucacaaaugcgauaauacguguauggaaagcguuaagaacgggaccuacgacuauccuaaauacuccgaggaagccaagcugaauagagaggaaaucgauggcgugaaacuugagagcacacggaucuaucaaauucuggcuaucuacucuaccgccgcguccagccucguccuggugguuucucugggagcuauuuccuuuuggaugugcagcaacggcucccuccagugccgcaucuguauuuga

SEQ ID NO: 194886 - RNA, 1701 nt, Artificial Sequence; identical to SEQ ID NO: 191210
  derived and/or modified sequence opt5 from hemagglutinin__InfluenzaA__AHM98767

SEQ ID NO: 194887 - RNA, 1701 nt, Artificial Sequence
  derived and/or modified sequence opt5 from hemagglutinin__InfluenzaA__AHM98778
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaauagaaaacuuuguaagcugcgcgggguugcuccccuccaucugggaaaaugcaacaucgccggcuggauucuggggaauccugagugugaaucucucagcacagccuccucuuggagcuacaucguggagaccuccucuagcgacaacggaacgugcuauccgggcgauuuuauuaauuacgaggagcugcgggagcagcuuuccagcgucucuuccuucgaaagauuugagaucuuccccaagaccagcucuuggccuaaccacgacuccaauaagggggugacagccgcuuguccccgggccggagcgaaaucuuuuuauaagaaccugaucuggcucguuaaaaagggcaauagcuacccuaaacuguccaagagcuauauuaacgauaagggcaaagaagugcuuguccugugggggauccaucaccccuccaccacagccgaccaacagucucucuaccagaaugcugaugccuacguguucgugggaaccagccgcuauuccaagaaauuuaagccugagauugcuaucagaccgaaaguccgggaccaggagggccgcaugaacuacuauuggacgcugguugaacccggggauaagauuacauucgaggccaccggaaaccugcucgugccuagauacgcguuugccauggaacggaaugcuggcagcgggaucauuaucucugacacacccgugcacgauugcaacaccaccugucaaacaccuaaaggagccaucaauacgucccugcccuuccagaacauucauccgaucaccauuggcaagugcccuaaguaugucaaaagcacaaaacuucgccuggcuaccggccucagaaaugugcccucuauccagagccgggggcuguuuggagccauugccggcuucaucgaagggggauggacaggcaugguugacgggugguacggauaucaccaucagaacgaacaaggcuccggcuacgcugcggaccuuaagucuacccagaaugccaucgauaagauuacgaacaaagugaauagcgucaucgagaagaugaacacacaguuuaccgcuguggggaaggaguucaaucaccuggaaaaacgcauugagaaccucaauaagaaaguugacgauggauuccuggacaucuggaccuacaacgccgaacugcucgugcugcuugagaaugaaagaacacuggauuaucacgacuccaacgucaagaaccucuacgagaaagugcggaaucagcugaagaacaaugccaaggagauuggcaacggguguuuugaguucuaucauaaaugcgauaauaccuguauggaaagcgucaagaacggaacauacgacuauccuaaauacucugaagaggcuaaacuuaaucgcgaagagaucgauggcgugaagcuggaguccacgagaaucuaucaaauucucgccaucuacagcaccguugcgucuucccuggugcuggucgugagccucggggcuauuuccuuuuggaugugcucuaacggcagccugcagugccggaucuguauuuga

SEQ ID NO: 194888 - RNA, 1701 nt, Artificial Sequence; identical to SEQ ID NO: 190074
  derived and/or modified sequence opt5 from hemagglutinin__InfluenzaA__AHM98798

SEQ ID NO: 194889 - RNA, 1701 nt, Artificial Sequence; identical to SEQ ID NO: 189848
  derived and/or modified sequence opt5 from hemagglutinin__InfluenzaA__AHM98809

SEQ ID NO: 194890 - RNA, 1701 nt, Artificial Sequence; identical to SEQ ID NO: 189848
  derived and/or modified sequence opt5 from hemagglutinin__InfluenzaA__AHM98820

SEQ ID NO: 194891 - RNA, 1701 nt, Artificial Sequence; identical to SEQ ID NO: 189848
  derived and/or modified sequence opt5 from hemagglutinin__InfluenzaA__AHM98831

SEQ ID NO: 194892 - RNA, 1701 nt, Artificial Sequence
  derived and/or modified sequence opt5 from hemagglutinin__InfluenzaA__AHM98836
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaaaugcaacaucgccggguggauucugggaaauccugagugugaaucucugagcacagccuccucuuggagcuacaucguggagaccuccucuagcgacaacggcacgugcuauccgggggauuuuauugacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaggcuuuuauaagaaucuuaucuggcugguuaaaaaggggaacagcuacccuaaacucucuaaguccuauauuaaugacaagggaaaagaagugcugguccuuuggggcauccaccaccccagcaccacagccgaucaacagucccuguaccagaacgcugacaccuacguguucguggggacgucuagauauagcaagaaauuuaagccugagauugccauccggccgaaaguccgcgaucaggagggaagaaugaauuacuauuggauucucguugaacccggcgacaagaucacauucgaggcuaccgggaaccugguggugccucgguacgccuuugcgauggaacgcaacgccggauccggcauuaucaucagcgauacacccguccaugacugcaauaccaccugucaaacaccuaaaggcgcuauuaacacgucucugcccuuccagaauauccacccgauuaccaucgggaagugcccuaaguaugugaaauccacaaagcucagacuggccaccggacuucggaacguucccagcauucagucucgcggccuguuuggggcuaucgccggauucaucgagggcggguggacaggaaugguggacggcugguacggcuaucaucaccagaaugaacaagggagcggauacgccgcugaucucaaauccacccagaacgcgauugacaagaucacgaauaaagucaacucugugauugagaagaugaauacacaguuuaccgccguuggcaaggaguucaaccaccuggaaaagagaaucgagaaucuuaacaagaaaguggaugacggguuccuggauauuuggaccuacaaugcugaacuccugguccugcucgagaacgaacggacacuggacuaucaugauagcaaugugaagaaccuuuacgagaaaguccgcaaccagcugaagaauaacgccaaggagaucggaaauggcuguuuugaguucuaucacaaaugcgacaacaccuguauggaguccgugaagaaugggacauacgauuauccuaaauacagcgaagaggccaagcucaacagagaagagaucgacggcguuaaacuggagucuacgcggauuuaucaaauccuugcuauuuacuccaccguggccagcucucugguccucgugguuucccugggagcgaucagcuuuuggaugugcuccaauggcucucugcagugccgcauuuguaucuga

SEQ ID NO: 194893 - RNA, 1701 nt, Artificial Sequence
  derived and/or modified sequence opt5 from hemagglutinin__InfluenzaA__AHM98847
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacgacgggaaacuguguaaacuuagaggaguugcuccccugcaucucggcaaaugcaauaucgccggguggauucugggaaacccugagugugaaucucugagcacagccuccucuuggagcuacaucguggagaccuccucuagcgauaauggcacgugcuauccgggggacuuuauugauuacgaagaacuccgggagcagcuguccagcgucucuuccuucgaacgcuuugagaucuuccccaagaccagcucuuggccuaaccacgacuccaauaagggagugacagccgcuuguccccaugccggcgcgaaaggcuuuuauaagaaccuuaucuggcugguuaaaaaggggaauagcuacccuaaacucucuaaguccuauauuaacgauaagggaaaagaagugcugguccuuuggggcauccaccaccccagcaccacagccgaccaacagucccuguaccagaaugcugauaccuacguguucguggggacgucuagauauagcaagaaauuuaagccugagauugccauccggccgaaaguccgcgaccaggagggaagaaugaacuacuauuggacacucguugaacccggcgauaagauuaccuucgaggcuacagggaaucugguggugccucgguacgccuuugcgauggaacgcaacgccggauccggcaucauuaucagcgacacccccguccaugacugcaacaccacaugucaaacgccuaaaggcgcuaucaauaccucucugcccuuccagaacauucacccgaucacaauugggaagugcccuaaguaugugaaauccaccaagcucagacuggccacaggacuucggaauguucccagcauccagucucgcggccuguuuggggcuauugccggauucaucgagggcggguggaccggaaugguggauggcugguacggcuaucaucaccagaacgaacaagggagcggauacgccgcugaccucaaauccacgcagaaugcgaucgauaagauuacaaacaaagucaauucugugaucgagaagaugaacacccaguuuaccgccguuggcaaggaguucaaucaccuggaaaagagaauugagaaccuuaauaagaaaguggacgauggguuccuggacaucuggacauacaacgcugaacuccugguccugcucgagaaugaacggacccuggauuaucaugacagcaacgugaagaaucuuuacgagaaaguccgcaaccagcugaagaacaaugccaaggagauuggaaacggcuguuuugaguucuaucacaaaugcgauaauacauguauggaguccgugaagaacgggacguacgacuauccuaaauacagcgaagaggccaagcucaauagagaagagaucgauggcguuaaacuggagucuacccggaucuaucaaauucuugcuaucuacuccacaguggccagcucucugguccucgugguuucccugggagcgauuagcuuuuggaugugcuccaacggcucucugcagugccgcaucuguauuuga

SEQ ID NO: 194894 - RNA, 1701 nt, Artificial Sequence; identical to SEQ ID NO: 189848
  derived and/or modified sequence opt5 from hemagglutinin__InfluenzaA__AHM98858

SEQ ID NO: 194895 - RNA, 1701 nt, Artificial Sequence; identical to SEQ ID NO: 189891
  derived and/or modified sequence opt5 from hemagglutinin__InfluenzaA__AHM98877

SEQ ID NO: 194896 - RNA, 1701 nt, Artificial Sequence
  derived and/or modified sequence opt5 from hemagglutinin__InfluenzaA__AHM98898
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaaucacaacgggaaacuuuguaagcugagaggaguugcgccccuccaucugggcaagugcaauaucgccggguggauucugggaaacccugagugugaaucucucagcacagcuuccucuuggagcuacaucguggagaccuccucuagcgacaauggcacgugcuauccgggggauuuuauuaacuacgaagaacugcgggagcagcuuuccagcgucucuuccuucgaacgcuuugagaucuuccccaaaaccagcucuuggccuaaucacgacuccaacaagggagugacagccgcuuguccccaugccggcgccaagagcuuuuauaaaaaucugaucuggcucguuaagaaaggcaacucuuacccuaagcuguccaaaagcuauauuaaugauaaggggaaggaagugcuuguccuguggggaauccaccaccccuccaccacagccgaccaacagucucucuaccagaacgcugaugccuacguguucgugggcaccagcagauauuccaaaaaguuuaaaccugagauugcuauccggccgaagguccgcgaccaggaggggagaaugaacuacuauuggacgcugguugaacccggagauaaaauuacauucgaggccaccggcaaucugguggugccucgguacgcguuugccauggaacgcaacgcugggagcggaaucauuaucucugacacacccguccaugauugcaauaccaccugucaaacaccuaagggcgccaucaacacgucccuccccuuccagaauauucacccgaucaccauuggcaaaugcccuaaguauguuaagagcacaaaacugagacuugcuaccgggcugcggaacgugcccucuauccagagccgcggacucuuuggcgccauugccggguucaucgagggaggcuggacagggaugguggacggaugguacggcuaucaucaccagaaugaacaaggcuccggguacgcugcggaccugaagucuacccagaacgccaucgauaaaauuacgaauaaggucaacagcgugaucgagaaaaugaauacacaguuuaccgcuguuggaaaggaguucaaccaccuugaaaagagaauugagaaucugaacaaaaagguggacgauggcuuccucgacaucuggaccuacaaugccgaacugcugguccuccuggagaacgaacggacacuugauuaucaugacuccaacgugaaaaaucuguacgagaagguccgcaaccagcucaaaaauaacgccaaggagauugggaauggauguuuugaguucuaucacaagugcgauaacaccuguauggagagcgugaaaaauggcacauacgacuauccuaaguacucugaagaggcuaaacugaacagagaagagaucgaugggguuaaacuugaguccacgcggaucuaucaaauucuggccaucuacagcaccguggcgucuucccucguccuggugguuagccugggcgcuauuuccuuuuggaugugcucuaauggaagccuccagugccgcaucuguauuuga

SEQ ID NO: 194897 - RNA, 1701 nt, Artificial Sequence; identical to SEQ ID NO: 193474
  derived and/or modified sequence opt5 from hemagglutinin__InfluenzaA__AHM98909

SEQ ID NO: 194898 - RNA, 1701 nt, Artificial Sequence
  derived and/or modified sequence opt5 from hemagglutinin__InfluenzaA__AHM98932
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugggaggcguugcuccccuccaucuggggaaaugcaacaucgccggauggauucugggcaauccugagugugaaucucucagcacagccuccucuuggagcuacaucguggagaccuccucuagcgacaacgggacgugcuauccgggagauuuuauugacuacgaagaacugagagagcagcuuuccagcgucucuuccuucgaacgguuugagaucuuccccaagaccagcucuuggccuaaucacgauuccaacaagggcgugacagccgcuuguccccaugccggcgcgaaaucuuuuuauaagaaucugaucuggcucguuaaaaagggggacagcuacccuaaacuguccaagagcuauauuaacgauaagggaaaagaagugcuuguccuguggggcauccaccaccccuccaccucugccgaccaacagagccucuaccagaaugcugaugccuacguguucgugggguccagccgcuauucuaagaaauuuaagccugagauugcuaucagaccgaaaguccgggaccgcgagggaagaaugaacuacuauuggacacugguugaacccggcgauaagauuaccuucgaggccacggggaaucugguggugccucgguacgcguuugccauggaacgcaacgcuggauccggcaucauuaucagcgacacacccguccaugacugcaacaccacaugucagaccccuaaaggcgccaucaauaccucucuccccuuccaaaacauucacccgaucacaauugggaagugcccuaaguaugugaaaagcacgaagcugagacuugcuaccggacugcggaauguucccuccauccagucucgcggccucuuuggggccauugccggauucaucgagggcggguggacaggaaugguggauggcugguacggcuaucaucaccagaacgaacaggggagcggauacgcugcggaccugaaauccacccaaaaugccaucgaugagauuacaaacaaggucaauagcgugaucgagaaaaugaacacccaguuuacggcuguuggcaaggaguucaaucaccuugagaagagaauugaaaaccugaauaaaaagguggacgauggguuccucgacaucuggacauacaacgccgagcugcugguccuccuggaaaaugagcggacccuugauuaucaugacucuaacgugaaaaaucuguacgagaagguccgcucccagcucaaaaacaacgccaaggaaauuggaaauggcuguuuugaguucuaucacaagugcgauaacaccuguauggaaagcgugaaaaaugggacauacgacuauccuaaguacucugaggaagcuaaacugaacagagaggagaucgauggcguuaaacuugaauccacccggaucuaucagauucuggccaucuacagcacaguggcguccucucucguccuggugguuagccugggagcuauuuccuuuuggaugugcucuaauggcagccuccaaugccgcaucuguauuuga

SEQ ID NO: 194899 - RNA, 1701 nt, Artificial Sequence; identical to SEQ ID NO: 194898
  derived and/or modified sequence opt5 from hemagglutinin__InfluenzaA__AHM98940

SEQ ID NO: 194900 - RNA, 1701 nt, Artificial Sequence; identical to SEQ ID NO: 194898
  derived and/or modified sequence opt5 from hemagglutinin__InfluenzaA__AHM98951

SEQ ID NO: 194901 - RNA, 1701 nt, Artificial Sequence
  derived and/or modified sequence opt5 from hemagglutinin__InfluenzaA__AHM98975
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaauccaacaagggagugacagccgcuuguccccaugccggcgcgaaaucuuuuuauaagaaucugaucuggcucguuaaaaagggcaacagcuacccuaaacuguccaagagcuauauuaaugauaaggggaaagaggugcuuguccuguggggaauccaccaccccuccaccucugccgaccaacagagccucuaccagaacgcugaugccuacguguucgugggcuccagcagauauucuaagaaauuuaagccugagauugcuauccggccgaaaguccgcgaccaggaagggagaaugaauuacuauuggacacugguugagcccggagauaagauuaccuucgaagccacgggcaaccugguggugccucgguacgcguuugccauggagcgcaacgcuggguccggaaucauuaucagcgacacacccguccaugauugcaauaccacaugucaaaccccuaaaggcgccaucaacaccucucuccccuuccagaauauucacccgaucacaauuggcaagugcccuaaguaugugaaaagcacgaagcugagacuugcuaccgggcugcggaacguucccuccauccagucucgcggacucuuuggcgccauugccggguucaucgaaggaggcuggacagggaugguggacggaugguacggcuaucaucaccagaaugagcaaggcagcggguacgcugcggaccugaaauccacccagaacgccaucgaugagauuacaaauaaggucaacagcgugaucgaaaagaugaauacccaguuuacggcuguuggaaaggaguucaaccaccuugaaaagagaauugagaaucugaacaaaaagguggacgauggcuuccucgacaucuggacauacaaugccgaacugcugguccuccuggagaacgagcggacccuugauuaucaugacucuaaugugaaaaaccuguacgaaaagguccgcucccagcucaaaaacaaugccaaggagauugggaacggauguuuugaguucuaucacaagugcgauaauaccuguauggagagcgugaaaaacggcacauacgacuauccuaaguacucugaagaggcuaaacugaauagagaggaaaucgaugggguuaaacuugaguccacccggaucuaucaaauucuggccaucuacagcacaguggcguccucucucguccuggugguuagccugggcgcuauuuccuuuuggaugugcucuaacggaagccuccagugccgcaucuguauuuga

SEQ ID NO: 194902 - RNA, 1701 nt, Artificial Sequence
  derived and/or modified sequence opt5 from hemagglutinin__InfluenzaA__AHM98997
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcgacagcuacccuaaacuguccaagagcuauauuaacgauaaggggaaagaagugcuuguccuguggggaauccaccaccccuccaccucugccgaccaacagagccucuaccagaaugcugaugccuacguguucgugggcuccagcagauauucuaagaaauuuaagccugagauugcuauccggccgaaaguccgcgggcaggagggaagaaugaacuacuauuggacacugguugaacccggcgacaagauuaccuucgaggccacggggaaucugguggugccucgguacgcguuugccauggaacgcaacgcuggauccggcaucauuaucagcgauacacccguccaugacugcaacaccacaugucaaaccccuaaaggcgccaucaauaccucucuccccuuccagaacauucacccgaucacaauugggaagugcccuaaguaugugaaaagcacgaagcugagacuugcuaccggacugcggaauguucccuccauccagucucgcggccucuuuggggccauugccggauucaucgagggcggguggacaggaaugguggacggcugguacggcuaucaucaccagaacgaacaagggagcggauacgcugcggaucugaaauccacccagaaugccaucgacgagauuacaaacaaggucaauagcgugaucgagaaaaugaacacccaguuuacggcuguuggcaaggaguucaaucaccuugagaagagaauugaaaaccugaauaaaaagguggaugacggguuccucgauaucuggacauacaacgccgagcugcugguccuccuggaaaaugagcggacccuugacuaucaugauucuaacgugaaaaaucuguacgagaagguccgcucccagcucaaaaacaacgccaaggaaauuggaaauggcuguuuugaguucuaucacaagugcgacaacaccuguauggaaagcgugaaaaaugggacauacgauuauccuaaguacucugaggaagcuaaacugaacagagaggagaucgacggcguuaaacuugaauccacccggaucuaucaaauucuggccaucuacagcacaguggcguccucucucguccuggugguuagccugggagcuauuuccuuuuggaugugcucuaauggcagccuccagugccgcaucuguauuuga

SEQ ID NO: 194903 - RNA, 1701 nt, Artificial Sequence
  derived and/or modified sequence opt5 from hemagglutinin__InfluenzaA__AHM99019
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugaaaggaguugcgccccuccaucugggcaagugcaacaucgccggguggauucugggaaauccugagugugaaucucucagcacagcuuccucuuggagcuacaucguggagaccuccucuagcgacaacggcacgugcuauccgggggauuuuauugacuacgaagaacugagagagcagcuuuccagcgucucuuccuucgaacgguuugagaucuuccccaagaccagcucuuggccuaaucacgauuccaacaaaggagugacagccgcuuguccccaugccggcgccaagagcuuuuauaaaaaucugaucuggcucguuaagaaaggcgacucuuacccuaagcuguccaagagcuauauuaacgauaaagggaaggaagugcuuguccuguggggaauccaccaccccuccaccucugccgaccaacagagccucuaccagaaugcugaugccuacguguucgugggcuccagccgcuauucuaaaaaguuuaaaccugagauugcuaucagaccgaagguccgggggcaggagggacgcaugaacuacuauuggacacugguugaacccggcgacaaaauuaccuucgaggccacggggaaucugguggugccuagauacgcguuugccauggaacggaacgcuggauccggcaucauuaucagcgauacacccguccaugacugcaacaccacaugucaaaccccuaagggcgccaucaauaccucucuccccuuccagaacauucacccgaucacaauugggaagugcccuaaauauguuaagagcacgaaacugcgccuugcuaccggacugagaaaugugcccuccauccagucucggggccucuuuggggccauugccggauucaucgagggcggguggacaggaaugguggacggcugguacggcuaucaucaccagaacgaacaagggagcggauacgcugcggaucugaaguccacccagaaugccaucgacgagauuacaaacaaagucaauagcgugaucgagaagaugaacacccaguuuacggcuguuggcaaggaguucaaucaccuugagaaacgcauugaaaaccugaauaagaaaguggaugacggguuccucgauaucuggacauacaacgccgagcugcugguccuccuggaaaaugagagaacccuugacuaucaugauucuaacgugaagaaucuguacgagaaaguccggucccagcucaagaacaacgccaaggaaauuggaaauggcuguuuugaguucuaucacaaaugcgacaacaccuguauggaaagcgugaagaaugggacauacgauuauccuaaauacucugaggaagcuaagcugaaccgcgaggagaucgacggcguuaaacuugaauccaccagaaucuaucaaauucuggccaucuacagcacaguggcguccucucucguccuggugguuagccugggagcuauuuccuuuuggaugugcucuaauggcagccuccagugccggaucuguauuuga

SEQ ID NO: 194904 - RNA, 1701 nt, Artificial Sequence; identical to SEQ ID NO: 194903
  derived and/or modified sequence opt5 from hemagglutinin__InfluenzaA__AHM99031

SEQ ID NO: 194905 - RNA, 1701 nt, Artificial Sequence; identical to SEQ ID NO: 194903
  derived and/or modified sequence opt5 from hemagglutinin__InfluenzaA__AHM99043

SEQ ID NO: 194906 - RNA, 1701 nt, Artificial Sequence; identical to SEQ ID NO: 194903
  derived and/or modified sequence opt5 from hemagglutinin__InfluenzaA__AHM99054

SEQ ID NO: 194907 - RNA, 1701 nt, Artificial Sequence; identical to SEQ ID NO: 194903
  derived and/or modified sequence opt5 from hemagglutinin__InfluenzaA__AHM99065

SEQ ID NO: 194908 - RNA, 1701 nt, Artificial Sequence
  derived and/or modified sequence opt5 from hemagglutinin__InfluenzaA__AHM99075
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcgacagcuacccuaaacuguccaagagcuauauuaacgauaaggggaaagaagugcuuguccuguggggaauccaccaccccuccaccucugccgaccaacagagccucuaccagaaugcugaugccuacguguucgugggcuccagcagauauucuaagaaauuuaagccugagauugcuauccggccgaaaguccgcgaccaggaggggagaaugaacuacuauuggacacugguugaacccggagauaagauuaccuucgaggccacgggcaaucugguggugccucgguacgcguuugccauggaacgcaacgcuggguccggaaucauuaucagcgacacacccguccaugacugcaacaccacaugucaaaccccuaaaggcgccaucaauaccucucuccccuuccagaacauucacccgaucacaauuggcaagugcccuaaguaugugaaaagcacgaagcugagacuugcuaccgggcugcggaauguucccuccauccagucucgcggacucuuuggcgccauugccggguucaucgagggaggcuggacagggaugguggauggaugguacggcuaucaucaccagaacgaacaaggcagcggguacgcugcggaccugaaauccacccagaaugccaucgaugagauuacaaacaaggucaauagcgugaucgagaaaaugaacacccaguuuacggcuguuggaaaggaguucaaucaccuugagaagagaauugaaaaccugaauaaaaagguggacgauggcuuccucgacaucuggacauacaacgccgagcugcugguccuccuggaaaaugagcggacccuugauuaucaugacucuaacgugaaaaaucuguacgagaagguccgcucccagcucaaaaacaacgccaaggaaauugggaauggauguuuugaguucuaucacaagugcgauaacaccuguauggaaagcgugaaaaauggcacauacgacuauccuaaguacucugaggaagcuaaacugaacagagaggagaucgaugggguuaaacuugaauccacccggaucuaucaaauucuggccaucuacagcacaguggcguccucucucguccuggugguuagccugggcgcuauuuccuuuuggaugugcucuaauggaagccuccagugccgcaucuguauuuga

SEQ ID NO: 194909 - RNA, 1701 nt, Artificial Sequence
  derived and/or modified sequence opt5 from hemagglutinin__InfluenzaA__AHN00717
augaaggccauccugcucgugcugcuuugcaccuucgcugccacaaacgcggacacgcuguguauuggcuaccacgcuaauaacagcaccgauacagucgacaccguucucgagaaaaaugugacagugacccauuccgucaaccugcuugaagauagacacaaugggaagcugugcaaacucggaggcaucgcuccccugcaucuggggaaguguaacauugccggauggcuccugggcaauccugagugcgaacuucuguuuacagugucuagcugguccuauaucguugagaccucuaacagcgacaaugggacguguuacccgggagauuucauuaacuaugaggaacuccgggagcagcuguccucugugagcuccuuugaacgcuucgagaucuuucccaaaaccagcucuuggccuaaucacgaaacaaacagaggcgucaccgccgccugccccuacgcuggcgccaauuccuucuaucggaaccuuaucuggcuggugaagaaggggaauagcuacccuaaacucucuaaguccuauguuaacaacaaaggaaaggaggugcugguccuguggggcauucaucaucccccuacaagcaccgaccaacagucucucuaccagaaugcggaugccuacguguuugugggguccagcaaauauaaccgcaaguucaagccggagaucgcugccagacccaaaguccggggacaggcuggccgcaugaauuacuauuggacgcugauugaaccuggggacacaaucaccuuugaggccacaggaaaccuuguugugcccagauacgcguucgccaugaaucggggcccuggcuccgggauuaucauuucugaugcucccgugcacgacuguaacacaaccugccaaaccccgaagggagccaucaauacgagccugccuuuucagaacauccaccccgucaccauuggcgaauguccuaaauaugugaaguccacaaaacuccgcauggcuaccgggcugagaaauauccccagcauucagucucggggacuuuucggcgccaucgccggguuuauugagggaggcuggacaggcaugaucgaugggugguacggauaucaccaucagaacgaacaaggcuccggguacgcugcggaccaaaagagcacccagaaugccaucgauggaauuacgaacaaaguuaauucugugaucaagaagaugaacacacaguucaccgcugucggcaaagaguucaaucaccuggagaagcgcauugaaaaccucaacaaaaagguggacgacggguuucuggauguuuggaccuacaaugccgagcugcucgugcugcuugaaaacgagagaacacuggacuuccacgauagcaaugucaaaaaccucuaugaaaaggugcggucccagcugcgcaauaacgccaaggagaucggcaauggaugcuuugaguucuaccauaaaugugacgauaccugcauggaaucugucaagaacggcacauaugacuaccccaaauauagcgaggaauccaaacuuaauagagaggaaauugauggggugaagcuggagagcacgcggaucuaccagauccucgcuauuuauucuaccgccgcguccagccugguucugcucgugucucugggagcuaucuccuuuuggaugugcagcaacggcucccuucaguguagaauuugcaucuga

SEQ ID NO: 194910 - RNA, 1701 nt, Artificial Sequence
  derived and/or modified sequence opt5 from hemagglutinin__InfluenzaA__AHN00764
augaaggccauccugcucgugcugcuuugcaccuucgcugccacaaacgcggacacgcuguguauuggcuaccacgcuaauaacagcaccgauacagucgacaccguucucgagaaaaaugugacagugacccauuccgucaaccugcuugaagauaagcacaaugggaaacugugcaagcucggaggcaucgcuccccugcaucuggggaaauguaacauugccggauggcuccugggcaauccugagugcgaacuucuguuuacagugucuagcugguccuauaucguugagaccucuaacagcgacaaugggacguguuacccgggagauuucauuaacuaugaggaacucagagagcagcuguccucugugagcuccuuugaacgguucgagaucuuucccaagaccagcucuuggccuaaucacgaaacaaaccgcggcgucaccgccgccugccccuacgcuggcgccaauuccuucuauagaaaccuuaucuggcuggugaagaaagggaauagcuacccuaagcucucuaaauccuauguuaacaacaagggaaaagaggugcugguccuguggggcauucaucaucccccuacaagcaccgaccaacagucucucuaccagaaugcggaugccuacguguuugugggguccagcaaguauaaccggaaguucaaaccggagaucgcugcccgccccaaggucagaggacaggcuggccggaugaauuacuauuggacgcugauugaaccuggggacacaaucaccuuugaggccacaggaaaccuuguugugccccgcuacgcguucgccaugaauagaggcccuggcuccgggauuaucauuucugaugcucccgugcacgacuguaacacaaccugccaaaccccgaaaggagccaucaauacgagccugccuuuucagaacauccaccccgucaccauuggcgaauguccuaaguaugugaaauccacaaagcuccggauggcuaccgggcugcgcaauauccccagcauucagucuagaggacuuuucggcgccaucgccggguuuauugagggaggcuggacaggcaugaucgaugggugguacggauaucaccaucagaacgaacaaggcuccggguacgcugcggaccagaaaagcacccagaaugccaucgauggaauuacgaacaagguuaauucugugaucaagaaaaugaacacacaguucaccgcugucggcaaggaguucaaucaccuggagaaacggauugaaaaccucaacaagaaaguggacgacggguuucuggauguuuggaccuacaaugccgagcugcucgugcugcuugaaaacgagcgcacacuggacuuccacgauagcaaugucaagaaccucuaugaaaaggugagaucccaacugcggaauaacgccaaagagaucggcaauggaugcuuugaguucuaccauaagugugacgauaccugcauggaaucugucaaaaacggcacauaugacuaccccaaguauagcgaggaauccaaacuuaaucgcgaggaaauugauggggugaagcuggagagcacgagaaucuaccagauccucgcuauuuauucuaccgccgcguccagccugguucugcucgugucucugggagcuaucuccuuuuggaugugcagcaacggcucccuucagugucggauuugcaucuga

SEQ ID NO: 194911 - RNA, 1683 nt, Artificial Sequence
  derived and/or modified sequence opt5 from hemagglutinin__InfluenzaA__AHN96323
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccaauauuccucgcaucuguuccaagggcaaaagaacaguugaucuggggcaaugcggacuccugggcaccaucacggggccgccccagugugaccaguuucuugaguucucugccgaucugauuaucgaacggcgcgagggaagcgacgugugcuacccuggcaaguuugucaacgaggaagcccucagacagauucugcgggaguccggcgggaucgauaaagaagcuaugggauucaccuauucuggcauucgcacaaauggggccaccagcgcuuguagacgguccggaucuagcuuuuacgccgagaugaaguggcugcucuccaacacagacaaugcggccuucccccaaaugaccaagagcuauaaaaacacgcgcaagucuccugcucugaucguguggggcauucaccauuccguuagcacagccgagcagaccaaacuuuacgggucuggaaauaagcuggugacagucggcuccagcaacuaucagcagucuuuugugcccuccccuggcgcuagaccgcaagugaaugggcucagcggacggaucgauuuccacuggcugaugcuuaaccccaaugacaccgucaccuuuuccuucaacggcgccuuuaucgcgccugaucgcgccucuuuccugagagggaaaagcaugggcauucaguccggaguucagguggacgcuaacugcgaaggggauuguuaccauagcggaggcacaaucauuucuaaucuccccuuucagaacaucgacucccgggccgugggcaagugcccucgcuaugucaagcaaagaagccugcugcucgcuacggggaugaaaaaugugcccgagauuccgaagggacggggccuguucggggccaucgccggauucaucgaaaacggcugggaggggcuuauugauggcugguacggauuuagacaccagaaugcucagggcgaagggaccgcggccgacuacaaaucuacacaaagcgcuaucgaccagauuaccggaaagcugaaccgccucaucgagaaaacaaaucagcaguucgagcugauugauaacgaauuuaaugagguugaaaagcaaaucggcaacgugaucaauuggacccgggacuccauuacggaggucuggucuuauaacgccgaacuucugguggccauggagaaucagcacacaaucgaucucgcugacagcgagauggauaaacuguacgaaagaguuaagcgccagcugcgggagaacgccgaagaggacgggaccggauguuucgaaauuuuucauaagugcgaugacgauuguauggcguccaucagaaauaacaccuaugaccacagcaaauaccgcgaggaggcuaugcagaaccggauucaaaucgauccugugaagcucucuuccggcuauaaagacgucauucugugguucagcuuuggggccucuugcuucauccuucuggccaucgugaugggccucgucuuuauuugcgugaagaauggaaacaugagauguacaaucggcauuuga

SEQ ID NO: 194912 - RNA, 1701 nt, Artificial Sequence; identical to SEQ ID NO: 190006
  derived and/or modified sequence opt5 from hemagglutinin__InfluenzaA__AHN96442

SEQ ID NO: 194913 - RNA, 1701 nt, Artificial Sequence
  derived and/or modified sequence opt5 from hemagglutinin__InfluenzaA__AHN96443
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuauacgucucuccggagccugguugcuuccagcgggacccuugaauuuaauaacgagucuuucaauuggacaggagugacccagaacggcacauccagcgccugcauccgcagaucuaauaacuccuuuuucagccggcugaauuggcucacccaccugaacuuuaaguacccugcucuuaacgucacgaugcccaauaacgagcaguucgauaagcuguauauuuggggcgugcaucacccugggacagacaaagaucagaucuuucucuacgcccaagcgucuggacgcauuaccguuuccacaaagagaagccagcaggccgugaucccgaauauuggcucccggccccgcgucagaaacaucccuucucgggugagcaucuauuggaccauugugaaacccggggacauccugcugauuaauuccaccggaaaccucaucgcuccucgcggcuacuucaagauuagaagcgggaaaucuuccaucaugcggagcgaugcccccaucggaaaguguaauucugcuugcauuacaccgaacggcagcaucccuaaugacaagcccuuucagaacgucaaucgcauuacguacggcgccuguccuagauauguuaaacaaaacacccugaaacuugcgacagggaugcggaaugugcccgaaaaacagacccgcggaaucuucggcgccauugcuggguuuaucgagaacggaugggaaggcaugguggacgggugguacggauucagacaccaaaauuccgagggccggggccaggccgcugaucugaagucuacacaggccgccaucgaccagauuaacgggaaacucaacagacugaucggaaagaccaaugagaaauuccaucagauugaaaaggaguuuagcgaagucgagggccgcauccaagaucuugaaaaguauguggaggacacgaaaauugaucugugguccuacaacgcugagcuccugguugcgcuggaaaaucagcacacaaucgaccucaccgauagcgagaugaacaagcuguucgaaaagaccaagaaacagcuucgggagaaugccgaagacauggggaacggaugcuuuaagauuuaucauaagugugauaaugcuugcaucggcucuaucagaaacgggacauacgaccacgauguguaucgcgacgaggcccugaauaaccgguuccagauuaaaggcgucgagcucaaguccggauacaaagacuggauccuguggauuagcuuugccaucucuugcuuccuucuguguguggcucuccugggcuuuauuaugugggccugccaaaaggggaauaucagauguaacaucugcauuuga

SEQ ID NO: 194914 - RNA, 1701 nt, Artificial Sequence
  derived and/or modified sequence opt5 from hemagglutinin__InfluenzaA__AHN96444
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauaacuccuuuuucucucgccugaauuggcucacccaucugaacuuuaaguauccugcccuuaacgucacaaugcccaauaaccagcaguucgacaagcuguacaucuggggcgugcaccauccugggaccgauaaagaccagauuuuucucuaugcgcaaagcucuggaagaaucacgguuuccacaaagcggagccagcaggccgugauuccgaauaucggcucccgccccagaauccggaacauuccuucucgcaucagcauuuacuggaccaucgucaaacccggggauauucugcugaucaauuccacaggaaaccucaucgcuccuagaggcuacuucaagauucggagcgggaaaucuuccaucaugcgcagcgacgcccccauuggaaaguguaagucugagugcaucaccccgaauggcagcauuccuaacgacaaacccuuucagaaugugaacagaaucaccuauggcgcuuguccucgguacgugaagcaauccacacugaaacuugccacggggaugcgcaauguccccgaaaagcagaccagaggaaucuucggcgcgauugccggguuuaucgagaacggaugggaaggcaugguugaugggugguauggauuccggcaccaaaauucugagggcagaggccaggcugccgaccugaaaagcacacaggcugccauugaucagaucaacgggaagcucaaucgccugauuggaaaaaccaacgagaaguuccaccagaucgaaaaggaguuuuccgaaguggagggccggauucaagaccuugaaaaauacguggaggauacaaagaucgaccuguggagcuauaacgccgagcuccuggucgcucuggaaaaucagcauaccaucgaucucacggacucugagaugaacaaacuguucgaaaagaccaaaaagcagcuuagagagaaugcggaagauauggggaacggaugcuuuaagauuuaccacaaaugugacaaugccugcaucggcuccauucgcaacgggacauaugaucaugacguguaccgggacgaggcucugaauaacagauuccagaucaagggcauugagcucaaaagcggauacaaggauuggauccuguggaucucuuuugccauuuccugcuuccuucuguguguugcccuccugggcuuuaucaugugggcuugccaaaaagggaauauucgcuguaacaucugcauuuga

SEQ ID NO: 194915 - RNA, 1701 nt, Artificial Sequence
  derived and/or modified sequence opt5 from hemagglutinin__InfluenzaA__AHN96445
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauaacuccuuuuucucucgccugaauuggcucacccaucugaacuuuaaguauccugcccuuaacgucacaaugcccaauaaccagcaguucgacaagcuguacaucuggggcgugcaccauccugggaccgauaaagaccagauuuuucucuaugcgcaaagcucuggaagaaucacgguuuccacaaagcggagccagcaggccgugauuccgaauaucggcucccgccccagaauccggaacauuccuucucgcaucagcauuuacuggaccaucgucaaacccggggauauucugcugaucaauuccacaggaaaccucaucgcuccuagaggcuacuucaagauucugagcgggaaaucuuccaucaugcggagcgacgcccccauuggaaaguguaagucugagugcaucaccccgaauggcagcauuccuaacgacaaacccuuucagaaugugaaccgcaucaccuauggcgcuuguccuagauacgugaagcaauccacacuuaaacuggccacggggaugcggaauguccccgaaaagcagacccgcggaaucuucggcgcgauugccggguuuaucgagaacggaugggaaggcaugguugaugggugguauggauucagacaccaaaauucugagggccggggccaggcugccgaccucaaaagcacacaggcugccauugaucagaucaacgggaagcugaauagacuuauuggaaaaaccaacgagaaguuccaccagaucgaaaaggaguuuuccgaaguggagggccgcauucaagaccuggaaaaauacguggaggauacaaagaucgaccucuggagcuauaacgccgagcugcuggucgcucucgaaaaucagcauaccaucgaucugacggacucugagaugaacaaacuuuucgaaaagaccaaaaagcagcugcgggagaaugcggaagauauggggaacggaugcuuuaagauuuaccacaaaugugacaaugccugcaucggcuccauuagaaacgggacauaugaucaugacguguaccgcgacgaggcucucaauaaccgguuccagaucaagggcguugagcugaaaagcggauacaaggauuggauucuuuggaucucuuuugccaucuccugcuuccugcucuguguggcccugcugggcuuuauuaugugggcuugccaaaaagggaauaucagauguaacauuugcaucuga

SEQ ID NO: 194916 - RNA, 1701 nt, Artificial Sequence
  derived and/or modified sequence opt5 from hemagglutinin__InfluenzaA__AHN96447
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugguugauggaugguauggcuucagacaccagaacagcgagggccgggggcaggccgcugaccugaaauccacccaagccgccauugaucagaucaauggaaagcucaacagacugauuggcaaaacaaaugaaaaguuccaccagaucgagaaggaauuuagcgagguggaagggcgcauucaggaccuugagaaauacguggaggauaccaagaucgaccuguggucuuauaacgcugaacuccuggucgcgcuggagaaccaacauacaaucgaucucaccgacuccgaaaugaauaaacuguucgagaagacgaaaaagcagcuucgggaaaacgccgaggauaugggaaauggcugcuuuaagauuuaccacaaaugugacaacgcuugcaucgggagcauuagaaauggcacauaugaucaugacguguaccgcgacgaggcccugaacaaucgguuccagaucaagggaguugaacucaaaucuggcuacaaggauuggauucuguggaucuccuuugccaucagcugcuuccuucugugugugguccuccugggguuuauuaugugggcuugccagaaaggaaacaucagauguaauauuugcaucuga

SEQ ID NO: 194917 - RNA, 1701 nt, Artificial Sequence
  derived and/or modified sequence opt5 from hemagglutinin__InfluenzaA__AHV83765
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauauguuaagagcaccaagcugagacuugccacagggcugcggaaugugcccucuauccagagccgcggacucuuuggcgcuauugccggguucaucgaaggaggcuggaccgggaugguggacggaugguacggcuaucaucaccaaaacgagcagggcuccggguacgccgcugaccugaaaucuacgcagaaugcgaucgauaagauuacaaacaaagucaauagcgugaucgagaagaugaacacccaguuuaccgccguuggaaaagaguucaaucaccuugagaagagaauugaaaaccugaauaagaaaguggacgauggcuuccucgacaucuggacauacaacgcugagcugcugguccuccuggaaaaugagcggacccuugauuaucaugacuccaacgugaagaaccuguacgagaaaguccgcaaucaacucaagacaaacgccaaagaaauugggaauggauguuuugaguucuaucacaagugcgauaacacguguauggaaagcgugaagaauggcaccuacgacuauccuaaauacucugaggaagccaagcugaacagagagaaaaucgaugggguuaaacuugaguccacacggaucuaucagauucuggcuaucuacagcaccguggccucuucccucguccuggugguuagccugggcgcgauuuccuuuuggaugugcucuaauggaagccuccagugccgcaucuguauuuga

SEQ ID NO: 194918 - RNA, 1701 nt, Artificial Sequence; identical to SEQ ID NO: 194045
  derived and/or modified sequence opt5 from hemagglutinin__InfluenzaA__AHV83766

SEQ ID NO: 194919 - RNA, 1701 nt, Artificial Sequence; identical to SEQ ID NO: 193064
  derived and/or modified sequence opt5 from hemagglutinin__InfluenzaA__AHV83767

SEQ ID NO: 194920 - RNA, 1701 nt, Artificial Sequence
  derived and/or modified sequence opt5 from hemagglutinin__InfluenzaA__AHV83768
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauuaauuacgaagaacugcgggagcagcuuuccagcgucucuuccuucgaacgcuuugagaucuuccccaagacaagcucuuggccuaaccacgacuccaauaagggagugaccgcugccuguccccaugcuggcgccaagagcuuuuauaagaaccugaucuggcucguuaaaaagggcaauucuuacccuaaacugucccaaagcuauauuaacgauaaggggaaggaagugcuuguccuguggggaauccaccaccccuccacaaccgcggaccagcagucucucuaccagaaugccgaugcuuacguguucgugggcacgagcagauauuccaaaaaguuuaaaccugagauugccauccggccgaagguccgcgaccaagaggggagaaugaacuacuauuggacacugcuggaacccggagauaaaauuaccuucgaggcuacaggcaaccucguugugccucgguacgccuuuaccauggaacgcaaugcggggagcggaaucauuaucucugacacccccgugcaugauugcaacacaacgugucagaccccugagggcgccaucaauacaucccugcccuuccagaacauucacccgaucaccauuggcaagugcccuaaauaugucaagagcacaaaacuuagacuggcuaccgggcuccggaaugugcccucuauccagagccgcggacuguuuggcgccauugcuggguucaucgaaggaggcuggacggggaugguugacggaugguacggcuaucaucaccaaaacgagcagggcuccggguacgccgccgaccuuaaaucuacacagaaugcuaucgauaagauuaccaacaaagugaauagcgucaucgagaagaugaacacccaguuuacagcggugggaaaagaguucaaucaccuggagaagagaauugaaaaccucaauaagaaaguugacgauggcuuccuggacaucuggaccuacaacgccgagcugcucgugcugcuugaaaaugagcggacacuggauuaucaugacuccaacgucaagaaccucuacgagaaagugcgcaaucaacugaagaacaaugcuaaagaaauugggaacggauguuuugaguucuaucacaagugcgauaauacguguauggacagcgucaagaacggcaccuacgauuauccuaaauacucugaagaggccaaacuuaauagagaaaagaucgacggggugaagcuggaguccacacggaucuaucagauucucgccaucuacagcaccguugcuucuucccuggugcuggucgugagccucggcgccauuuccuuuuggaugugcucuaacggaagccugcagugccgcaucuguauuuga

SEQ ID NO: 194921 - RNA, 1701 nt, Artificial Sequence; identical to SEQ ID NO: 194022
  derived and/or modified sequence opt5 from hemagglutinin__InfluenzaA__AHV83770

SEQ ID NO: 194922 - RNA, 1701 nt, Artificial Sequence
  derived and/or modified sequence opt5 from hemagglutinin__InfluenzaA__AHV83771
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacaaccgaccagcagucucucuaccagaaugccgaugcuuacguguucgugggcacgagcagauauuccaaaaaguuuaaaccugagauugccauccggccgaagguccgcgaccaagaggggagaaugaacuacuauuggacacugguugaacccggagauaaaauuaccuucgaggcuacaggcaaccugguggugccucgguacgccuuuaccauggaacgcaaugcggggagcggaaucauuaucucugacacccccguccaugauugcaacacaacgugucagaccccugagggcgccaucaauacaucccuccccuuccagaacauucacccgaucaccauuggcaagugcccuaaauauguuaagagcacaaagcugagacuugcuaccgggcugcggaaugugcccucuauccagagccgcggacucuuuggcgccauugcuggguucaucgaaggaggcuggacggggaugguggacggaugguacggcuaucaucaccaaaacgagcagggcuccggguacgccgccgaccagaaaucuacacagaaugcuaucgauaagauuaccaacaaagucaauagcgugaucgagaagaugaacacccaauuuacagcgguuggaaaagaguucaaucaccuggagaagagaauugaaaaccuuaauaagaaaguggacgauggcuuccuggacaucuggaccuacaacgccgagcuccugguccugcucgaaaaugagcggacacuggauuaucaugacuccaacgugaagaaccuuuacgagaaaguccgcaaucagcugaagaacaaugcuaaagaaauugggaacggauguuuugaguucuaucacaagugcgauaauacguguauggaaagcgugaagaacggcaccuacgacuauccuaaauacucugaggaagccaagcucaauagagagaaaaucgaugggguuaagcuggaguccacacggaucuaucagauucuugccaucuacagcaccguggcuucuucccugguccucgugguuagccugggcgccauuuccuuuuggaugugcucuaacggaagccugcaaugccgcaucuguauuuga

SEQ ID NO: 194923 - RNA, 1701 nt, Artificial Sequence; identical to SEQ ID NO: 193064
  derived and/or modified sequence opt5 from hemagglutinin__InfluenzaA__AHV83772

SEQ ID NO: 194924 - RNA, 1701 nt, Artificial Sequence; identical to SEQ ID NO: 193064
  derived and/or modified sequence opt5 from hemagglutinin__InfluenzaA__AHV83773

SEQ ID NO: 194925 - RNA, 1701 nt, Artificial Sequence; identical to SEQ ID NO: 193064
  derived and/or modified sequence opt5 from hemagglutinin__InfluenzaA__AHV83774

SEQ ID NO: 194926 - RNA, 1701 nt, Artificial Sequence
  derived and/or modified sequence opt5 from hemagglutinin__InfluenzaA__AHV83775
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauauguuaagagcaccaagcugagacuugccacagggcugcggaauauccccucuauucagagccgcggacucuuuggcgcuaucgccggguucaucgaaggaggcuggaccgggaugguggacggaugguacggcuaucaucaccaaaacgagcagggcuccggguacgccgcugaccugaaaucuacgcagaaugcgauugauaagaucacaaacaaagugaauagcgucauugagaagaugaacacccaguuuaccgccgugggaaaagaguucaaucaccuugagaagagaaucgaaaaccugaauaagaaaguugacgauggcuuccucgacauuuggacauacaacgcugagcugcuggugcuccuggaaaaugagcggacccuugauuaucaugacuccaacgucaagaaccuguacgagaaagugcgcaaucaacucaagaacaaugccaaagaaaucgggaacggauguuuugaguucuaucacaagugcgauaauacauguauggaaagcgucaagaacggcacguacgacuauccuaaauacucugaggaagccaagcugaauagagagaaaaucgauggggugaaacuugaguccacccggauuuaucagauccuggcuauuuacagcacaguugccucuucccucgugcuggucgugagccugggcgcgaucuccuuuuggaugugcucuaacggaagccuccagugccgcauuuguaucuga

SEQ ID NO: 194927 - RNA, 1701 nt, Artificial Sequence; identical to SEQ ID NO: 193064
  derived and/or modified sequence opt5 from hemagglutinin__InfluenzaA__AHV83776

SEQ ID NO: 194928 - RNA, 1701 nt, Artificial Sequence
  derived and/or modified sequence opt5 from hemagglutinin__InfluenzaA__AHV83777
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauauguuaagagcaccaagcugagacuugccacagggcugcggaauauccccucuauucagagccgcggacucuuuggcgcuaucgccggguucaucgaaggaggcuggaccgggaugguggacggaugguacggcuaucaucaccaaaacgagcagggcuccggguacgccgcugaccugaaaucuacgcagaaugcgauugauaagaucacaaacaaagugaauagcgucauugagaagaugaacacccaguuuaccgccgugggaaaagaguucaaucaccuugagaagagaaucgaaaaccugaauaagaaaguugacgauggcuuccucgacauuuggacauacaacgcugagcugcuggugcuccuggaaaaugagcggacccuugauuaucaugacuccaacgucaagaaccuguacgagaaagugcgcaaucaacucaagaacaaugccaaagaaaucgggaacggauguuuugaguucuaucacaagugcgauaauacauguauggaaagcgucaagaacggcacguacgacuauccuaaauacucugaggaagccaagcugaauagagagaaaaucgauggggugaaacuugaguccacccggauuuaucagauccuggcuauuuacagcacaguugccucuucccucgugcuggucgugagccugggcgcgaucugcuuuuggaugugcuccaacggaucucuccagugucgcauuugcaucuga

SEQ ID NO: 194929 - RNA, 1701 nt, Artificial Sequence
  derived and/or modified sequence opt5 from hemagglutinin__InfluenzaA__AHV83778
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauuaauuacgaagaacugcgggagcagcuuuccagcgucucuuccuucgaacgcuuugagaucuuccccaagacaagcucuuggccuaaccacgacuccaauaagggagugaccgcugccuguccccaugcuggcgccaagagcuuuuauaagaaccugaucuggcucguuaaaaagggcaauucuuacccuaaacugucccaaagcuauauuaacgauaaggggaaggaagugcuuguccuguggggaauccaccaccccuccacaaccgcggaccagcagucucucuaccagaaugccgaugcuuacguguucgugggcacgagcagauauuccaaaaaguuuaaaccugagauugccauccggccgaagguccgcgaccaagaggggagaaugaacuacuauuggacacugguugaacccggagauaaaauuaccuucgaggcuacaggcaaccugguggugccucgguacgccuuuaccauggaacgcaaugcggggagcggaaucauuaucucugacacccccgucuaugauugcaacacaacgugucagaccccugagggcgccaucaauacaucccuccccuuccagaacauucauccgaucaccauuggcaagugcccuaaauacguuaagagcacaaagcugagacuugcuaccgggcugcggaaugugcccucuauccagagccgcggacucuuuggcgccauugcuggguucaucgaaggaggcuggacggggaugguggacggaugguauggcuaccaccaucaaaacgagcagggcuccggguacgccgccgaccugaaaucuacacagaaugcuaucgauaagauuaccaacaaagucaauagcgugaucgagaagaugaacacccaguuuacagcgguuggaaaagaguucaaucaccuugagaagagaauugaaaaccugaauaagaaaguggacgauggcuuccucgacaucuggaccuauaacgccgagcugcugguccuccuggaaaaugagcggacacuugauuaccacgacuccaacgugaagaaccuguaugagaaaguccgcaaucaacucaagaacaaugcuaaagaaauugggaacggauguuuugaguucuaccauaagugcgauaauacguguauggaaagcgugaagaacggcaccuaugacuacccuaaauauucugaggaagccaagcugaauagagagaaaaucgaugggguuaaacuugaguccacacggaucuaccagauucuggccaucuacagcaccguggcuucuucccucguccuggugguuagccugggcgccauuuccuuuuggaugugcucuaacggaagccuccagugccgcaucuguauuuga

SEQ ID NO: 194930 - RNA, 1701 nt, Artificial Sequence
  derived and/or modified sequence opt5 from hemagglutinin__InfluenzaA__AHV83779
augaaggccauccuggugguccuccuguacaccuucgcuacaacgaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauuaauuacgaagaacugcgggagcagcuuuccagcgucucuuccuucgaacgcuuugagaucuuccccaagacaagcucuuggccuaaccacgacuccaauaagggagugaccgcugccuguccccaugcuggcgccaagagcuuuuauaagaaccugaucuggcucguuaaaaagggcaauucuuacccuaaacugucccaaagcuauauuaacgauaaggggaaggaagugcuuguccuguggggaauccaccaccccuccacaaccgcggaccagcagucucucuaccagaaugccgaugcuuacguguucgugggcacgagcagauauuccaaaaaguuuaaaccugagauugccauccggccgaagguccgcgaccaagaggggagaaugaacuacuauuggacacugguugaacccggagauaaaauuaccuucgaggcuacaggcaaccugguggugccucgguacgccuuuaccauggaacgcaaugcggggagcggaaucauuaucucugacacccccguccaugauugcaacacaacgugucagaccccugagggcgccaucaauacaucccuccccuuccagaacauucacccgaucaccauuggcaagugcccuaaauauguuaagagcacaaagcugagacuugcuaccgggcugcggaaugugcccucuauccagagccgcggacucuuuggcgccauugcuggguucaucgaaggaggcuggacggggaugguggacggaugguacggcuaucaucaccaaaacgagcagggcuccggguacgccgccgaccugaaaucuacacagaaugcuaucgauaagauuaccaacaaagucaauagcgugaucgagaagaugaacacccaguuuacagcgguuggaaaagaguucaaucaccuugagaagagaauugaaaaccugaauaagaaaguggacgauggcuuccucgacaucuggaccuacaacgccgagcugcugguccuccuggaaaaugagcggacacuugauuaucaugacuccaacgugaagaaccuguacgagaaaguccgcaaucaacucaagaacaaugcuaaagaaacggggaacggauguuuugaguucuaucacaagugcgauaauaccuguauggaaagcgugaagaacggcacauacgacuauccuaaauacucugaggaagccaagcugaauagagagaaaauugaugggguuaaacuugaguccacccggaucuaucagauccuggccauuuacagcacaguggcuucuucccucguccuggugguuagccugggcgccaucuccuuuuggaugugcucuaacggaagccuccagugccgcauuuguaucuga

SEQ ID NO: 194931 - RNA, 1701 nt, Artificial Sequence
  derived and/or modified sequence opt5 from hemagglutinin__InfluenzaA__AHV83780
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugagacaauccuauauuaacgauaaggggaaggaagugcuuguccuguggggaauccaccaccccagcaccacaaccgaccagcagucccucuaccagaaugccgaugcuuacguguucgugggcacgucucgguauagcaaaaaguuuaaaccugagauugccauccgcccgaaggucagagaccaagaggggcggaugaacuacuauuggacacugguugaacccggagauaaaauuaccuucgaggcuacaggcaaccugguggugccucgcuacgccuuuaccauggaaagaaaugcgggguccggaaucauuaucagcgacacccccguccaugauugcaacacaacgugucagaccccugagggcgccaucaauacaucucuccccuuccagaacauucacccgaucaccauuggcaagugcccuaaauaugugaaguccacaaagcugcggcuugcuaccgggcugcgcaauguucccagcauccagucuagaggacucuuuggcgccauugcuggguucaucgaaggaggcuggacggggaugguggacggaugguacggcuaucaucaccaaaacgagcagggcagcggguacgccgccgaccugaaauccacacagaaugcuaucgauaagauuaccaacaaagucaauucugugaucgagaagaugaacacccaguuuacagcgguuggaaaagaguucaaucaccuugagaagcggauugaaaaccugaauaagaaaguggacgauggcuuccucgacaucuggaccuacaacgccgagcugcugguccuccuggaaaaugagcgcacacuugauuaucaugacagcaacgugaagaaccuguacgagaaagucagaaaucaacucaagaacaaugcuaaagaaauugggaacggauguuuugaguucuaucacaagugcgauaauacguguauggaauccgugaagaacggcaccuacgacuauccuaaauacagcgaggaagccaagcugaaucgggagaaaaucgaugggguuaaacuugagucuacacgcaucuaucagauucuggccaucuacuccaccguggcuagcucucucguccuggugguuucccugggcgccauuagcuuuuggaugugcuccaacggaucucuccagugcagaaucuguauuuga

SEQ ID NO: 194932 - RNA, 1701 nt, Artificial Sequence; identical to SEQ ID NO: 193064
  derived and/or modified sequence opt5 from hemagglutinin__InfluenzaA__AHV83781

SEQ ID NO: 194933 - RNA, 1701 nt, Artificial Sequence
  derived and/or modified sequence opt5 from hemagglutinin__InfluenzaA__AHV83782
augaaggccauccuggugguccuccuguacacccuugcuacagccaacgcggacacgcugugcauuggcuaucacgcuaauaacagcaccgauacaguugacaccgugcucgagaaaaaugugacagucacccauuccgugaaccugcuugaagauaagcacaaugggaaacuguguaagcucagaggaguugcuccccugcaucugggcaaaugcaacaucgccggguggauucucggaaauccugagugugaaucucugagcacagccuccucuuggagcuacaucguggagaccuccucuagcgacaacggcacgugcuauccgggggauuucauuaauuacgaggaacuucgggagcagcuguccagcgucucuuccuuugaacgcuucgagaucuuucccaagaccagcucuuggccuaaccacgacuccaauaagggagugacagccgcuuguccccaugccggcgcgaaaucuuucuauaagaaccucaucuggcugguuaaaaagggcaauagcuacccuaaacuuucccaaagcuauauuaacgauaaggggaaggaagugcugguccucuggggaauccaccaccccuccaccacagccgaccagcagucucuguaccagaaugcugaugccuacguguuugugggcaccagcagauauuccaaaaaguucaaaccugagauugcuauccggccgaagguccgcgaccaagaggggagaaugaacuacuauuggacgcugguugaacccggagauaaaauuacauuugaggccaccggcaaccucguggcgccucgguacgccuucacaauggaacgcaaugcugggagcggaaucauuaucucugacacccccgugcaugauugcaacaccacaugucagacgccugagggcgccaucaauaccucccugcccuuucagaacauucacccgaucacaauuggcaagugcccuaaauaugucaagagcaccaaacuuagacuggcuacagggcuccggaaugugcccucuauccagagccgcggacuguucggcgccauugccggguuuaucgaaggaggcuggaccgggaugguugacggaugguacggcuaucaucaccaaaacgagcagggcuccggguacgcugcggaccuuaagucuacgcagaaugccaucgauaagauuacaaacaaagugaauagcgucaucgagaagaugaacacccaguucaccgcugugggaaaagaauuuaaucaccuggagaagagaauugaaaaccucaauaagaaaguugacgauggcuuccuggacaucuggacauacaacgccgagcugcucgugcugcuugaaaaugagcggacccuggauuaucaugacuccaacgucaagaaccucuacgagaaagugcgcaaucaacugaagaacaaugccaaagaaauugggaacggauguuucgaguuuuaucacaagugcgauaauacauguauggaaagcgucaagaacggcacguacgacuauccuaaauacucugaggaagcuaaacuuaauagagagaagaucgauggggugaagcuggaguccacccggaucuaucagauucucgccaucuacagcacaguugcgucuucccuggugcuggucgugagccucggcgcuauuuccuucuggaugugcucuaacggaagccugcagugccgcaucuguauuuga

SEQ ID NO: 194934 - RNA, 1701 nt, Artificial Sequence
  derived and/or modified sequence opt5 from hemagglutinin__InfluenzaA__AHV83783
augaaggccauccuggugguccuccuguacaccuucgcuacagccaacgcggacacgcuuugcauuggcuaucacgcuaauaacagcaccgauacaguugacaccgugcuggagaagaauaucacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucaauuacgaagaacugcgggagcagcuuuccagcgugucuuccuucgaacgcuuugagaucuuccccaagaccagcucuuggccuaaccacgacuccaauaagggagucacagccgcuuguccccaugccggcgcgaaaggcuuuuauaagaaccugauuuggcucgugaaaaaggggaauagcuacccuaaacugagacaaucuuauaucaacgauaagggaaaggaaguucuugugcuguggggcauucaccaccccuccaccacaaccgaccagcagagccucuaccagaaugccgaugcuuacgucuucguggggacgucccgguauucuaaaaaguuuaaaccugagaucgccauucgcccgaaggugagagaccaagagggacggaugaacuacuauuggacacuggucgaacccggcgauaaaaucaccuucgaggcuacagggaaccugguugugccucgcuacgccuuuaccauggaaagaaaugcgggaagcggcauuaucaucuccgacacccccgugcaugauugcaacacaacgugucagaccccugagggcgccauuaauacaagccuccccuuccagaacauccacccgauuaccaucgggaagugcccuaaauaugucaagucuacaaagcugcggcuugcuaccggacugcgcaaugugcccuccauucagagcagaggccucuuuggggccaucgcuggauucaucgaaggcggguggacgggaaugguugacggcugguacggcuaucaucaccaaaacgagcaggggucuggauacgccgccgaccugaaaagcacacagaaugcuauugauaagaucaccaacaaagucaauuccgugauugagaagaugaacacccaguuuacagcggugggcaaagaguucaaucaccuugagaagcggaucgaaaaccugaauaagaaaguugacgauggguuccucgacauuuggaccuacaacgccgagcugcuggugcuccuggaaaaugagcgcacacuugauuaucaugacucuaacgucaagaaccuguacgagaaagugagaaaucaacucaagaacaaugcuaaagaaaucggaaacggcuguuuugaguucuaucacaagugcgauaauacguguauggaaagcgucaagaacgggaccuacgacuauccuaaauacuccgaggaagccaagcugaaucgggagaaaaucgauggcgugaaacuugagagcacacgcauuuaucagauccuggccauuuacucuaccguugcuuccagccucgugcuggucgugucucugggagccaucuccuuuuggaugugcagcaacggcucccuccagugcagaauuuguaucuga

SEQ ID NO: 194935 - RNA, 1701 nt, Artificial Sequence; identical to SEQ ID NO: 193064
  derived and/or modified sequence opt5 from hemagglutinin__InfluenzaA__AHV83784

SEQ ID NO: 194936 - RNA, 1701 nt, Artificial Sequence; identical to SEQ ID NO: 193064
  derived and/or modified sequence opt5 from hemagglutinin__InfluenzaA__AHV83785

SEQ ID NO: 194937 - RNA, 1701 nt, Artificial Sequence; identical to SEQ ID NO: 193064
  derived and/or modified sequence opt5 from hemagglutinin__InfluenzaA__AHV83787

SEQ ID NO: 194938 - RNA, 1701 nt, Artificial Sequence
  derived and/or modified sequence opt5 from hemagglutinin__InfluenzaA__AHV83788
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguuucuccccuccaucugggcaaaugcaacaucgccggguggauucugggaaauccugagugugaaagccucuccacagccucuagcugguccuacaucguggagaccucuagcuccgacaacggcacgugcuauccgggggauuuugucaauuacgaagaacugcgggagcagcuuagcucuguguccagcuucgaacgcuuugagauuuuccccaagaccucuuccuggccuaaccacgacagcaauaagggaguuacagcugccuguccccaugcuggcgccaaaucuuuuuauaagaaccugaucuggcucgugaaaaagggcaauuccuacccuaaacugagccaauccuauaucaacgauaaggggaaggaaguccuugugcuguggggcauucaccaccccucuaccacagcggaccagcagagccucuaccagaaugccgaugcuuacguguucgucggaaccuccagauauagcaaaaaguuuaaaccugagaucgccauucggccgaagguucgcgaccaagaggggagaaugaacuacuauuggacgcugguggaacccggagauaaaaucacauucgaggcuaccggcaaccugguggucccucgguacgccuuuacaauggaacgcaaugcggggucuggaauuaucauuuccgacacccccgugcaugauugcaacaccacaugucagacgccugagggcgccaucaauaccagccuccccuuccagaacauccacccgauuacaaucggcaagugcccuaaauauguuaagucuaccaagcugagacuugcuacagggcugcggaaugugcccagcauucagucccgcggacucuuuggcgccaucgcuggguucauugaaggaggcuggaccgggauggucgacggaugguacggcuaucaucaccaaaacgagcagggcucuggguacgccgccgaccugaaaagcacgcagaaugcuaucgauaagaucacaaacaaaguuaauuccgugauugagaagaugaacacccaguuuaccgcggugggaaaagaguucaaucaccuugagaagagaaucgaaaaccugaauaagaaagucgacgauggcuuccucgacauuuggacauacaacgccgagcugcuggugcuccuggaaaaugagcggacccuugauuaucaugacagcaacgucaagaaccuguacgagaaagugcgcaaucaacucaagaacaaugcuaaagaaaucgggaacggauguuuugaguucuaucacaagugcgauaauacauguauggaaucuguuaagaacggcacguacgacuauccuaaauacuccgaggaagccaagcugaauagagagaaaauugauggggugaaacuugagagcacccggaucuaucagauccuggccauuuacucuacagucgcuuccagccucgugcugguugugucccugggcgccaucucuuuuuggaugugcagcaacggaucccuccagugccgcauuuguaucuga

SEQ ID NO: 194939 - RNA, 1701 nt, Artificial Sequence; identical to SEQ ID NO: 194926
  derived and/or modified sequence opt5 from hemagglutinin__InfluenzaA__AHV83789

SEQ ID NO: 194940 - RNA, 1701 nt, Artificial Sequence; identical to SEQ ID NO: 193064
  derived and/or modified sequence opt5 from hemagglutinin__InfluenzaA__AHV83790

SEQ ID NO: 194941 - RNA, 1701 nt, Artificial Sequence; identical to SEQ ID NO: 193064
  derived and/or modified sequence opt5 from hemagglutinin__InfluenzaA__AHV83791

SEQ ID NO: 194942 - RNA, 1701 nt, Artificial Sequence; identical to SEQ ID NO: 193064
  derived and/or modified sequence opt5 from hemagglutinin__InfluenzaA__AHV83792

SEQ ID NO: 194943 - RNA, 1701 nt, Artificial Sequence
  derived and/or modified sequence opt5 from hemagglutinin__InfluenzaA__AHV83793
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauuaauuacgaagaacugcgggagcagcuuuccagcgucucuuccuucgaaaaguuugagaucuuccccaagaccagcucuuggccuaaccacgacuccaauaaaggagugacagccgcuuguccccaugccggcgccaagagcuuuuauaaaaaccugaucuggcucguuaagaaaggcaauucuuacccuaagcugucccaaagcuauauuaacgauaaggggaaagaaauccuugugcuguggggcauucaccaccccuccaccacagccgaccagcagucucucuaccagaaugcugaugccuacgucuucgugggaaccagccgcuauuccaagaaauuuaagccugagaucgcuauuagaccgaaagugcgggaccaagaggggcgcaugaacuacuauuggacgcuggucgaacccggagauaagaucacauucgaggccaccggcaaccugguugugccuagauacgcguuuacaauggaacggaaugccgggagcggaauuaucaucucugacacccccgugcaugauugcaacaccacaugucagacgccugagggcgcuauuaauaccucccuccccuuccagaacauccacccgauuacaaucggcaaaugcccuaaguaugucaagagcaccaaacugcgccuugccacagggcugagaaaugugcccucuauucagagccggggacucuuuggcgcuaucgccggguucaucgaaggaggcuggaccgggaugguugacggaugguacggcuaucaucaccaaaacgagcagggcuccggguacgccgcugaccagaagucuacgcagaaugcgauugauaaaaucacaaacaaggugaauagcgucauugagaaaaugaacacccaauuuaccgccgugggaaaggaguucaaucaccuggagaagcgcaucgaaaaccuuaauaaaaagguugacgauggcuuccuggacauuuggacauacaacgcugagcuccuggugcugcucgaaaaugagagaacccuggauuaucaugacuccaacgucaaaaaccuuuacgagaaggugcggaaucagcugaaaaacaaugccaaggaaaucgggaacggauguuuugaguucuaucacaagugcgauaauacauguauggaaagcgucaaaaacggcacguacgacuauccuaaguacucugaggaagccaaacucaaucgcgagaagaucgauggggugaaacuggaguccaccagaauuuaucagauccuugcuauuuacagcacaguugccucuucccuggugcucgucgugagccugggcgcgaucuccuuuuggaugugcucuaacggaagccugcaaugccggauuuguaucuga

SEQ ID NO: 194944 - RNA, 1701 nt, Artificial Sequence
  derived and/or modified sequence opt5 from hemagglutinin__InfluenzaA__AHV83794
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauauguuaagagcaccaagcugagacuugccacagggcugcggaaugugcccucuauccagagccgcggacucuuuggcgcuauugccggguucaucgaaggaggcuggaccgggaugguggacggaugguacggcuaucaucaccaaaacgagcagggcuccggguacgccgcugaccagaaaucuacgcagaaugcgaucgauaagauuacaaacaaagucaauagcgugaucgagaagaugaacacccaauuuaccgccguuggaaaagaguucaaucaccuggagaagagaauugaaaaccuuaauaagaaaguggacgauggcuuccuggacaucuggacauacaacgcugagcuccugguccugcucgaaaaugagcggacccuggauuaucaugacuccaacgugaagaaccuuuacgagaaaguccgcaaucagcugaagaacaaugccaaagaaauugggaacggauguuuugaguucuaucacaagugcgauaauacauguauggaaagcgugaagaacggcacguacgacuauccuaaauacucugaggaagccaagcucaauagagagaaaaucgaugggguuaagcuggaguccacccggaucuaucagauucuugcuaucuacagcacaguggccucuucccugguccucgugguuagccugggcgcgauuuccuuuuggaugugcucuaacggaagccugcaaugccgcaucuguauuuga

SEQ ID NO: 194945 - RNA, 1701 nt, Artificial Sequence
  derived and/or modified sequence opt5 from hemagglutinin__InfluenzaA__AHV83795
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcgccgccuccucuuggagcuacaucguggagacauccucuagcgacaacgggaccugcuauccgggcgauuuuauuaauuacgaagaacugcgggagcagcuuuccagcgucucuuccuucgaacgcuuugagaucuuccccaagacgagcucuuggccuaaccacgacuccaauaagggagugaccgcugccuguccccaugcgggcgccaagagcuuuuauaagaaccugaucuggcucguuaaaaagggcaauucuuacccuaaacugucccaaagcuauauuaacgauaaggggaaggaagugcuuguccuguggggaauccaccaccccuccacaaccgcugaccagcagucucucuaccagaaugccgauacauacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauaugugaaaagcaccaagcugagacuugccacagggcugcggaauguucccucuauccagagccgcggacucuuuggcgcuauugccggguucaucgaaggaggcuggaccgggaugguggacggaugguacggcuaucaucaccaaaacgagcagggcuccggguacgccgcugaccagaaaucuacgcagaaugcgaucgauaagauuacaaacaaagucaauagcgugaucgagaagaugaacacccaauuuaccgccguuggaaaagaguucaaucaccuggagaagagaauugaaaaccuuaauaagaaaguggacgauggcuuccuggacaucuggacauacaacgcugagcuccugguccugcucgaaaaugagcggacccuggauuaucaugacuccaacgugaagaaccuuuacgagaaaguccgcaaucagcugaagaacaaugccaaagaaauugggaacggauguuuugaguucuaucacaagugcgauaauacauguauggaaagcgugaagaacggcacguacgacuauccuaaauacucugaggaagccaagcucaauagagagaaaaucgaugggguuaagcuggaguccaccaaaaucuaucagauucuugcuaucuacagcacaguggccucuucccugguccucgugguuagccugggcgcgauuuccuuuuggaugugcucuaacggaagccugcaaugccggaucuguauuuga

SEQ ID NO: 194946 - RNA, 1701 nt, Artificial Sequence; identical to SEQ ID NO: 194944
  derived and/or modified sequence opt5 from hemagglutinin__InfluenzaA__AHV83796

SEQ ID NO: 194947 - RNA, 1701 nt, Artificial Sequence; identical to SEQ ID NO: 193064
  derived and/or modified sequence opt5 from hemagglutinin__InfluenzaA__AHV83798

SEQ ID NO: 194948 - RNA, 1701 nt, Artificial Sequence; identical to SEQ ID NO: 193064
  derived and/or modified sequence opt5 from hemagglutinin__InfluenzaA__AHV83799

SEQ ID NO: 194949 - RNA, 1701 nt, Artificial Sequence
  derived and/or modified sequence opt5 from hemagglutinin__InfluenzaA__AHV83800
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauauguuaagagcaccaagcugagacuugccacagggcugcggaaugugcccucuauccagagccgcggacucuuuggcgcuauugccggguucaucgaaggaggcuggaccgggaugguggacggaugguacggcuaucaucaccaaaacgagcagggcuccggguacgccgcugaccugaaaucuacgcagaaugcgaucgauaagauuacaaacaaagucaauagcgugaucgagaagaugaacacccaguuuaccgccguuggaaaagaguucaaucaccuugagaagagaauugaaaaccugaauaagaaaguggacgauggcuuccucgacaucuggacauacaacgcugagcugcugguccuccuggaaaaugagaagacccuugauuaucaugacuccaacgugaaaaaccuguacgagaagguccggaaucaacucaaaaacaaugccaaggaaauugggaacggauguuuugaguucuaucacaagugcgauaauacauguauggaaagcgugaaaaacggcacguacgacuauccuaaguacucugaggaagccaaacugaaucgcgagaagaucgaugggguuaaacuugaguccaccagaaucuaucagauucuggcuaucuacagcacaguggccucuucccucguccuggugguuagccugggcgcgauuuccuuuuggaugugcucuaacggaagccuccagugccggaucuguauuuga

SEQ ID NO: 194950 - RNA, 1701 nt, Artificial Sequence
  derived and/or modified sequence opt5 from hemagglutinin__InfluenzaA__AHV83801
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauauguuaagagcaccaagcugagacuugccacagggcugcggaaugugcccucuauccagagccgcggacucuuuggcgcuauugccggguucaucgaaggaggcuggaccgggaugguggacggaugguacggcuaucaucaccaaaacgagcagggcuccggguacgccgcugaccagaaaucuacgcagaaugcgaucgauaagauuacaaacaaagucaauagcgugaucgagaagaugaacacccaauuuaccgccguuggaaaagaguucaaucaccuggagaagagaauugaaaaccuuaauaagaaaguggacgauggcuuccuggacaucuggacauacaacgcugagcuccugguccugcucgaaaaugagcggacccuggauuaucaugacuccaacgugaagaaccuuuacgagaaaguccgcaaucagcugaagaacaaugccaaagaaauugggaacggauguuuugaguucuaucacaagugcgauaauacauguauggaaagcgugaagaacggcacguacgacuauccuaaauacucugaggaagccaagcucaauagagagaaaaucgaugggguuaagcuggaguccaccaaaaucuaucagauucuugcuaucuacagcacaguggccucuucccugguccucgugguuagccugggcgcgauuuccuuuuggaugugcucuaacggaagccugcaaugccggaucuguauuuga

SEQ ID NO: 194951 - RNA, 1701 nt, Artificial Sequence
  derived and/or modified sequence opt5 from hemagglutinin__InfluenzaA__AHV83802
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauucuuacccuaaacugucccaaagcuauauuaacgauaaggggaaggaagugcuuguccuguggggaauccaccaccccuccaccacagccgaccagcagggccucuaccagaauguggaugcuuacguguucgucgggaccucuagauauagcaaaaaguuuaaaccugagauugccauccggccgaagguucgcgaccaagagggaagaaugaacuacuauuggacgcugguggaacccggcgauaaaauuacauucgaggcuaccgggaaccugguggucccucgguacgccuuuacaauggaacgcaaugcgggauccggcaucauuaucagcgacacccccgugcaugauugcaacaccacaugucagacgccugagggcgccaucaauaccucucuccccuuccagaacauucacccgaucacaauugggaagugcccuaaauauguuaaguccaccaagcugagacuugcuacaggacugcggaaugugcccagcauccagucucgcggccucuuuggggccauugcuggauucaucgaaggcggguggaccggaauggucgacggcugguacggcuaucaucaccaaaacgagcaggggagcggauacgccgccgaccugaaauccacgcagaaugcuaucgauaagauuacaaacaaagugaauagcguuaucgagaagaugaacacccaguuuaccgcggugggcaaagaguucaaucaccuugagaagagaauugaaaaccugaauaagaaagucgacgauggguuccucgacaucuggacauacaacgccgagcugcuggugcuccuggaaaaugagcggacccuugauuaucaugacagcaacgucaagaaccuguacgagaaagugcgcaaucaacucaagaacaaugcuaaagaaauuggaaacggcuguuuugaguucuaucacaagugcgauaauacauguauggaauccguuaagaacgggacguacgacuauccuaaauacagcgaggaagccaagcugaauagagagaaaaucgauggcgugaaacuugagucuacccggaucuaucagauucuggccaucuacuccacagucgcuagcucucucgugcugguugugucccugggagccauuagcuuuuggaugugcuccaacggcucucuccagugccgcaucuguauuuga

SEQ ID NO: 194952 - RNA, 1701 nt, Artificial Sequence; identical to SEQ ID NO: 193064
  derived and/or modified sequence opt5 from hemagglutinin__InfluenzaA__AHV83803

SEQ ID NO: 194953 - RNA, 1701 nt, Artificial Sequence; identical to SEQ ID NO: 193064
  derived and/or modified sequence opt5 from hemagglutinin__InfluenzaA__AHV83804

SEQ ID NO: 194954 - RNA, 1701 nt, Artificial Sequence; identical to SEQ ID NO: 193064
  derived and/or modified sequence opt5 from hemagglutinin__InfluenzaA__AHV83805

SEQ ID NO: 194955 - RNA, 1701 nt, Artificial Sequence; identical to SEQ ID NO: 194944
  derived and/or modified sequence opt5 from hemagglutinin__InfluenzaA__AHV83806

SEQ ID NO: 194956 - RNA, 1701 nt, Artificial Sequence
  derived and/or modified sequence opt5 from hemagglutinin__InfluenzaA__AHV83807
augaaggccauccuggugguccuccuguacaccuucgcuacagccaacgcggacacgcuuugcauuggcuaucacgcuaauaacagcaccgauacaguugacaccgugcuggagaaggaugugacagucacccauuccgugaaucuccuggaagacaagcacaacgggaaacuuuguaagcugagaggaguugcuccccuccaucugggcaaaugcaauaucgccggguggauucugggaaacccugagugugaaucucucagcacagccuccucuuggagcuacaucguggagaccuccucuagcgauaauggcacgugcuauccgggggacuuuauuaacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacugucccaaagcuauauuaaugacaaggggaaggaagugcuuguccuguggggaauccaccaccccuccaccacagccgaucagcagucucucuaccagaacgcugacgccuacguguucgugggcaccagcagauauuccaaaaaguuuaaaccugagauugcuauccggccgaagguccgcgaucaagaggggagaaugaauuacuauuggacgcugguugaacccggagacaaaauuacauucgaggccaccggcaaccugguggugccucgguacgcguuuacaauggaacgcaacgccgggagcggaaucauuaucucugauacccccguccaugacugcaauaccacaugucagacgccugagggcgcuaucaacaccucccuccccuuccagaauauucacccgaucacaauuggcaagugcccuaaauauguuaagagcaccaagcugagacuugccacagggcugcggaacgugcccucuauccagagccgcggacucuuuggcgcuauugccggguucaucgaaggaggcuggaccgggaugguggacggaugguacggcuaucaucaccaaaaugagcagggcuccggguacgccgcugaucugaaaucuacgcagaacgcgaucgacaagauuacaaauaaagucaacagcgugaucgagaagaugaauacccaguuuaccgccguuggaaaagaguucaaccaccuugagaagagaauugaaaaucugaacaagaaaguggaugacggcuuccucgauaucuggacauacaaugcugagcugcugguccuccuggaaaacgagcggacccuugacuaucaugauuccaaugugaagaaccuguacgagaaaguccgcaaccaacucaagaauaacgccaaagaaauugggaauggauguuuugaguucuaucacaagugcgacaacacauguauggaaagcgugaagaauggcacguacgauuauccuaaauacucugaggaagccaagcugaacagagagaaaaucgacgggguuaaacuugaguccacccggaucuaucagauucuggcuaucuacagcacaguggccucuucccucguccuggugguuagccugggcgcgauuuccuuuuggaugugcucuaauggaagccuccagugccgcaucuguauuuga

SEQ ID NO: 194957 - RNA, 1701 nt, Artificial Sequence
  derived and/or modified sequence opt5 from hemagglutinin__InfluenzaA__AHV83808
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaggccuacguguucgugggcaccagcagauauuccaaaaaguuuaaaccugagauugcuauccggccgaagguccgcgaucaagaagggagaaugaacuacuauuggacgcugguugagcccggagacaaaauuacauucgaagccaccggcaaccugguggugccucgguacgcguuuacaauggagcgcaaugccgggagcggaaucauuaucucugauacccccguccaugacugcaacaccacaugucagacgccugaaggcgcuaucaauaccucccuccccuuccagaacauucacccgaucacaauuggcaagugcccuaaauauguuaagagcaccaagcugagacuugccacagggcugcggaaugugcccucuauccagagccgcggacucuuuggcgcuauugccggguucaucgagggaggcuggaccgggaugguggauggaugguacggcuaucaucaccaaaacgagcagggcuccggguacgccgcugaccugaaaucuacgcagaaugcgaucgacaagauuacaaacaaagucaauagcgugaucgaaaagaugaacacccaguuuaccgccguuggaaaagaguucaaucaccuugaaaagagaauugagaaccugaauaagaaaguggaugacggcuuccucgauaucuggacauacaacgcugaacugcugguccuccuggagaaugagcggacccuugacuaucaugauuccaacgugaagaaccuguacgaaaaaguccgcaaucaacucaagaacaaugccaaagagauugggaacggauguuuugaguucuaucacaagugcgacaauauguguauggagagcgugaagaacggcacauacgauuauccuaaauacucugaagaggccaagcugaauagagagaaaaucgacgggguuaaacuugaauccacgcggaucuaucagauucuggcuaucuacagcaccguggccucuucccucguccuggugguuagccugggcgcgauuuccuuuuggaugugcucuaacggaagccuccagugccgcaucuguauuuga

SEQ ID NO: 194958 - RNA, 1701 nt, Artificial Sequence; identical to SEQ ID NO: 193064
  derived and/or modified sequence opt5 from hemagglutinin__InfluenzaA__AHV83809

SEQ ID NO: 194959 - RNA, 1701 nt, Artificial Sequence; identical to SEQ ID NO: 194045
  derived and/or modified sequence opt5 from hemagglutinin__InfluenzaA__AHV83810

SEQ ID NO: 194960 - RNA, 1701 nt, Artificial Sequence
  derived and/or modified sequence opt5 from hemagglutinin__InfluenzaA__AHV83812
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauuaauuacgaagaacugcgggagcagcuuuccagcgucucuuccuucgaacgcuuugagaucuuccccaagacaagcucuuggccuaaccacgacuccaauaagggagugaccgcugccuguccccaugcuggcgccaagagcuuuuauaagaaccugaucuggcucguuaaaaagggcaauucuuacccuaaacugucccaaagcuauauuaacgauaaggggaaggaagugcuuguccuguggggaauccaccaccccuccacaaccgcggaccagcagucucucuaccagaaugccgaugcuuacguguucgugggcacgagcagauauuccaaaaaguuuaaaccugagauugccauccggccgaagguccgcgaccaagaggggagaaugaacuacuauuggacacugguugaacccggagauaaaauuaccuucgaggcuacaggcaaccugguggugccucgguacgccuuuaccauggaacgcaaugcggggagcggaaucauuaucucugacacccccguccaugauugcaacacaacgugucagaccccugagggcgccaucaauacaucccuccccuuccagaacauucacccgaucaccauuggcaagugcccuaaauauguuaagagcacaaagcugagacuugcuaccgggcugcggaaugugcccucuauccagagccgcggacucuuuggcgccauugcuggguucaucgaaggaggcuggacggggaugguggacggaugguacggcuaucaucaccaaaacgagcagggcuccggguacgccgccgaccugaaaucuacacagaaugcuaucgauaagauuaccaacaaagucaauagcgugaucgagaagaugaacacccaguuuacagcgguuggaaaagaguucaaucaccuugagaagagaauugaaaaccugaauaagaaaguggacgauggcuuccucgacaucuggaccuacaacgccgagcugcugguccuccuggaaaaugagcggacacuugauuaucaugacuccaacgugaagaaccuguacgagaaaguccgcaaucaacucaagaacaaugcuaaagaaauugggaacggauguuuugaguucuaucacaagugcgauaauacguguauggaaagcgugaagaacggcaccuacgaguauccuaaauacucugaagaggccaagcugaauagagagaaaaucgacgggguuaaacuugaauccacaaaaaucuaucagauucuggccaucuacagcaccguggcuucuucccucguccuggugguuagccugggcgccauuuccuuuuggaugugcucuaacggaagccuccagugccggaucuguauuuga

SEQ ID NO: 194961 - RNA, 1701 nt, Artificial Sequence; identical to SEQ ID NO: 193064
  derived and/or modified sequence opt5 from hemagglutinin__InfluenzaA__AHV83813

SEQ ID NO: 194962 - RNA, 1701 nt, Artificial Sequence
  derived and/or modified sequence opt5 from hemagglutinin__InfluenzaA__AHV83814
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauauguuaagagcaccaagcugagacuugccacagggcugcggaaugugcccucuauccagagccgcggacucuuuggcgcuauugccggguucaucgaaggaggcuggaccgggaugguggacggaugguacggcuaucaucaccaaaacgagcagggcuccggguacgccgcugaccugaaaucuacgcagaaugcgaucgauaagauuacaaacaaagucaauagcgugaucgagaagaugaacacccaguuuaccgccguuggaaaagaguucaaucaccuugagaagagaauugaaaaccugaauaagaaaguggacgauggcuuccucgacaucuggacauacaacgcugagcugcugguccuccuggaaaaugagcggaaccuugauuaucaugacuccaacgugaagaaucuguacgagaaaguccgcaaccaacucaagaccaaugccaaagaaauugggaacggauguuuugaguucuaucacaagugcgauaauacauguauggaaagcgugaagaacggcacguacgacuauccuaaauacucugaggaagccaagcugaauagagagaaaaucgaugggguuaaacuugaguccacccggaucuaucagauucuggcuaucuacagcacaguggccucuucccucguccuggugguuagccugggcgcgauuuccuuuuggaugugcucuaacggaagccuccagugccgcaucuguauuuga

SEQ ID NO: 194963 - RNA, 1701 nt, Artificial Sequence; identical to SEQ ID NO: 194045
  derived and/or modified sequence opt5 from hemagglutinin__InfluenzaA__AHV83815

SEQ ID NO: 194964 - RNA, 1701 nt, Artificial Sequence; identical to SEQ ID NO: 193064
  derived and/or modified sequence opt5 from hemagglutinin__InfluenzaA__AHV83816

SEQ ID NO: 194965 - RNA, 1701 nt, Artificial Sequence
  derived and/or modified sequence opt5 from hemagglutinin__InfluenzaA__AHV83817
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugguuuggcucgugaaaaagggcaauagcuacccuaaacugucccaaagcuauaucaacgauaaggggaaggaaguccuugugcuguggggcauucaccaccccuccaccacagccgaccagcagucucucuaccagaaugcugaugccuacguguucgucggaaccagcagauauuccaaaaaguuuaaaccugagaucgcuauucggccgaagguucgcgaccaagaggggagaaugaacuacuauuggacgcugguggaacccggagauaaaaucacauucgaggccaccggcaaccugguggucccucgguacgcguuuacaauggaacgcaaugccgggagcggaauuaucauuucugacacccccgugcaugauugcaacaccacaugucagacgccugagggcgcuaucaauaccucccuccccuuccagaacauccacccgauuacaaucggcaagugcccuaaauauguuaagagcaccaagcugagacuugccacagggcugcggaaugugcccucuauucagagccgcggacucuuuggcgcuaucgccggguucauugaaggaggcuggaccgggauggucgacggaugguacggcuaucaucaccaaaacgagcagggcuccggguacgccgcugaccugaaaucuacgcagaaugcgaucgauaagaucacaaacaaagugaauagcguuauugagaagaugaacacccaguuuaccgccgugggaaaagaguucaaucaccuugagaagagaaucgaaaaccugaauaagaaagucgacgauggcuuccucgacauuuggacauacaacgcugagcugcuggugcuccuggaaaaugagcggacccuugauuaucaugacuccaacgucaagaaccuguacgagaaagugcgcaaucaacucaagaacaaugccaaagaaaucgggaacggauguuuugaguucuaucacaagugcgauaauacauguauggaaagcguuaagaacggcacguacgacuauccuaaauacucugaggaagccaagcugaauagagagaaaauugauggggugaaacuugaguccacccggaucuaucagauccuggcuauuuacagcacagucgccucuucccucgugcugguugugagccugggcgcgaucuccuuuuggaugugcucuaacggaagccuccagugccgcauuuguaucuga

SEQ ID NO: 194966 - RNA, 1701 nt, Artificial Sequence; identical to SEQ ID NO: 194944
  derived and/or modified sequence opt5 from hemagglutinin__InfluenzaA__AHV83818

SEQ ID NO: 194967 - RNA, 1701 nt, Artificial Sequence; identical to SEQ ID NO: 194926
  derived and/or modified sequence opt5 from hemagglutinin__InfluenzaA__AHV83819

SEQ ID NO: 194968 - RNA, 1701 nt, Artificial Sequence
  derived and/or modified sequence opt5 from hemagglutinin__InfluenzaA__AHV83821
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguuucuccccuccaucugggcaaaugcaacaucgccggguggauucugggaaauccugagugugaaagccucuccacagccucuagcugguccuacaucguggagaccucuagcuccgacaacggcacgugcuauccgggggauuuugucaauuacgaagaacugcgggagcagcuuagcucuguguccagcuucgaacgcuuugagauuuuccccaagaccucuuccuggccuaaccacgacagcaauaagggaguuacagcugccuguccccaugcuggcgccaaaucuuuuuauaagaaccugaucuggcucgugaaaaagggcaauuccuacccuaaacugagccaauccuauaucaacgauaaggggaaggaaguccuugugcuguggggcauucaccaccccucuaccacagcggaccagcagagccucuaccagaaugccgaugcuuacguguucgucggaaccuccagauauagcaaaaaguuuaaaccugagaucgccauucggccgaagguucgcgaccaagaggggagaaugaacuacuauuggacgcugguggaacccggagauaaaaucacauucgaggcuaccggcaaccugguggucccucgguacgccuuuacaauggaacgcaaugcggggucuggaauuaucauuuccgacacccccgugcauaacugcaauaccacaugucagacgccugagggcgccaucaacaccagccuccccuuccagaauauccacccgauuacaaucggcaagugcccuaaauauguuaagucuaccaagcugagacuugcuacagggcugcggaacgugcccagcauucagucccgcggacucuuuggcgccaucgcuggguucauugaaggaggcuggaccgggauggucgauggaugguacggcuaucaucaccaaaaugagcagggcucuggguacgccgccgaccugaaaagcacgcagaacgcuaucgacaagaucacaaauaaagugaacuccguuauugagaagaugaauacccaguuuaccgcggugggaaaagaguucaaccaccuugagaagagaaucgaaaaucugaacaagaaagucgaugacggcuuccucgauauuuggacauacaaugccgagcugcuggugcuccuggaaaacgagcggacccuugacuaucaugauagcaacgucaagaaucuguacgagaaagugcgcaaccaacucaagaauaacgcuaaagaaaucgggaauggauguuuugaguucuaucacaagugcgacaacacauguauggaaucuguuaagaauggcacguacgauuauccuaaauacuccgaggaagccaagcugaacagagagaaaauugacggggugaaacuugagagcacccggaucuaucagauccuggccauuuacucuacagucgcuuccagccucgugcugguugugucccugggcgccaucucuuuuuggaugugcagcaauggaucccuccagugccgcauuuguaucuga

SEQ ID NO: 194969 - RNA, 1701 nt, Artificial Sequence
  derived and/or modified sequence opt5 from hemagglutinin__InfluenzaA__AHV83822
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguuucuccccuccaucugggcaaaugcaacaucgccggguggauucugggaaauccugagugugaaagccucuccacagccucuagcugguccuacaucguggagaccucuagcuccgacaacggcacgugcuauccgggggauuuugucaauuacgaagaacugcgggagcagcuuagcucuguguccagcuucgaacgcuuugagauuuuccccaagaccucuuccuggccuaaccacgacagcaauaagggaguuacagcugccuguccccaugcuggcgccaaaucuuuuuauaagaaccugaucuggcucgugaaaaagggcaauuccuacccuaaacugagccaauccuauaucaacgauaaggggaaggaaguccuugugcuguggggcauucaccaccccucuaccacagcggaccagcagagccucuaccagaaugccgaugcuuacguguucgucggaaccuccagauauagcaaaaaguuuaaaccugagaucgccauucggccgaagguucgcgaccaagaggggagaaugaacuacuauuggacgcugguggaacccggagauaaaaucacauucgaggcuaccggcaaccugguggucccucgguacgccuuuacaauggaacgcaaugcggggucuggaauuaucauuuccgacacccccgugcaugauugcaacaccacaugucagacgccugagggcgccaucaauaccagccuccccuuccagaacauccacccgauuacaaucggcaagugcccuaaauauguuaagucuaccaagcugagacuugcuacagggcugcggaaugugcccagcauucagucccgcggacucuuuggcgccaucgcuggguucauugaaggaggcuggaccgggauggucgacggaugguacggcuaucaucaccaaaacgagcagggcucuggguacgccgccgaccugaaaagcacgcagaaugcuaucgauaagaucacaaacaaaguuaauuccauuaucgagaagaugaacacccaguuuaccgcggugggaaaagaguucaaucaccuugagaagagaauugaaaaccugaauaagaaaguggacgauggcuuccucgacaucuggacauacaacgccgagcugcugguccuccuggaaaaugagcggacccuugauuaucaugacagcaacgugaagaaccuguacgagaaaguccgcaaucaacucaagaacaaugcuaaagaaauugggaacggauguuuugaguucuaucacaagugcgauaauacauguauggaaucugugaagaacggcacguacgacuauccuaaauacuccgaggaagccaagcugaauagagagaaaaucgaugggguuaaacuugagagcacccggaucuaucagauucuggccaucuacucuacaguggcuuccagccucguccuggugguuucccugggcgccauuucuuuuuggaugugcagcaacggaucccuccagugccgcaucuguauuuga

SEQ ID NO: 194970 - RNA, 1701 nt, Artificial Sequence
  derived and/or modified sequence opt5 from hemagglutinin__InfluenzaA__AHV83823
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaaauuucccaaagcuauaucaacgauaaggggaaggaagugcugguccuuuggggcauucaccaccccuccaccacagccgaccagcagucucuguaccagaaugcugaugccuacguguucgugggaaccagcagauauuccaaaaaguuuaaaccugagaucgcuauucggccgaagguccgcgaccaagaggggagaaugaacuacuauuggacgcucguugaacccggagauaaaaucacauucgaggccaccggcaaccugguggugccucgguacgcguuuacaauggaacgcaauaccgggagcggaauuaucaucucugacacccccguccaugauugcaacacaacgugucagaccccugagggcgccauuaauacaucccugcccuuccagaacauccacccgauuaccaucggcaagugcccuaaauauguuaagagcacaaagcucagacuggcuaccgggcuucggaaugugcccucuauucagagccgcggacuguuuggcgccaucgcuggguucaucgaaggaggcuggacggggaugguggacggaugguacggcuaucaucaccaaaacgagcagggcuccggguacgccgccgaccucaaaucuacacagaaugcuauugauaagaucaccaacaaagucaauagcgugauugagaagaugaacacccaguuuacagcgguuggaaaagaguucaaucaccuggagaagagaaucgaaaaccuuaauaagaaaguggacgauggcuuccuggacauuuggaccuacaacgccgagcuccugguccugcucgaaaaugagcggacacuggauuaucaugacuccaacgugaagaaccuuuacgagaaaguccgcaaucaacugaagaacaaugcuaaagaaaucgggaacggauguuuugaguucuaucacaagugcgauaauacguguauggaaagcgugaagaacggcaccuacgacuauccuaaauacucugaggaagccaagcucaauagagagaaaaucgaugggguuaagcuggaguccacacggauuuaucagauccuugccauuuacagcaccguggcuucuucccugguccucgugguuagccugggcgccaucuccuuuuggaugugcucuaacggaagccugcagugccgcauuuguaucuga

SEQ ID NO: 194971 - RNA, 1701 nt, Artificial Sequence
  derived and/or modified sequence opt5 from hemagglutinin__InfluenzaA__AHV83824
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugagacaauccuauauuaacgauaaggggaaggaagugcuuguccuguggggaauccaccaccccagcaccacaaccgaccagcagucccucuaccagaaugccgaugcuuacguguucgugggcacgucucgguauagcaaaaaguuuaaaccugagauugccauccgcccgaaggucagagaccaagaggggcggaugaacuacuauuggacacugguugaacccggagauaaaauuaccuucgaggcuacaggcaaccugguggugccucgcuacgccuuuaccauggaaagaaaugcgggguccggaaucauuaucagcgacacccccguccaugauugcaacacaacgugucagaccccugagggcgccaucaauacaucucuccccuuccagaacauucacccgaucaccauuggcaagugcccuaaauaugugaaguccacaaagcugcggcuugcuaccgggcugcgcaauguucccagcauccagucuagaggacucuuuggcgccauugcuggguucaucgaaggaggcuggacggggaugguggacggaugguacggcuaucaucaccaaaacgagcagggcagcggguacgccgccgaccugaaauccacacagaaugcuaucgauaagauuaccaacaaagucaauucugugaucgagaagaugaacacccaguuuacagcgguuggaaaagaguucaaucaccuugagaagcggauugaaaaccugaauaagaaaguggacgauggcuuccucgacaucuggaccuacaacgccgagcugcugguccuccuggaaaaugagcgcaaccuugauuaucaugacagcaacgugaagaaucuguacgagaaagucagaaaccaacucaagaauaacgcuaaagaaauugggaauggauguuuugaguucuaucacaagugcgauaacacauguauggaauccgugaagaauggcacguacgacuauccuaaauacagcgaggaagccaagcugaaccgggagaaaaucgaugggguuaaacuugagucuacccgcaucuaucagauucuggccaucuacuccacaguggcuagcucucucguccuggugguuucccugggcgccauuagcuuuuggaugugcuccaauggaucucuccagugcagaaucuguauuuga

SEQ ID NO: 194972 - RNA, 1701 nt, Artificial Sequence; identical to SEQ ID NO: 194944
  derived and/or modified sequence opt5 from hemagglutinin__InfluenzaA__AHV83825

SEQ ID NO: 194973 - RNA, 1701 nt, Artificial Sequence
  derived and/or modified sequence opt5 from hemagglutinin__InfluenzaA__AHV83826
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauuucaacgauaaggggaaggaagugcuuguccuguggggcauucaccaccccuccaccacagccgaccagcagucucucuaccagaaugcugaugccuacguguuugugggaaccagcagauauuccaaaaaguucaaaccugagaucgcuauucggccgaagguccgcgaccaagaggggagaaugaacuacuauuggacgcugguugaacccggagauaaaaucacauuugaggccaccggcaaccugguggugccucgguacgcguucacaauggaacgcaaugccgggagcggaauuaucauuucugacacccccguccaugauugcaacaccacaugucagacgccugagggcgcuaucaauaccucccuccccuuucagaacauccacccgauuacaaucggcaagugcccuaaauauguuaagagcaccaagcugagacuugccacagggcugcggaaugugcccucuauucagagccgcggacucuucggcgcuaucgccggguuuauugaaggaggcuggaccgggaugguggacggaugguacggcuaucaucaccaaaacgagcagggcuccggguacgccgcugaccugaaaucuacgcagaaugcgaucgauaagaucacaaacaaagucaauagcgugauugagaagaugaacacccaguucaccgccguuggaaaagaguucaaucaccuugagaagagaaucgaaaaccugaauaagaaaguggacgauggcuuucucgacauuuggacauacaacgcugagcugcugguccuccuggaaaaugagcggacccuugauuaucaugacuccaacgugaagaaccuguacgagaaaguccgcaaucaacucaagaacaaugccaaagaaaucgggaacggauguuucgaguuuuaucacaagugcgauaauacauguauggaaagcgugaagaacggcacguacgacuauccuaaauacucugaggaagccaagcugaauagagagaaaauugaugggguuaaacuugaguccacccggaucuaucagauccuggcuauuuacagcacagccgcgucuucccucgugcuggucgugagccugggcgcuaucuccuucuggaugugcucuaacggaagccuccagugccgcauuuguaucuga

SEQ ID NO: 194974 - RNA, 1701 nt, Artificial Sequence; identical to SEQ ID NO: 193064
  derived and/or modified sequence opt5 from hemagglutinin__InfluenzaA__AHV83827

SEQ ID NO: 194975 - RNA, 1701 nt, Artificial Sequence; identical to SEQ ID NO: 193064
  derived and/or modified sequence opt5 from hemagglutinin__InfluenzaA__AHV83828

SEQ ID NO: 194976 - RNA, 1701 nt, Artificial Sequence
  derived and/or modified sequence opt5 from hemagglutinin__InfluenzaA__AHV83829
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaaacugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauuaauuacgaggagcugcgggaacagcuuuccagcgucucuuccuucgagcgcuuugaaaucuuccccaaaaccagcucuuggccuaaccacgacuccaauaagggagugacagccgcuuguccccaugccggcgccaagagcuuuuauaaaaaccugaucuggcucguuaagaaaggcaauucuuacccuaagauuucccaaagcuauaucaacgauaaagggaaggaggugcugguccuuuggggcauucaccaccccuccaccacagccgaccagcagucucuguaccagaaugcugaugccuacguguucgugggaaccagcagauauuccaagaaauuuaagccugagaucgcuauucggccgaaaguccgcgaccaagaagggagaaugaacuacuauuggacgcucguugagcccggagauaagaucacauucgaagccaccggcaaccugguggugccucgguacgcguuuacaauggagcgcaaugccgggagcggaauuaucaucucugacacccccguccaugauugcaacaccacaugucagacgccugaaggcgcuauuaauaccucccugcccuuccagaacauccacccgauuacaaucggcaaaugcccuaaguaugugaaaagcaccaagcucagacuggccacagggcuucggaauguucccucuauucagagccgcggacuguuuggcgcuaucgccggguucaucgagggaggcuggaccgggaugguggacggaugguacggcuaucaucaccaaaacgagcagggcuccggguacgccgcugaccucaagucuacgcagaaugcgauugauaaaaucacaaacaaggucaauagcgugauugaaaagaugaacacccaguuuaccgccguuggaaaggaguucaaucaccuggagaaaagaaucgaaaaccuuaauaagaagguggacgauggcuuccuggacauuuggacauacaacgcugaacuccugguccugcucgagaaugagcggacccuggauuaucaugacuccaacgugaaaaaccuuuacgaaaagguccgcaaucaacugaaaaacaaugccaaggagaucgggaacggauguuuugaguucuaucacaaaugcgauaauacauguauggaaagcgugaagaacggcacguacgacuauccuaaguacucugaagaggccaaacucaauagagagaagaucgaugggguuaaacuggaauccacccggauuuaucagauccuugcuauuuacagcacaguggccucuucccugguccucgugguuagccugggcgcgaucuccuuuuggaugugcucuaacggaagccugcagugccgcauuuguaucuga

SEQ ID NO: 194977 - RNA, 1701 nt, Artificial Sequence; identical to SEQ ID NO: 193064
  derived and/or modified sequence opt5 from hemagglutinin__InfluenzaA__AHV83830

SEQ ID NO: 194978 - RNA, 1701 nt, Artificial Sequence
  derived and/or modified sequence opt5 from hemagglutinin__InfluenzaA__AHV83831
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccauugccgaccagcagucucucuaccagaaugcugaugccuacguguucgugggcacaagcagauauuccaaaaaguuuaaaccugagaucgcuauucggccgaagguccgcgaccaagaggggagaaugaacuacuauuggacccugguugaacccggagauaaaaucacguucgaggccacaggcaaccugguggugccucgguacgcguuuaccauggaacgcaaugccgggagcggaauuaucgucucugacacacccgugcaugauugcaacaccaccugucagacaccugagggcgcuaucaauacgucccuccccuuccagaacauucacccgaucaccauuggcaagugcccuaaauauguuaagagcacaaagcugagacuugccaccgggcugcggaaugugcccucuauccagagccgcggacucuuuggcgcuauugccggguucaucgaaggaggcuggacagggauggucgacggaugguacggcuaucaucaccaaaacgagcagggcuccggguacgccgcugaccugaaaucuacccagaaugcgaucgauaagauuacgaacaaagugaauagcguuaucgagaagaugaacacacaguuuaccgccgugggaaaagaguucaaucaccuugagaagagaauugaaaaccugaauaagaaagucgacgauggcuuccucgacaucuggaccuacaacgcugagcugcuggugcuccuggaaaaugagcggacacuugauuaucaugacuccaacgucaagaaccuguacgagaaagugcgcaaucaacucaagaacaaugccaaagaaauugggaacggauguuuugaguucuaucacaagugcgauaauaccuguauggaaagcguuaagaacggcacauacgacuauccuaaauacucugaggaagccaagcugaauagagagaaaaucgauggggugaaacuugaguccacgcggaucuaucagauucuggcuaucuacagcaccgucgccucuucccucgugcugguugugagccugggcgcgauuuccuuuuggaugugcucuaacggaagccuccagugccgcaucuguauuuga

SEQ ID NO: 194979 - RNA, 1701 nt, Artificial Sequence; identical to SEQ ID NO: 194027
  derived and/or modified sequence opt5 from hemagglutinin__InfluenzaA__AHV83832

SEQ ID NO: 194980 - RNA, 1701 nt, Artificial Sequence; identical to SEQ ID NO: 193064
  derived and/or modified sequence opt5 from hemagglutinin__InfluenzaA__AHV83833

SEQ ID NO: 194981 - RNA, 1701 nt, Artificial Sequence; identical to SEQ ID NO: 194045
  derived and/or modified sequence opt5 from hemagglutinin__InfluenzaA__AHV83834

SEQ ID NO: 194982 - RNA, 1701 nt, Artificial Sequence
  derived and/or modified sequence opt5 from hemagglutinin__InfluenzaA__AHV83836
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaggagcugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaaggaaaauagcuacccuaaacugagacaauccuauauuaacgauaagggcaaggaggugcuuguccugugggggauccaccaccccagcaccacaaccgaccagcagucccucuaccagaaugccgaugcuuacguguucgugggaacgucucgguauagcaaaaaguuuaaaccugagauugccauccgcccgaaggucagagaccaagaaggccggaugaacuacuauuggacacugguugagcccggggauaaaauuaccuucgaagcuacaggaaaccugguggugccucgcuacgccuuuaccauggagagaaaugcgggcuccgggaucauuaucagcgacacccccguccaugauugcaacacaacgugucagaccccugaaggagccaucaauacaucucuccccuuccagaacauucacccgaucaccauuggcaagugcccuaaauaugugaaguccacaaagcugcggcuugcuaccggccugcgcaauguucccagcauccagucuagagggcucuuuggagccauugcuggcuucaucgaagggggauggacgggcaugguggacgggugguacggauaucaucaccaaaacgagcagggcagcggcuacgccgccgaccugaaauccacacagaaugcuaucgauaagauuaccaacaaagucaauucugugaucgaaaagaugaacacccaguuuacagcgguugggaaagaguucaaucaccuugaaaagcggauugagaaccugaauaagaaaguggacgauggauuccucgacaucuggaccuacaacgccgaacugcugguccuccuggagaaugagcgcacacuugauuaucaugacagcaacgugaagaaccuguacgaaaaagucagaaaucaacucaagaacaaugcuaaagagauuggcaacggguguuuugaguucuaucacaagugcgauaauacguguauggaauccgugaagaacggaaccuacgacuauccuaaauacagcgaagaggccaagcugaaucgggagaaaaucgauggcguuaaacuugaaucuacacgcaucuaucagauucuggccaucuacuccaccguggcuagcucucucguccuggugguuucccugggggccauuagcuuuuggaugugcuccaacggcucucuccagugcagaaucuguauuuga

SEQ ID NO: 194983 - RNA, 1701 nt, Artificial Sequence; identical to SEQ ID NO: 194931
  derived and/or modified sequence opt5 from hemagglutinin__InfluenzaA__AHV83837

SEQ ID NO: 194984 - RNA, 1701 nt, Artificial Sequence; identical to SEQ ID NO: 193064
  derived and/or modified sequence opt5 from hemagglutinin__InfluenzaA__AHV83838

SEQ ID NO: 194985 - RNA, 1701 nt, Artificial Sequence; identical to SEQ ID NO: 194027
  derived and/or modified sequence opt5 from hemagglutinin__InfluenzaA__AHV83839

SEQ ID NO: 194986 - RNA, 1701 nt, Artificial Sequence; identical to SEQ ID NO: 194045
  derived and/or modified sequence opt5 from hemagglutinin__InfluenzaA__AHV83840

SEQ ID NO: 194987 - RNA, 1701 nt, Artificial Sequence
  derived and/or modified sequence opt5 from hemagglutinin__InfluenzaA__AHV83841
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugagacaauccuauauuaacgauaaggggaaggaagugcuuguccuguggggaauccaccaccccagcaccacaaccgaccagcagucccucuaccagaaugccgaugcuuacguguucgugggcacgucucgguauagcaaaaaguuuaaaccugagauugccauccgcccgaaggucagagaccaagaggggcggaugaacuacuauuggacacugguugaacccggagauaaaauuaccuucgaggcuacaggcaaccugguggugccucgcuacgccuuuaccauggaaagaaaugcgggguccggaaucauuaucagcgacacccccguccauaacugcaauacaacgugucagaccccugagggcgccaucaacacaucucuccccuuccagaauauucacccgaucaccauuggcaagugcccuaaauaugugaaguccacaaagcugcggcuugcuaccgggcugcgcaacguucccagcauccagucuagaggacucuuuggcgccauugcuggguucaucgaaggaggcuggacggggaugguggauggaugguacggcuaucaucaccaaaaugagcagggcagcggguacgccgccgaccugaaauccacacagaacgcuaucgacaagauuaccaauaaagucaacucugugaucgagaagaugaauacccaguuuacagcgguuggaaaagaguucaaccaccuugagaagcggauugaaaaucugaacaagaaaguggaugacggcuuccucgauaucuggaccuacaaugccgagcugcugguccuccuggaaaacgagcgcacacuugacuaucaugauagcaacgugaagaaucuguacgagaaagucagaaaccaacucaagaauaacgcuaaagaaauugggaauggauguuuugaguucuaucacaagugcgacaacacguguauggaauccgugaagaauggcaccuacgauuauccuaaauacagcgaggaagccaagcugaaccgggagaaaaucgacgggguuaaacuugagucuacacgcaucuaucagauucuggccaucuacuccaccguggcuagcucucucguccuggugguuucccugggcgccauuagcuuuuggaugugcuccaauggaucucuccagugcagaaucuguauuuga

SEQ ID NO: 194988 - RNA, 1701 nt, Artificial Sequence; identical to SEQ ID NO: 193064
  derived and/or modified sequence opt5 from hemagglutinin__InfluenzaA__AHV83842

SEQ ID NO: 194989 - RNA, 1701 nt, Artificial Sequence; identical to SEQ ID NO: 193064
  derived and/or modified sequence opt5 from hemagglutinin__InfluenzaA__AHV83843

SEQ ID NO: 194990 - RNA, 1701 nt, Artificial Sequence; identical to SEQ ID NO: 193064
  derived and/or modified sequence opt5 from hemagglutinin__InfluenzaA__AHV83844

SEQ ID NO: 194991 - RNA, 1701 nt, Artificial Sequence
  derived and/or modified sequence opt5 from hemagglutinin__InfluenzaA__AHV83845
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaucccccuaccacagccgaccagcagucccucuaccagaaugcugaugccuacguguucgugggcaccucuagauauagcaaaaaguuuaaaccggagauugcuauccggcccaagguccgcgaccaagaggggagaaugaacuacuauuggacgcugguugaaccuggagauaaaauuacauucgaggccaccggcaaccugguggugccccgguacgcguuuacaauggaacgcaaugccggguccggaaucauuaucagcgacaccccuguccacgauugcaacaccacaugucagacgcccgagggcgcuaucaauaccucucucccguuccagaacauucacccuaucacaauuggcaagugccccaaauaugugaaguccaccaagcugagacuugccacagggcugcggaauguuccuagcauccagucucgcggacucuuuggcgcuauugccggguucaucgaaggaggcuggaccgggaugguggacggaugguacggcuaucaucaccaaaacgagcagggcagcggguacgccgcugaccugaaauccacgcagaaugcgaucgauaagauuacaaacaaagucaauucugugaucgagaagaugaacacccaguuuaccgccguuggaaaagaguucaaucaccuugagaagagaauugaaaaccugaauaagaaaguggacgauggcuuccucgacaucuggacauacaacgcugagcugcugguccuccuggaaaaugagcggacccuugauuaucaugacagcaacgugaagaaccuguacgagaaaguccgcaaucaacucaagaacaaugccaaagaaauugggaacggauguuuugaguucuaucacaagugcgauaauacauguauggaauccgugaagaacggcacguacgacuaucccaaauacagcgaggaagccaagcugaauagagagaaaaucgaugggguuaaacuugagucuacccggaucuaucagauucuggcuaucuacuccacagccgcgagcucucucgugcuggucgugucccugggcgcuauuagcuuuuggaugugcuccaacggaucucuccagugccgcaucuguauuuga

SEQ ID NO: 194992 - RNA, 1701 nt, Artificial Sequence; identical to SEQ ID NO: 193064
  derived and/or modified sequence opt5 from hemagglutinin__InfluenzaA__AHV83846

SEQ ID NO: 194993 - RNA, 1701 nt, Artificial Sequence; identical to SEQ ID NO: 193064
  derived and/or modified sequence opt5 from hemagglutinin__InfluenzaA__AHV83847

SEQ ID NO: 194994 - RNA, 1701 nt, Artificial Sequence; identical to SEQ ID NO: 193064
  derived and/or modified sequence opt5 from hemagglutinin__InfluenzaA__AHV83848

SEQ ID NO: 194995 - RNA, 1701 nt, Artificial Sequence; identical to SEQ ID NO: 194917
  derived and/or modified sequence opt5 from hemagglutinin__InfluenzaA__AHV83849

SEQ ID NO: 194996 - RNA, 1701 nt, Artificial Sequence
  derived and/or modified sequence opt5 from hemagglutinin__InfluenzaA__AHV83850
augaaggccauccuggugguccuccuguacaccuucgcuacaacgaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaaggccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaaaggagugacagcugccuguccccaugcuggcgccaagagcuuuuauaaaaaccugaucuggcucguuaagaaaggcaauucuuacccuaagcugucccaaagcuauauuaacgauaaggggaaagaagugcuuguccuguggggaauccaccaccccuccaccacagcggaccagcagucucucuaccagaaugccgaugcuuacguguucgugggcaccagcagauauuccaagaaauuuaagccugagauugccauccggccgaaaguccgcgaccaagaggggagaaugaacuacuauuggacgcugguugaacccggagauaagauuacauucgaggcuaccggcaaccugguggugccucgguacgccuuuacaauggaacgcaaugcggggagcggaaucauuaucucugacacccccguccaugauugcaacaccacaugucagacgccugagggcgccaucaauaccucccuccccuuccagaacauucacccgaucacaauuggcaaaugcccuaaguauguuaagagcaccaaacugagacuugcuacagggcugcggaaugugcccucuauccagagccgcggacucuuuggcgccauugcuggguucaucgaaggaggcuggaccgggaugguggacggaugguacggcuaucaucaccaaaacgagcagggcuccggguacgccgccgaccugaagucuacgcagaaugcuaucgauaaaauuacaaacaaggucaauagcgugaucgagaaaaugaacacccaguuuaccgcgguuggaaaggaguucaaucaccuugagaagagaauugaaaaccugaauaaaaagguggacgauggcuuccucgacaucuggacauacaacgccgagcugcugguccuccuggaaaaugagcggacccuugauuaucaugacuccaacgugaaaaaccuguacgagaagguccgcaaucaacucaaaaacaaugcuaaggaaauugggaacggauguuuugaguucuaucacaagugcgauaauacauguauggaaagcgugaaaaacggcacguacgacuauccuaaguacucugaggaagccaaacugaauagagagaagaucgaugggguuaaacuugaguccacccggaucuaucagauucuggccaucuacagcacaguggcuucuucccucguccuggugguuagccugggcgccauuuccuuuuggaugugcucuaacggaagccuccagugccgcaucuguauuuga

SEQ ID NO: 194997 - RNA, 1701 nt, Artificial Sequence; identical to SEQ ID NO: 193064
  derived and/or modified sequence opt5 from hemagglutinin__InfluenzaA__AHV83851

SEQ ID NO: 194998 - RNA, 1701 nt, Artificial Sequence; identical to SEQ ID NO: 193064
  derived and/or modified sequence opt5 from hemagglutinin__InfluenzaA__AHV83852

SEQ ID NO: 194999 - RNA, 1701 nt, Artificial Sequence
  derived and/or modified sequence opt5 from hemagglutinin__InfluenzaA__AHV83853
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaacacucucuaccgccagcuccuggucuuacaucguggagacgagcuccucugacaacgggaccugcuauccgggcgauuuuauugacuacgaagaacugcgggagcagcuuagcuccgucagcucuuucgaacgcuuugagaucuuccccaagacauccagcuggccuaaucacgauucuaacaagggagugaccgccgcuuguccccaugccggcgcgaaaggcuuuuauaagaaucugaucuggcucguuaaaaaggggaacuccuacccuaaacugagcaagucuuauauuaaugacaagggaaaagaagugcuuguccuguggggcauccaccaccccuccacaaccgccgaucaacagagccucuaccagaacgcugacacguacguguucguggggacauccagauauucuaagaaauuuaagccugagauugccauccggccgaaaguccgcgaucaggagggaagaaugaauuacuauuggacccugguugaacccggcgacaagauuacauucgaggcuaccgggaaccugguggugccucgguacgccuuugcgauggaacgcgaugccggaagcggcaucauuaucuccgacacccccguccaugacugcaacacaacgugucaaaccccuaaaggcgcuaucaauacaagccuccccuuccagaacauucacccgaucaccauugggaagugcccuaaguaugugaaaucuacaaagcugagacuugccaccggacugcggaauguucccuccauccagagccgcggccucuuuggggcuauugccggauucaucgagggcggguggacgggaaugguggauggcugguacggcuaucaucaccagaacgaacaagggucuggauacgccgcugaccugaaaagcacacagaaugcgaucgauaagauuaccaacaaagucaauuccgugaucgagaagaugaacacccaguuuacagccguuggcaaggaguucaaucaccuugagaaaagaauugagaaccugaauaagaaaguggacgauggguuccucgacaucuggaccuacaacgcugaacugcugguccuccuggagaaugaacggacacuugauuaucaugacucuaacgugaagaaucuguacgagaaaguccgcacgcagcucaagaacaacgccaaggagauuggaaauggcuguuuugaguucuaucacaaaugcgauaacaccuguauggaaagcgugaagaaugggacauacgacuauccuaaauacuccgaagaggccaagcugaacagagaagagaucgauggcguuaaacuugagagcacccggaucuaucaaauucuggcuaucuacucuacagccgcguccagccucgugcuggucgugucucugggagcuauuuccuuuuggaugugcagcaauggcucccuccagugccgcaucuguauuuga

SEQ ID NO: 195000 - RNA, 1701 nt, Artificial Sequence; identical to SEQ ID NO: 194926
  derived and/or modified sequence opt5 from hemagglutinin__InfluenzaA__AHV83855

SEQ ID NO: 195001 - RNA, 1701 nt, Artificial Sequence
  derived and/or modified sequence opt5 from hemagglutinin__InfluenzaA__AHV83856
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauauguuaagagcaccaagcugagacuugccacagggcugcggaaugugcccucuauccagagccgcggacucuuuggcgcuauugccggguucaucgaaggaggcuggaccgggaugguggacggaugguacggcuaucaucaccaaaacgagcagggcuccggguacgccgcugaccugaaaucuacgcagaaugcgaucgauaagauuacaaacaaagucaauagcgugaucgagaagaugaacacccaguuuaccgccguuggaaaagaguucaaucaccuugagaagagaauugaaaaccugaauaagaaaguggacgauggcuuccucgacaucuggacauacaacgcugagcugcugguccuccuggaaaaugagcggacccuugauuaucaugacuccaacgugaagaaccuguacgagaaaguccgcaaucaacucaagaacaaugccaaagaaauugggaacggauguuuugaguucuaucacaagugcgauaauacauguauggaaaucgugaagaacggcacguacgacuauccuaaauacagcgaggaagccaagcugaauagagagaaaaucgaugggguuaaacuugagucuacccggauuuaucagauccuggcuauuuacuccacaguggccagcucucucguccuggugguuucccugggcgcgaucagcuuuuggaugugcuccaacggaucucuccagugccgcauuuguaucuga

SEQ ID NO: 195002 - RNA, 1701 nt, Artificial Sequence; identical to SEQ ID NO: 194926
  derived and/or modified sequence opt5 from hemagglutinin__InfluenzaA__AHV83857

SEQ ID NO: 195003 - RNA, 1701 nt, Artificial Sequence
  derived and/or modified sequence opt5 from hemagglutinin__InfluenzaA__AHV83858
augaaggccauccuggugguccuccuguacaccuucgcuacagccaacacggacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauuaauuacgaagaacugcgggagcagcuuuccagcgucucuuccuucgaacgcuuugagaucuuccccaagacaagcucuuggccuaaccacgacuccaauaagggagugaccgcugccuguccccaugcuggcgccaagagcuuuuauaagaaccugaucuggcucguuaaaaagggcaauucuuacccuaaacugucccaaagcuauauuaacgauaaggggaaggaagugcuuguccuguggggaauccaccaccccuccacaaccgcggaccagcagucucucuaccagaaugccgaugcuuacguguucgugggcacgagcagauauuccaaaaaguuuaaaccugagauugccauccggccgaagguccgcgaccaagaggggagaaugaacuacuauuggacacugguugaacccggagauaaaauuaccuucgaggcuacaggcaaccugguggugccucgguacgccuuuaccauggaacgcaaugcggggagcggaaucauuaucucugacacccccguccaugauugcaacacaacgugucagaccccugagggcgccaucaauacaucccuccccuuccagaacauucacccgaucaccauuggcaagugcccuaaauaugugaaaagcacaaagcugagacuugcuaccgggcugcggaauguucccucuauccagagccgcggacucuuuggcgccauugcuggguucaucgaaggaggcuggacggggaugguggacggaugguacggcuaucaucaccaaaacgagcagggcuccggguacgccgccgaccagaaaucuacacagaaugcuaucgauaagauuaccaacaaagucaauagcgugaucgagaagaugaacacccaauuuacagcgguuggaaaagaguucaaucaccuggagaagagaauugaaaaccuuaauaagaaaguggacgauggcuuccuggacaucuggaccuacaacgccgagcuccugguccugcucgaaaaugagcggacacuggauuaucaugacuccaacgugaagaaccuuuacgagaaaguccgcaaucagcugaagaacaaugcuaaagaaauugggaacggauguuuugaguucuaucacaagugcgauaauacguguauggaaagcgugaagaacggcaccuacgacuauccuaaauacucugaggaagccaagcucaauagagagaaaaucgaugggguuaagcuggaguccacacggaucuaucagauucuugccaucuacagcaccguggcuucuucccugguccucgugguuagccugggcgccauuuccuuuuggaugugcucuaacggaagccugcaaugccgcaucuguauuuga

SEQ ID NO: 195004 - RNA, 1701 nt, Artificial Sequence; identical to SEQ ID NO: 193064
  derived and/or modified sequence opt5 from hemagglutinin__InfluenzaA__AHV83859

SEQ ID NO: 195005 - RNA, 1701 nt, Artificial Sequence
  derived and/or modified sequence opt5 from hemagglutinin__InfluenzaA__AHV83861
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauuaauuacgaagaacugcgggagcagcuuuccagcgucucuuccuucgaacgcuuugagaucuuccccaagacaagcucuuggccuaaccacgacuccaauaagggagugaccgcugccuguccccaugcuggcgccaagagcuuuuauaagaaccugaucuggcucguuaaaaagggcaauucuuacccuaaacugucccaaagcuauauuaacgauaaggggaaggaagugcuuguccuguggggaauccaccaccccuccacaaccgcggaccagcagucucucuaccagaaugccgaugcuuacguguucgugggcacgagcagauauuccaaaaaguuuaaaccugagauugccauccggccgaagguccgcgaccaagaggggagaaugaacuacuauuggacacugguugaacccggagauaaaauuaccuucgaggcuacaggcaaccugguggugccucgguacgccuuuaccauggaacgcaaugcggggagcggaaucauuaucucugacacccccguccaugauugcaacacaacgugucagaccccugagggcgccaucaauacaucccuccccuuccagaacauucacccgaucaccauuggcaagugcccuaaauauguuaagagcacaaagcugagacuugcuaccgggcugcggaaugugcccucuauccagagccgcggacucuuuggcgccauugcuggguucaucgaaggaggcuggacggggaugguggacggaugguacggcuaucaucaccaaaacgagcagggcuccggguacgccgccgaccugaaaucuacacagaaugcuaucgauaagauuaccaacaaagucaauagcgugaucgagaagaugaacacccaguuuacagcgguuggaaaagaguucaaucaccuugagaagagaauugaaaaccugaauaagaaaguggacgauggcuuccucgacaucuggaccuacaacgccgagcugcugguccuccuggaaaaugagcggacacuugauuaucaugacuccaacgugaagaaccuguacgagaaaguccgcaaucaacucaagaacaaugcuaaagaaauugggaacggauguuuugaguucuaucacaagugcgauaauacguguauggaaagcgugaagaacggcaccuacgacuauccuaaauacucugaggaagccaagcugaauagagagaaaaucgaugggguuaaacuugaguccacacggaucuaucagauucuggccaucuacagcaccguggcuucuucccucguccuggugguuagccugggcgccauuuccuuuuggaugugcucuaacggaagccuccagugccgcaucuguauuuga

SEQ ID NO: 195006 - RNA, 1701 nt, Artificial Sequence; identical to SEQ ID NO: 195005
  derived and/or modified sequence opt5 from hemagglutinin__InfluenzaA__AHV83862

SEQ ID NO: 195007 - RNA, 1701 nt, Artificial Sequence; identical to SEQ ID NO: 193064
  derived and/or modified sequence opt5 from hemagglutinin__InfluenzaA__AHV83863

SEQ ID NO: 195008 - RNA, 1701 nt, Artificial Sequence; identical to SEQ ID NO: 193064
  derived and/or modified sequence opt5 from hemagglutinin__InfluenzaA__AHV83864

SEQ ID NO: 195009 - RNA, 1701 nt, Artificial Sequence
  derived and/or modified sequence opt5 from hemagglutinin__InfluenzaA__AHV83866
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccauccaugauugcaacaccacaugucagacgccugagggcgcuauuaauaccucccuccccuuccagaacauccacccgauuacaaucggcaagugcccuaaauaugucaagagcaccaagcugagacuugccacagggcugcggaaugugcccucuauucagagccgcggacucuuuggcgcuaucgccggguucaucgaaggaggcuggaccgggaugguugacggaugguacggcuaucaucaccaaaacgagcagggcuccggguacgccgcugaccugaaaucuacgcagaaugcgauugauaagaucacaaacaaagugaauagcgucauugagaagaugaacacccaguuuaccgccgugggaaaagaguucaaucaccuugagaagagaaucgaaaaccugaauaagaaaguugacgauggcuuccucgacauuuggacauacaacgcugagcugcuggugcuccuggaaaaugagcggacccuugauuaucaugacuccaacgucaagaaccuguacgagaaagugcgcaaucaacucaagaacaaugccaaagaaaucgggaacggauguuuugaguucuaucacaagugcgaugacacauguauggaaagcgucaagaauggcacguacgauuauccuaaauacucugaggaagccaagcugaacagagagaaaaucgacggggugaaacuugaguccacccggauuuaucagauccuggcuauuuacagcacaguugccucuucccucgugcuggucgugagccugggcgcgaucuccuuuuggaugugcucuaauggaagccuccagugccgcauuuguaucuga

SEQ ID NO: 195010 - RNA, 1701 nt, Artificial Sequence
  derived and/or modified sequence opt5 from hemagglutinin__InfluenzaA__AHV83867
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauauguuaagagcaccaagcugagacuugccacagggcugcggaaugugcccucuauccagagccgcggacucuuuggcgcuauugccggguucaucgaaggaggcuggaccgggaugguggacggaugguacggcuaucaucaccaaaacgagcagggcuccggguacgccgcugaccugaaaucuacgcagaaugcgaucgauaagauuacaaacaaagucaauagcgugaucgagaagaugaacacccaguuuaccgccguuggaaaagaguucaaucaccuugagaagagaauugaaaaccugaauaagaaaguggacgauggcuuccucgacaucuggacauacaacgcugagcugcugguccuccuggaaaaugagcggacccuugauuaucaugacuccaacgugaagaaccuguacgagaaaguccgcaaucaacucaagaacaaugccaaagaaauugggaacggauguuuugaguucuaucacaagugcgaugacacauguauggaaagcgugaagaauggcacguacgauuauccuaaauacucugaggaagccaagcugaacagagagaaaaucgacgggguuaaacuugaguccacccggaucuaucagauucuggcuaucuacagcacaguggccucuucccucguccuggugguuagccugggcgcgauuuccuuuuggaugugcucuaauggaagccuccagugccgcaucuguauuuga

SEQ ID NO: 195011 - RNA, 1701 nt, Artificial Sequence; identical to SEQ ID NO: 193064
  derived and/or modified sequence opt5 from hemagglutinin__InfluenzaA__AHV83868

SEQ ID NO: 195012 - RNA, 1701 nt, Artificial Sequence
  derived and/or modified sequence opt5 from hemagglutinin__InfluenzaA__AHV83869
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccaacagcuggccuaaucacgacucuaacaagggagugacagccgcuuguccccaugccggcgcgaaauccuuuuauaagaaucugaucuggcucguuaaaaagggcaacagcuacccuaaacugucucaauccuauauuaaugauaaggggaaggaagugcuuguccuguggggaauccaccaccccagcaccacagccgaccagcagucccucuaccagaacgcugaugccuacguguucgugggcaccucuagauauagcaaaaaguuuaaaccugagauugcuauccggccgaagguccgcgaccaagaggggagaaugaacuacuauuggacgcugguugaacccggagauaaaauuacauucgaggccaccggcaaucugguggugccucgguacgcguuuacaauggaacgcaacgccggguccggaaucauuaucagcgacacccccguccaugauugcaauaccacaugucagacgccugagggcgcuaucaacaccucucuccccuuccagaauauucacccgaucacaauuggcaagugcccuaaauaugugaaguccaccaagcugagacuugccacagggcugcggaacguucccagcauccagucucgcggacucuuuggcgcuauugccggguucaucgaaggaggcuggaccgggaugguggacggaugguacggcuaucaucaccaaaaugagcagggcagcggguacgccgcugaccugaaauccacgcagaacgcgaucgauaagauuacaaauaaagucaacucugugaucgagaagaugaauacccaguuuaccgccguuggaaaagaguucaaccaccuugagaagagaauugaaaaucugaacaagaaaguggacgauggcuuccucgacaucuggacauacaaugcugagcugcugguccuccuggaaaacgagcggacccuugauuaucaugacagcaacgugaagaaucuguacgagaaaguccgcaaccaacucaagaauaacgccaaagaaauugggaauggauguuuugaguucuaucacaagugcgauaacacauguauggaauccgugaagaauggcacguacgacuauccuaaauacagcgaggaagccaagcugaacagagagaaaaucgaugggguuaaacuugagucuacccggaucuaucagauucuggcuaucuacuccacaguggccagcucucucguccuggugguuucccugggcgcgauuagcuuuuggaugugcuccaauggaucucuccagugccgcaucuguauuuga

SEQ ID NO: 195013 - RNA, 1701 nt, Artificial Sequence; identical to SEQ ID NO: 193064
  derived and/or modified sequence opt5 from hemagglutinin__InfluenzaA__AHV83870

SEQ ID NO: 195014 - RNA, 1701 nt, Artificial Sequence; identical to SEQ ID NO: 193064
  derived and/or modified sequence opt5 from hemagglutinin__InfluenzaA__AHV83871

SEQ ID NO: 195015 - RNA, 1701 nt, Artificial Sequence; identical to SEQ ID NO: 193064
  derived and/or modified sequence opt5 from hemagglutinin__InfluenzaA__AHV83872

SEQ ID NO: 195016 - RNA, 1701 nt, Artificial Sequence
  derived and/or modified sequence opt5 from hemagglutinin__InfluenzaA__AHV83873
augaaggccauccuggugguccuccuguacaccuucgcuacaacgaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauuaauuacgaagaacugcgggagcagcuuuccagcgucucuuccuucgaacgcuuugagaucuuccccaagacaagcucuuggccuaaccacgacuccaauaagggagugaccgcugccuguccccaugcuggcgccaagagcuuuuauaagaaccugaucuggcucguuaaaaagggcaauucuuacccuaaacugucccaaagcuauauuaacgauaaggggaaggaagugcuuguccuguggggaauccaccaccccuccacaguggcggaccagcagucucucuaccagaaugccgaugcuuacguguucgucggcaccagcagauauuccaaaaaguuuaaaccugagauugccauccggccgaagguucgcgaccaagaggggagaaugaacuacuauuggacgcugguggaacccggagauaaaauuacauucgaggcuaccggcaaccugguggucccucgguacgccuuuacaauggaacgcaaugcggggagcggaaucauuaucucugacacccccgugcaugauugcaacaccacaugucagacgccugagggcgccaucaauaccucccuccccuuccagaacauucacccgaucacaauuggcaagugcccuaaauauguuaagagcaccaagcugagacuugcuacagggcugcggaaugugcccucuauccagagccgcggacucuuuggcgccauugcuggguucaucgaaggaggcuggaccgggauggucgacggaugguacggcuaucaucaccaaaacgagcagggcuccggguacgccgccgaccugaaaucuacgcagaaugcuaucgauaagauuacaaacaaagugaauagcguuaucgagaagaugaacacccaguuuaccgcggugggaaaagaguucaaucaccuugagaagagaauugaaaaccugaauaagaaagucgacgauggcuuccucgacaucuggacauacaacgccgagcugcuggugcuccuggaaaaugagcggacccuugauuaucaugacuccaacgucaagaaccuguacgagaaagugcgcaaucaacucaagaacaaugcuaaagaaauugggaacggauguuuugaguucuaucacaagugcgauaauacauguauggaaagcguuaagaacggcacguacgacuauccuaaauacucugaggaagccaagcugaauagagagaaaaucgauggggugaaacuugaguccacccggaucuaucagauucuggccaucuacagcacagucgcuucuucccucgugcugguugugagccugggcgccauuuccuuuuggaugugcucuaacggaagccuccagugccgcaucuguauuuga

SEQ ID NO: 195017 - RNA, 1701 nt, Artificial Sequence; identical to SEQ ID NO: 193064
  derived and/or modified sequence opt5 from hemagglutinin__InfluenzaA__AHV83874

SEQ ID NO: 195018 - RNA, 1701 nt, Artificial Sequence; identical to SEQ ID NO: 193064
  derived and/or modified sequence opt5 from hemagglutinin__InfluenzaA__AHV83875

SEQ ID NO: 195019 - RNA, 1701 nt, Artificial Sequence; identical to SEQ ID NO: 193064
  derived and/or modified sequence opt5 from hemagglutinin__InfluenzaA__AHV83876

SEQ ID NO: 195020 - RNA, 1701 nt, Artificial Sequence
  derived and/or modified sequence opt5 from hemagglutinin__InfluenzaA__AHV83877
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauuaauuacgaagaacugcgggagcagcuuuccagcgucucuuccuucaagcgcuuugaaaucuuccccaagaccagcucuuggccuaaccacgacuccaauaaaggagugacagccgcuuguccccaugccggcgccaagagcuuuuauaaaaaccugaucuggcucguuaagaaaggcaauucuuacccuaagcugucccaaagcuauauuaacgauaaggggaaagaggugcuuguccuguggggaauccaccaccccuccaccacagccgaccagcagucucucuaccagaaugcugaugccuacguguucgugggcaccagcagauauuccaagaaauuuaagccugaaauugcuauccggccgaaaguccgcgaccaagaggggagaaugaacuacuauuggacgcugguugagcccggagauaagauuacauucgaagccaccggcaaccugguggugccucgguacgcguuuacaauggagcgcaaugccgggagcggaaucauuaucucugacacccccguccaugauugcaacaccacaugucagacgccugaaggcgcuaucaauaccucccuccccuuccagaacauucacccgaucacaauuggcaaaugcccuaaguauguuaagagcaccaaacugagacuugccacagggcugcggaaugugcccucuauccagagccgcggacucuuuggcgcuauugccggguucaucgagggaggcuggaccgggaugguggacggaugguacggcuaucaucaccaaaacgaacagggcuccggguacgccgcugaccugaagucuacgcagaaugcgaucgauaaaauuacaaacaaggucaauagcgugaucgagaaaaugaacacccaguuuaccgccguuggaaaggaguucaaucaccuugaaaagagaauugagaaccugaauaaaaagguggacgauggcuuccucgacaucuggacauacaacgcugaacugcugguccuccuggagaaugaacggacccuugauuaucaugacuccaacgugaaaaaccuguacgagaagguccgcaaucaacucaaaaacaaugccaaggagauugggaacggauguuuugaguucuaucacaagugcgauaauacauguauggagagcgugaaaaacggcacguacgacuauccuaaguacucugaagaggccaaacugaauagagaaaagaucgaugggguuaaacuugaguccacccggaucuaucagauucuggcuaucuacagcacaguggccucuucccucguccuggugguuagccugggcgcgauuuccuuuuggaugugcucuaacggaagccuccagugccgcaucuguauuuga

SEQ ID NO: 195021 - RNA, 1701 nt, Artificial Sequence; identical to SEQ ID NO: 194931
  derived and/or modified sequence opt5 from hemagglutinin__InfluenzaA__AHV83878

SEQ ID NO: 195022 - RNA, 1701 nt, Artificial Sequence; identical to SEQ ID NO: 194931
  derived and/or modified sequence opt5 from hemagglutinin__InfluenzaA__AHV83879

SEQ ID NO: 195023 - RNA, 1701 nt, Artificial Sequence
  derived and/or modified sequence opt5 from hemagglutinin__InfluenzaA__AHV83881
augaaggccacccuggugguccuccuguacacauucgcuacggccaacgcggacacccuuugcaucggcuaucacgcuaauaacagcacagauaccguugacacagugcuggagaagaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacguccucuagcgacaacggaaccugcuauccgggggauuuuaucaauuacgaagaacugcgggagcagcuuuccagcgucucuuccuucgaacgcuuugagauuuuccccaagacaagcucuuggccuaaccacgacuccaauaagggagugaccgccgcuuguccccaugccggcgcgaaaucuuuuuauaagaaccugaucuggcucguuaaaaagggcaauagcuacccuaaacugucccaaagcuauaucaacgauaaggggaaggaagugcuuguccuguggggcauucaccaccccuccacaaccgccgaccagcagucucucuaccagaaugcugaugccuacguguucgugggcacgagcagauauuccaaaaaguuuaaaccugagaucgcuauucggccgaagguccgcgaccaagaggggagaaugaacuacuauuggacacugguugaacccggagauaaaaucaccuucgaggccacaggcaaccugguggugccucgguacgcguuuaccauggaacgcaaugccgggagcggaauuaucauuucugacacccccguccaugauugcaacacaacgugucagaccccugagggcgcuaucaauacaucccuccccuuccagaacauccacccgauuaccaucggcaagugcccuaaauauguuaagagcacaaagcugagacuugccaccgggcugcggaaugugcccucuauucagagccgcggacucuuuggcgcuaucgccggguucauugaaggaggcuggacggggaugguggacggaugguacggcuaucaucaccaaaacgagcagggcuccggguacgccgcugaccugaaaucuacacagaaugcgaucgauaagaucaccaacaaagucaauagcgugauugagaagaugaacacccaguuuacagccguuggaaaagaguucaaucaccuugagaagagaaucgaaaaccugaauaagaaaguggacgauggcuuccucgacauuuggaccuacaacgcugagcugcugguccuccuggaaaaugagcggacacuugauuaucaugacuccaacgugaagaaccuguacgagaaaguccgcaaucaacucaagaacaaugccaaagaaaucgggaacggauguuuugaguucuaucacaagugcgauaauacguguauggaaagcgugaagaacggcaccuacgacuauccuaaauacucugaggaagccaagcugaauagagagaaaauugaugggguuaaacuugaguccacacggaucuaucagauccuggcuauuuacagcaccguggccucuucccucguccuggugguuagccugggcgcgaucuccuuuuggaugugcucuaacggaagccuccagugccgcauuuguaucuga

SEQ ID NO: 195024 - RNA, 1701 nt, Artificial Sequence; identical to SEQ ID NO: 194045
  derived and/or modified sequence opt5 from hemagglutinin__InfluenzaA__AHV83882

SEQ ID NO: 195025 - RNA, 1701 nt, Artificial Sequence; identical to SEQ ID NO: 194027
  derived and/or modified sequence opt5 from hemagglutinin__InfluenzaA__AHV83883

SEQ ID NO: 195026 - RNA, 1701 nt, Artificial Sequence; identical to SEQ ID NO: 193064
  derived and/or modified sequence opt5 from hemagglutinin__InfluenzaA__AHV83884

SEQ ID NO: 195027 - RNA, 1701 nt, Artificial Sequence
  derived and/or modified sequence opt5 from hemagglutinin__InfluenzaA__AHV83885
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccgucuaugauugcaacaccacaugucagacgccugagggcgcuaucaauaccucccuccccuuccagaacauucauccgaucacaauuggcaagugcccuaaauacguuaagagcaccaagcugagacuugccacagggcugcggaaugugcccucuauccagagccgcggacucuuuggcgcuauugccggguucaucgaaggaggcuggaccgggaugguggacggaugguauggcuaccaccaucaaaacgagcagggcuccggguacgccgcugaccugaaaucuacgcagaaugcgaucgauaagauuacaaacaaagucaauagcgugaucgagaagaugaacacccaguuuaccgccguuggaaaagaguucaaucaccuugagaagagaauugaaaaccugaauaagaaaguggacgauggcuuccucgacaucuggacauauaacgcugagcugcugguccuccuggaaaaugagcggacccuugauuaccacgacuccaacgugaagaaccuguaugagaaaguccgcaaucaacucaagaacaaugccaaagaaauugggaacggauguuuugaguucuaccauaagugcgauaauacauguauggaaagcgugaagaacggcacguaugacuacccuaaauauucugaggaagccaagcugaauagagagaaaaucgaugggguuaaacuugaguccacccggaucuaccagauucuggcuaucuacagcacaguggccucuucccucguccuggugguuagccugggcgcgauuuccuuuuggaugugcucuaacggaagccuccagugccgcaucuguauuuga

SEQ ID NO: 195028 - RNA, 1701 nt, Artificial Sequence; identical to SEQ ID NO: 194944
  derived and/or modified sequence opt5 from hemagglutinin__InfluenzaA__AHV83887

SEQ ID NO: 195029 - RNA, 1701 nt, Artificial Sequence; identical to SEQ ID NO: 193064
  derived and/or modified sequence opt5 from hemagglutinin__InfluenzaA__AHV83888

SEQ ID NO: 195030 - RNA, 1701 nt, Artificial Sequence
  derived and/or modified sequence opt5 from hemagglutinin__InfluenzaA__AHV83889
augaaggccauccuggugguccuccugcacacccuugcuacagccaacgcggacacgcugugcauuggcuaccaugcuaauaacagcaccgauacaguugacaccgugcucgagaaaaaugugacagucacccacuccgugaaccugcuugaagauaagcauaaugggaaacuguguaagcucagaggaguugcuccccugcaccugggcaaaugcaacaucgccggguggauucucggaaauccugagugugaaucucugagcacagccuccucuuggagcuauaucguggagaccuccucuagcgacaacggcacgugcuacccgggggauuucauuaauuaugaggaacuucgggagcagcuguccagcgucucuuccuuugaacgcuucgagaucuuucccaagaccagcucuuggccuaaccaugacuccaauaagggagugacagccgcuuguccccacgccggcgcgaaaucuuucuacaagaaccucaucuggcugguuaaaaagggcaauagcuauccuaaacuuucccaaagcuacauuaacgauaaggggaaggaagugcugguccucuggggaauccaccaucccuccaccacagccgaccagcagucucuguaucagaaugcugaugccuacguguuugugggcaccagcagauacuccaaaaaguucaaaccugagauugcuauccggccgaagguccgcgaccaagaggggagaaugaacuauuacuggacgcugguugaacccggagauaaaauuacauuugaggccaccggcaaccucguggugccucgguaugcguucacaauggaacgcaaugccgggagcggaaucauuaucucugacacccccguccacgauugcaacaccacaugucagacgccugagggcgcuaucaauaccucccugcccuuucagaacauucauccgaucacaauuggcaagugcccuaaauacguuaagagcaccaaacuuagacuggccacagggcuccggaaugugcccucuauccagagccgcggacuguucggcgcuauugccggguuuaucgaaggaggcuggaccgggaugguggacggaugguauggcuaccaccaccaaaacgagcagggcuccggguaugccgcugaccuuaagucuacgcagaaugcgaucgauaagauuacaaacaaagucaauagcgugaucgagaagaugaacacccaguucaccgccguuggaaaagaauuuaaucaucuggagaagagaauugaaaaccucaauaagaaaguggacgauggcuuccuggacaucuggacauacaacgcugagcugcucguccugcuugaaaaugagcggacccuggauuaccacgacuccaacgugaagaaccucuaugagaaaguccgcaaucaacugaagaacaaugccaaagaaauugggaacggauguuucgaguuuuaccauaagugcgauaauacauguauggaaagcgugaagaacggcacguaugacuacccuaaauauucugaggaagccaaacuuaauagagagaagaucgaugggguuaagcuggaguccacccggaucuaccagauucucgcuaucuauagcacaguggccucuucccugguccuggugguuagccucggcgcgauuuccuucuggaugugcucuaacggaagccugcagugccgcaucuguauuuga

SEQ ID NO: 195031 - RNA, 1701 nt, Artificial Sequence; identical to SEQ ID NO: 193064
  derived and/or modified sequence opt5 from hemagglutinin__InfluenzaA__AHV83890

SEQ ID NO: 195032 - RNA, 1701 nt, Artificial Sequence; identical to SEQ ID NO: 193064
  derived and/or modified sequence opt5 from hemagglutinin__InfluenzaA__AHV83891

SEQ ID NO: 195033 - RNA, 1701 nt, Artificial Sequence; identical to SEQ ID NO: 193064
  derived and/or modified sequence opt5 from hemagglutinin__InfluenzaA__AHV83893

SEQ ID NO: 195034 - RNA, 1701 nt, Artificial Sequence; identical to SEQ ID NO: 193064
  derived and/or modified sequence opt5 from hemagglutinin__InfluenzaA__AHV83894

SEQ ID NO: 195035 - RNA, 1701 nt, Artificial Sequence
  derived and/or modified sequence opt5 from hemagglutinin__InfluenzaA__AHV83895
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauauguuaagagcaccaagcugagacuugccacagggcugcggaaugugcccucuauccagagccgcggacucuuuggcgcuauugccggguucaucgaaggaggcuggaccgggaugguggacggaugguacggcuaucaucaccaaaacgagcagggcuccggguacgccgcugaccugaaaucuacgcagaaugcgaucgauaagauuacaaacaaagucaauagcgugaucgagaagaugaacacccaguuuaccgccguuggaaaagaguucaaucaccuugagaagagaauugaaaaccugaauaagaaaguggacgauggcuuccucgacaucuggacauacaacgcugagcugcugguccuccuggaaaaugagcggacccuugauuaucaugacuccaacgugaagaaccuguacgagaaaguccgcaaucaacucaagaacaaugccaaagaaauugggaacggauguuuugaguucuaucacaagugcgauaauacauguauggaaagcgugaagaacggcacguacgacuauccuaaauacucugaggaaaccaagcugaauagagagaaaaucgaugggguuaaacuugaguccacacggaucuaucagauucuggccaucuacagcaccguggcuucuucccucguccuggugguuagccugggcgccauuuccuuuuggaugugcucuaacggaagccuccagugccgcaucuguauuuga

SEQ ID NO: 195036 - RNA, 1701 nt, Artificial Sequence; identical to SEQ ID NO: 193064
  derived and/or modified sequence opt5 from hemagglutinin__InfluenzaA__AHV83896

SEQ ID NO: 195037 - RNA, 1701 nt, Artificial Sequence; identical to SEQ ID NO: 193064
  derived and/or modified sequence opt5 from hemagglutinin__InfluenzaA__AHV83897

SEQ ID NO: 195038 - RNA, 1701 nt, Artificial Sequence
  derived and/or modified sequence opt5 from hemagglutinin__InfluenzaA__AHV83898
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauauguuaagagcaccaagcugagacuugugacagggcugcggaaugugcccucuauccagagccgcggacucuuuggcgccauugcuggguucaucgaaggaggcuggaccgggauggucgacggaugguacggcuaucaucaccaaaacgagcagggcuccggguacgccgccgaccugaaaucuacgcagaaugcuaucgauaagauuacaaacaaagugaauagcguuaucgagaagaugaacacccaguuuaccgcggugggaaaagaguucaaucaccuugagaagagaauugaaaaccugaauaagaaagucgacgauggcuuccucgacaucuggacauacaacgccgagcugcuggugcuccuggaaaaugagcggacccuugauuaucaugacuccaacgucaagaaccuguacgagaaagugcgcaaucaacucaagaacaaugcuaaagaaauugggaacggauguuuugaguucuaucacaagugcgauaauacauguauggaaagcguuaagaacggcacguacgacuauccuaaauacucugaggaagccaagcugaauagagagaaaaucgauggggugaaacuugaguccacccggaucuaucagauucuggccaucuacagcacagucgcuucuucccucgugcugguugugagccugggcgccauuuccuuuuggaugugcucuaacggaagccuccagugccgcaucuguauuuga

SEQ ID NO: 195039 - RNA, 1701 nt, Artificial Sequence; identical to SEQ ID NO: 193064
  derived and/or modified sequence opt5 from hemagglutinin__InfluenzaA__AHV83899

SEQ ID NO: 195040 - RNA, 1701 nt, Artificial Sequence; identical to SEQ ID NO: 193064
  derived and/or modified sequence opt5 from hemagglutinin__InfluenzaA__AHV83900

SEQ ID NO: 195041 - RNA, 1701 nt, Artificial Sequence; identical to SEQ ID NO: 193064
  derived and/or modified sequence opt5 from hemagglutinin__InfluenzaA__AHV83901

SEQ ID NO: 195042 - RNA, 1701 nt, Artificial Sequence; identical to SEQ ID NO: 193064
  derived and/or modified sequence opt5 from hemagglutinin__InfluenzaA__AHV83902

SEQ ID NO: 195043 - RNA, 1701 nt, Artificial Sequence; identical to SEQ ID NO: 193064
  derived and/or modified sequence opt5 from hemagglutinin__InfluenzaA__AHV83903

SEQ ID NO: 195044 - RNA, 1701 nt, Artificial Sequence; identical to SEQ ID NO: 193064
  derived and/or modified sequence opt5 from hemagglutinin__InfluenzaA__AHV83904

SEQ ID NO: 195045 - RNA, 1701 nt, Artificial Sequence
  derived and/or modified sequence opt5 from hemagglutinin__InfluenzaA__AHV83905
augaaggccauccuggugguccuccuguacacccuuacaacggcuaacgccgacacccugugcauuggcuaucacgcgaauaacagcacagauaccguugacacagugcucgagaaaaaugugaccgucacacauuccgugaaccugcuugaagauaagcacaaugggaaacuguguaagcucagaggaguugcuccccugcaucugggcaaaugcaacaucgccggguggauucucggaaauccugagugugaaucucugagcaccgccuccucuuggagcuacaucguggagacguccucuagcgacaacgggaccugcuauccgggcgauuucauuaauuacgaggaacuucgggagcagcuguccagcgucucuuccuuugaacgcuucgagaucuuucccaagacaagcucuuggccuaaccacgacuccaauaagggagugaccgcugccuguccccaugcuggcgccaagagcuucuauaagaaccucaucuggcugguuaaaaagggcaauucuuacccuaaacuuucccaaagcuauauuaacgauaaggggaaggaagugcugguccucuggggaauccaccaccccuccacaaccgcggaccagcagucucuguaccagaaugccgaugcuuacguguuugugggcacgagcagauauuccaaaaaguucaaaccugagauugccauccggccgaagguccgcgaccaagaggggagaaugaacuacuauuggacacugguugaacccggagauaaaauuaccuuugaggcuacaggcaaccucguggugccucgguacgccuucaccauggaacgcaaugcggggagcggaaucauuaucucugacacccccguccaugauugcaacacaacgugucagaccccugagggcgccaucaauacaucccugcccuuucagaacauucacccgaucaccauuggcaagugcccuaaauauguuaagagcacaaaacuuagacuggcuaccgggcuccggaaugugcccucuauccagagccgcggacuguucggcgccauugcuggguuuaucgaaggaggcuggacggggaugguggacggaugguacggcuaucaucaccaaaacgagcagggcuccggguacgccgccgaccuuaaaucuacacagaaugcuaucgauaagauuaccaacaaagucaauagcgugaucgagaagaugaacacccaguucacagcgguuggaaaagaauuuaaucaccuggagaagagaauugaaaaccucaauaagaaaguggacgauggcuuccuggacaucuggaccuacaacgccgagcugcucguccugcuugaaaaugagcggacacuggauuaucaugacuccaacgugaagaaccucuacgagaaaguccgcaaucaacugaagaacaaugcuaaagaaauugggaacggauguuucgaguuuuaucacaagugcgauaauacguguauggaaagcgugaagaacggcaccuacgacuauccuaaauacucugaggaagccaaacuuaauagagagaagaucgaugggguuaagcuggaguccacacggaucuaucagauucucgccaucuacagcaccguggcuucuucccugguccuggugguuagccucggcgccauuuccuucuggaugugcucuaacggaagccugcagugccgcaucuguauuuga

SEQ ID NO: 195046 - RNA, 1701 nt, Artificial Sequence; identical to SEQ ID NO: 193064
  derived and/or modified sequence opt5 from hemagglutinin__InfluenzaA__AHV83906

SEQ ID NO: 195047 - RNA, 1701 nt, Artificial Sequence; identical to SEQ ID NO: 193064
  derived and/or modified sequence opt5 from hemagglutinin__InfluenzaA__AHV83907

SEQ ID NO: 195048 - RNA, 1701 nt, Artificial Sequence
  derived and/or modified sequence opt5 from hemagglutinin__InfluenzaA__AHV83908
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaccgcucucuacagccagcuccuggucuuacaucguggagaccagcuccucugacaacggcacgugcuaucccggggauuuuauuaauuacgaagaacugcgggagcagcuuagcuccgucagcucuuucgaacgcuuugagaucuucccuaagaccuccagcuggcccaaccacgacucuaauaagggagugacagccgcuuguccucaugccggcgcgaaauccuuuuauaagaaccugaucuggcucguuaaaaagggcaauagcuaccccaaacugucucaauccuauauuaacgauaaggggaagaaagugcuuguccuguggggaauccaccacccuagcaccacagccgaccagcagucccucuaccagaaugcugaugccuacguguucgugggcaccucuagauauagcaagaaauuuaagccggaaauugcuauccggcccaaaguccgcgaccaagaggggagaaugaacuacuauuggacgcugguugagccuggagauaagauuacauucgaagccaccggcaaccugguggugccccgguacgcguuuacaauggagcgcaaugccggguccggaaucauuaucagcgacaccccuguccaugauugcaacaccacaugucagacgcccgaaggcgcuaucaauaccucucucccguuccagaacauucacccuaucacaauuggcaaaugccccaaguaugugaaguccaccaaacugagacuugccacagggcugcggaauguuccuagcauccagucucgcggacucuuuggcgcuauugccggguucaucgagggaggcuggaccgggaugguggacggaugguacggcuaucaucaccaaaacgaacagggcagcggguacgccgcugaccugaaguccacgcagaaugcgaucgauaaaauuacaaacaaggucaauucugugaucgagaaaaugaacacccaguuuaccgccguuggaaaggaguucaaucaccuugaaaagagaauugagaaccugaauaaaaagguggacgauggcuuccucgacaucuggacauacaacgcugaacugcugguccuccuggagaaugaacggacccuugauuaucaugacagcaacgugaaaaaccuguacgagaagguccgcaaucaacucaaaaacaaugccaaggagauugggaacggauguuuugaguucuaucacaagugcgauaauacauguauggaguccgugaaaaacggcacguacgacuaucccaaguacagcgaagaggccaaacugaauagagaaaagaucgaugggguuaaacuugagucuacccggaucuaucagauucuggcuaucuacuccacaguggccagcucucucguccuggugguuucccugggcgcgauuagcuuuuggaugugcuccaacggaucucuccagugccgcaucuguauuuga

SEQ ID NO: 195049 - RNA, 1701 nt, Artificial Sequence
  derived and/or modified sequence opt5 from hemagglutinin__InfluenzaA__AHV83911
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaccgcucucuacagccagcuccuggucuuacaucguggagaccagcuccucugacaacggcacgugcuaucccggggauuuuauuaauuacgaagaacugcgggagcagcuuagcuccgucagcucuuucgaacgcuuugagaucuucccuaagaccuccagcuggcccaaccacgacucuaauaagggagugacagccgcuuguccucaugccggcgcgaaauccuuuuauaagaaccugaucuggcucguuaaaaagggcaauagcuaccccaaacugucucaauccuauauuaacgauaaggggaaggaagugcuuguccuguggggaauccaccacccuagcaccacagccgaccagcagucccucuaccagaaugcugaugccuacguguucgugggcaccucuagauauagcaaaaaguuuaaaccggagauugcuauccggcccaagguccgcgaccaagaggggagaaugaacuacuauuggacgcugguugaaccuggagauaaaauuacauucgaggccaccggcaaccugguggugccccgguacgcguuuacaauggaacgcaaugccggguccggaaucauuaucagcgacaccccuguccaugauugcaacaccacaugucagacgcccgagggcgcuaucaauaccucucucccguuccagaacauucacccuaucacaauuggcaagugccccaaauaugugaaguccaccaagcugagacuugccacagggcugcggaauguuccuagcauccagucucgcggacucuuuggcgcuauugccggguucaucgaaggaggcuggaccgggaugguggacggaugguacggcuaucaucaccaaaacgagcagggcagcggguacgccgcugaccugaaauccacgcagaaugcgaucgauaagauuacaaacaaagucaauucugugaucgagaagaugaacacccaguuuaccgccguuggaaaagaguucaaucaccuugagaagagaauugaaaaccugaauaagaaaguggacgauggcuuccucgacaucuggacauacaacgcugagcugcugguccuccuggaaaaugagcggacccuugauuaucaugacagcaacgugaagaaccuguacgagaaaguccgcaaucaacucaagaacaaugccaaagaaauugggaacggauguuuugaguucuaucacaagugcgauaauacauguauggaauccgugaagaacggcacguacgacuaucccaaauacagcgaggaagccaagcugaauagagagaaaaucgaugggguuaaacuugagucuacccggaucuaucagauucuggcuaucuacuccacaguggccagcucucucguccuggugguuucccugggcgcgauuagcuuuuggaugugcuccaacggaucucuccagugccgcaucuguauuuga

SEQ ID NO: 195050 - RNA, 1701 nt, Artificial Sequence; identical to SEQ ID NO: 193064
  derived and/or modified sequence opt5 from hemagglutinin__InfluenzaA__AHV83912

SEQ ID NO: 195051 - RNA, 1701 nt, Artificial Sequence; identical to SEQ ID NO: 193064
  derived and/or modified sequence opt5 from hemagglutinin__InfluenzaA__AHV83913

SEQ ID NO: 195052 - RNA, 1701 nt, Artificial Sequence; identical to SEQ ID NO: 193064
  derived and/or modified sequence opt5 from hemagglutinin__InfluenzaA__AHV83915

SEQ ID NO: 195053 - RNA, 1701 nt, Artificial Sequence; identical to SEQ ID NO: 193064
  derived and/or modified sequence opt5 from hemagglutinin__InfluenzaA__AHV83916

SEQ ID NO: 195054 - RNA, 1701 nt, Artificial Sequence; identical to SEQ ID NO: 195049
  derived and/or modified sequence opt5 from hemagglutinin__InfluenzaA__AHV83917

SEQ ID NO: 195055 - RNA, 1701 nt, Artificial Sequence; identical to SEQ ID NO: 194027
  derived and/or modified sequence opt5 from hemagglutinin__InfluenzaA__AHV83919

SEQ ID NO: 195056 - RNA, 1701 nt, Artificial Sequence; identical to SEQ ID NO: 194944
  derived and/or modified sequence opt5 from hemagglutinin__InfluenzaA__AHV83920

SEQ ID NO: 195057 - RNA, 1701 nt, Artificial Sequence; identical to SEQ ID NO: 194045
  derived and/or modified sequence opt5 from hemagglutinin__InfluenzaA__AHV83921

SEQ ID NO: 195058 - RNA, 1701 nt, Artificial Sequence
  derived and/or modified sequence opt5 from hemagglutinin__InfluenzaA__AHV83922
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauauguuaagagcaccaagcugagacuugccacagggcugcggaaugugcccucuauccagagccgcggacucuuuggcgcuauugccggguucaucgaaggaggcuggaccgggaugguggacggaugguacggcuaucaucaccaaaacgagcagggcuccggguacgccgcugaccugaaaucuacgcagaaugcgaucgauaagauuacaaacaaagucaauagcgugaucgagaagaugaacacccaguuuaccgccguuggaaaagaguucucccaccuugagaagagaauugaaaaucugaacaagaaaguggacgauggcuuccucgacaucuggacauacaaugcugagcugcugguccuccuggaaaacgagcggacccuugauuaucaugacagcaaugugaagaaccuguacgagaaaguccgcaaccaacucaagaauaacgccaaagaaauugggaauggauguuuugaguucuaucacaagugcgauaacacauguauggaaucugugaagaauggcacguacgacuauccuaaauacuccgaggaagccaagcugaacagagagaaaaucgaugggguuaaacuugagagcacccggaucuaucagauucuggcuaucuacucuacaguggccuccagccucguccuggugguuucccugggcgcgauuucuuuuuggaugugcagcaauggaucccuccagugccgcaucuguauuuga

SEQ ID NO: 195059 - RNA, 1701 nt, Artificial Sequence; identical to SEQ ID NO: 194960
  derived and/or modified sequence opt5 from hemagglutinin__InfluenzaA__AHV83923

SEQ ID NO: 195060 - RNA, 1701 nt, Artificial Sequence; identical to SEQ ID NO: 194944
  derived and/or modified sequence opt5 from hemagglutinin__InfluenzaA__AHV83924

SEQ ID NO: 195061 - RNA, 1701 nt, Artificial Sequence; identical to SEQ ID NO: 194960
  derived and/or modified sequence opt5 from hemagglutinin__InfluenzaA__AHV83925

SEQ ID NO: 195062 - RNA, 1701 nt, Artificial Sequence; identical to SEQ ID NO: 194944
  derived and/or modified sequence opt5 from hemagglutinin__InfluenzaA__AHV83926

SEQ ID NO: 195063 - RNA, 1701 nt, Artificial Sequence; identical to SEQ ID NO: 195049
  derived and/or modified sequence opt5 from hemagglutinin__InfluenzaA__AHV83927

SEQ ID NO: 195064 - RNA, 1701 nt, Artificial Sequence
  derived and/or modified sequence opt5 from hemagglutinin__InfluenzaA__AHV83928
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauuaauuacgaagaacugcgggagcagcuuuccagcgucucuuccuucgaacgcuuugagaucuuccccaagacaagcucuuggccuaaccacgacuccaauaagggagugaccgcugccuguccccaugcuggcgccaagagcuuuuauaagaaccugaucuggcucguuaaaaagggcaauucuuacccuaaacugucccaaagcuauauuaacgauaaggggaaggaagugcuuguccuguggggaauccaccaccccuccacaaccgcggaccagcagucucucuaccagaaugccgaugcuuacguguucgugggcacgagcagauauuccaaaaaguuuaaaccugagauugccauccggccgaagguccgcgaccaagaggggagaaugaacuacuauuggacacugguugaacccggagauaaaauuaccuucgaggcuacaggcaaccugguggugccucgguacgccuuuaccauggaacgcaaugcggggagcggaaucauuaucucugacacccccguccaugauugcaacacaacgugucagaccccugagggcgccaucaauacaucccuccccuuccagaacauucacccgaucaccauuggcaagugcccuaaauaugugaaaagcacaaagcugagacuugcuaccgggcugcggaauguucccucuauccagagccgcggacucuuuggcgccauugcuggguucaucgaaggaggcuggacggggaugguggacggaugguacggcuaucaucaccaaaacgagcagggcuccggguacgccgccgaccagaaaucuacacagaaugcuaucgauaagauuaccaacaaagucaauagcgugaucgagaagaugaacacccaauuuacagcgguuggaaaagaguucaaucaccuggagaagagaauugaaaaccuuaauaagaaaguggacgauggcuuccuggacaucuggaccuacaacgccgagcuccugguccugcucgaaaaugagcggacacuggauuaucaugacuccaacgugaagaaccuuuacgagaaaguccgcaaucagcugaagaacaaugcuaaagaaauugggaacggauguuuugaguucuaucacaagugcgauaauacguguauggaaagcgugaagaacggcaccuacgacuauccuaaauacucugaggaagccaagcucaauagagagaaaaucgaugggguuaagcuggaguccacacggaucuaucagauucuugccaucuacagcaccguggcuucuucccugguccucgugguuagccugggcgccauuuccuuuuggaugugcucuaacggaagccugcaaugccgcaucuguauuuga

SEQ ID NO: 195065 - RNA, 1701 nt, Artificial Sequence; identical to SEQ ID NO: 194944
  derived and/or modified sequence opt5 from hemagglutinin__InfluenzaA__AHV83929

SEQ ID NO: 195066 - RNA, 1701 nt, Artificial Sequence
  derived and/or modified sequence opt5 from hemagglutinin__InfluenzaA__AHV83930
augaaggccauccuggugauucuccuguacaccuucgcuacagccaacgcggacacgcuuugcaucggcuaucacgcuaauaacagcaccgauacagucgacaccguucuggagaagaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucaauuacgaagaacugcgggagcagcuuuccagcgugucuuccuucgaacgcuuugagaucuuccccaagaccagcucuuggccuaaccacgacuccaauaagggagucacagccgcuuguccccaugccggcgcgaaaucuuuuuauaagaaccugauuuggcucgugaaaaagggcaauagcuacccuaaacugucccaaagcuauaucaacgauaaggggaaggaaguucuugugcuguggggcauucaccaccccuccaccacagccgaccagcagucucucuaccagaaugcugaugccuacgucuucgugggaaccagcagauauuccaaaaaguuuaaaccugagaucgcuauucggccgaaggugcgcgaccaagaggggagaaugaacuacuauuggacgcuggucgaacccggagauaaaaucacauucgaggccaccggcaaccugguugugccucgguacgcguuuacaauggaacgcaaugccgggagcggaauuaucaucucugacacccccgugcaugauugcaacaccacaugucagacgccugagggcgcuauuaauaccucccuccccuuccagaacauccacccgauuacaaucggcaagugcccuaaauaugucaagagcaccaagcugagacuugccacagggcugcggaaugugcccucuauucagagccgcggacucuuuggcgcuaucgccggguucaucgaaggaggcuggaccgggaugguugacggaugguacggcuaucaucaccaaaacgagcagggcuccggguacgccgcugaccugaaaucuacgcagaaugcgauugauaagaucacaaacaaagugaauagcgucauugagaagaugaacacccaguuuaccgccgugggaaaagaguucaaucaccuugagaagagaaucgaaaaccugaauaagaaaguugacgauggcuuccucgacauuuggacauacaacgcugagcugcuggugcuccuggaaaaugagcggacccuugauuaucaugacuccaacgucaagaaccuguacgagaaagugcgcaaucaacucaagaacaaugccaaagaaaucgggaacggauguuuugaguucuaucacaagugcgauaauacauguauggaaagcgucaagaacggcacguacgacuauccuaaauacucugaggaagccaagcugaauagagagaaaaucgauggggugaaacuugaguccacccggauuuaucagauccuggcuauuuacagcacaguugccucuucccucgugcuggucgugagccugggcgcgaucuccuuuuggaugugcucuaacggaagccuccagugccgcauuuguaucuga

SEQ ID NO: 195067 - RNA, 1701 nt, Artificial Sequence; identical to SEQ ID NO: 194944
  derived and/or modified sequence opt5 from hemagglutinin__InfluenzaA__AHV83931

SEQ ID NO: 195068 - RNA, 1701 nt, Artificial Sequence; identical to SEQ ID NO: 193064
  derived and/or modified sequence opt5 from hemagglutinin__InfluenzaA__AHV83932

SEQ ID NO: 195069 - RNA, 1701 nt, Artificial Sequence
  derived and/or modified sequence opt5 from hemagglutinin__InfluenzaA__AHV83933
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguuacaccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauuaauuacgaagaacugcgggagcagcuuuccagcgucucuuccuucgaacgcuuugagaucuuccccaagacaagcucuuggccuaaccacgacuccaauaagggagugaccgcugccuguccccaugcuggcgccaagagcuuuuauaagaaccugaucuggcucguuaaaaagggcaauucuuacccuaaacugucccaaagcuauauuaacgauaaggggaaggaagugcuuguccuguggggaauccaccaccccuccacaaccgcggaccagcagucucucuaccagaaugccgaugcuuacguguucgugggcacgagcagauauuccaaaaaguuuaaaccugagauugccauccggccgaagguccgcgaccaagaggggagaaugaacuacuauuggacacugguugaacccggagauaaaauuaccuucgaggcuacaggcaaccugguggugccucgguacgccuuuaccauggaacgcaaugcggggagcggaaucauuaucucugacacccccguccaugauugcaacacaacgugucagaccccugagggcgccaucaauacaucccuccccuuccagaacauucacccgaucaccauuggcaagugcccuaaauaugugaaaagcacaaagcugagacuugcuaccgggcugcggaauguucccucuauccagagccgcggacucuuuggcgccauugcuggguucaucgaaggaggcuggacggggaugguggacggaugguacggcuaucaucaccaaaacgagcagggcuccggguacgccgccgaccagaaaucuacacagaaugcuaucgauaagauuaccaacaaagucaauagcgugaucgagaagaugaacacccaauuuacagcgguuggaaaagaguucaaucaccuggagaagagaauugaaaaccuuaauaagaaaguggacgauggcuuccuggacaucuggaccuacaacgccgagcuccugguccugcucgaaaaugagcggacacuggauuaucaugacuccaacgugaagaaccuuuacgagaaaguccgcaaucagcugaagaacaaugcuaaagaaauugggaacggauguuuugaguucuaucacaagugcgauaauacguguauggaaagcgugaagaacggcaccuacgacuauccuaaauacucugaggaagccaagcucaauagagagaaaaucgaugggguuaagcuggaguccacacggaucuaucagauucuugcccuguacagcaccguggcuucuucccucguccuggugguuagccugggcgccaucuccuuuuggaugugcucuaacggaagccuccaaugccgcauuuguaucuga

SEQ ID NO: 195070 - RNA, 1701 nt, Artificial Sequence; identical to SEQ ID NO: 194027
  derived and/or modified sequence opt5 from hemagglutinin__InfluenzaA__AHV83934

SEQ ID NO: 195071 - RNA, 1701 nt, Artificial Sequence; identical to SEQ ID NO: 193064
  derived and/or modified sequence opt5 from hemagglutinin__InfluenzaA__AHV83935

SEQ ID NO: 195072 - RNA, 1701 nt, Artificial Sequence; identical to SEQ ID NO: 193064
  derived and/or modified sequence opt5 from hemagglutinin__InfluenzaA__AHV83937

SEQ ID NO: 195073 - RNA, 1701 nt, Artificial Sequence
  derived and/or modified sequence opt5 from hemagglutinin__InfluenzaA__AHV83938
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaaauuucccaaagcuauaucaacgauaaggggaaggaagugcugguccuuuggggcauucaccaccccuccaccacagccgaccagcagucucuguaccagaaugcugaugccuacguguucgugggaaccagcagauauuccaaaaaguuuaaaccugagaucgcuauucggccgaagguccgcgaccaagaggggagaaugaacuacuauuggacgcucguugaacccggagauaaaaucacauucgaggccaccggcaaccugguggugccucgguacgcguuuacaauggaacgcaaugccgggagcggaauuaucaucucugacacccccguccaugauugcaacaccacaugucagacgccugagggcgcuauuaauaccucccugcccuuccagaacauccacccgauuacaaucggcaagugcccuaaauauguuaagagcaccaagcucagacuggccacagggcuucggaaugugcccucuauucagagccgcggacuguuuggcgcuaucgccggguucaucgaaggaggcuggaccgggaugguggacggaugguacggcuaucaucaccaaaacgagcagggcuccggguacgccgcugaccagaaaucuacgcagaaugcgauugauaagaucacaaacaaagucaauagcgugauugagaagaugaacacccaauuuaccgccguuggaaaagaguucaaucaccucgagaagagaaucgaaaaccugaauaagaaaguggacgauggcuuccuugacauuuggacauacaacgcugagcugcucguccugcuggaaaaugagcggacccucgauuaucaugacuccaacgugaagaaccuguacgagaaaguccgcaaucagcuuaagaacaaugccaaagaaaucgggaacggauguuuugaguucuaucacaagugcgauaauacauguauggaaagcgugaagaacggcacguacgacuauccuaaauacucugaggaagccaagcugaauagagagaaaaucgaugggguuaagcucgaguccacccggauuuaucagauccuggcuauuuacagcacaguggccucuucccuuguccuggugguuagccucggcgcgaucuccuuuuggaugugcucuaacggaagccugcaaugccgcauuuguaucuga

SEQ ID NO: 195074 - RNA, 1701 nt, Artificial Sequence; identical to SEQ ID NO: 195073
  derived and/or modified sequence opt5 from hemagglutinin__InfluenzaA__AHV83939

SEQ ID NO: 195075 - RNA, 1701 nt, Artificial Sequence
  derived and/or modified sequence opt5 from hemagglutinin__InfluenzaA__AHV83940
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauauguuaagagcaccaagcugagacuugccacagggcugcggaaugugcccucuauccagagccgcggacucuuuggcgcuauugccggguucaucgaaggaggcuggaccgggaugguggacggaugguacggcuaucaucaccaaaacgagcagggcuccggguacgccgcugaccagaaaucuacgcagaaugcgaucgauaagauuacaaacaaagucaauagcgugaucgagaagaugaacacccaauuuaccgccguuggaaaagaguucaaucaccuggagaagagaauugaaaaccuuaauaagaaaguggacgauggcuucauggacaucuggacauacaacgcugagcugcucguccugcuggaaaaugagcggacccucgauuaucaugacuccaacgugaagaaccuguacgagaaaguccgcaaucagcuuaagaacaaugccaaagaaauugggaacggauguuuugaguucuaucacaagugcgauaauacauguauggaaagcgugaagaacggcacguacgacuauccuaaauacucugaggaagccaagcugaauagagagaaaaucgaucggguuaagcucgaguccacccgcaucuaucagauucuggcuaucuacagcacaguggccucuucccuuguccuggugguuagccucggggcgauuuccuuuuggaugugcucuaacggcagccugcaaugcagaaucuguauuuga

SEQ ID NO: 195076 - RNA, 1701 nt, Artificial Sequence; identical to SEQ ID NO: 193064
  derived and/or modified sequence opt5 from hemagglutinin__InfluenzaA__AHV83941

SEQ ID NO: 195077 - RNA, 1701 nt, Artificial Sequence
  derived and/or modified sequence opt5 from hemagglutinin__InfluenzaA__AHV83943
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauauguuaagagcaccaagcugagacuugccacagggcugcggaaugugcccucuauccagagccgcggacucuuuggcgcuauugccggguucaucgaaggaggcuggaccgggaugguggacggaugguacggcuaucaucaccaaaacgagcagggcuccggguacgccgcugaccugaaaucuacgcagaaugcgaucgauaagauuacaaacaaagucaauagcgugaucgagaagaugaacacccaguuuaccgccguuggaaaagaguucaaucaccuugagaagagaauugaaaaccugaauaagaaaguggacgauggcuuccucgacaucuggacauacaacgcugagcugcugguccuccuggaaaaugagcggacccuugauuaucaugacuccaacgugaagaaccuguacgagaaaguccgcaaucaacucaagaacaaugccaaagaaauugggaacggauguuuugaguucuaucacaagugcgauaauauguguauggaaagcgugaagaacggcacauacgacuauccuaaauacucugaggaagccaagcugaauagagagaaaaucgaugggguuaaacuugaguccacgcggaucuaucagauucuggcuaucuacagcaccguggccucuucccucguccuggugguuagccugggcgcgauuuccuuuuggaugugcucuaacggaagccuccagugccgcaucuguauuuga

SEQ ID NO: 195078 - RNA, 1701 nt, Artificial Sequence
  derived and/or modified sequence opt5 from hemagglutinin__InfluenzaA__AHV83944
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagaugagcacaaugggaaacuuuguaaacugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauuaauuacgaggagcugcgggaacagcuuuccagcgucucuuccuucgagcgcuuugaaaucuuccccaaaaccagcucuuggccuaaccacgacuccaauaagggagugacagccgcuuguccccaugccggcgccaagagcuuuuauaaaaaccugaucuggcucguuaagaaaggcaauucuuacccuaagcugucccaaagcuauauuaacgauaaagggaaggaggugcuuguccuguggggaauccaccaccccuccaccacagccgaccagcagucucucuaccagaaugcugaugccuacguguucgugggcaccagcagauauuccaagaaauuuaagccugagauugcuauccggccgaaaguccgcgaccaagaagggagaaugaacuacuauuggacgcugguugagcccggagauaagauuacauucgaagccaccggcaaccugguggugccucgguacgcguuuacaauggagcgcaaugccgggagcggaaucauuaucucugacacccccguccaugauugcaacaccacaugucagacgccugaaggcgcuaucaauaccucccuccccuuccagaacauucacccgaucacaauuggcaaaugcccuaaguaugugaaaagcaccaagcugagacuugccacagggcugcggaauguucccucuauccagagccgcggacucuuuggcgcuauugccggguucaucgagggaggcuggaccgggaugguggacggaugguacggcuaucaucaccaaaacgagcagggcuccggguacgccgcugaccugaagucuacgcagaaugcgaucgauaaaauuacaaacaaggucaauagcgugaucgaaaagaugaacacccaguuuaccgccguuggaaaggaguucaaucaccuugagaaaagaauugaaaaccugaauaagaagguggacgauggcuuccucgacaucuggacauacaacgcugaacugcugguccuccuggagaaugagcggacccuugauuaucaugacuccaacgugaaaaaccuguacgaaaagguccgcaaucaacucaaaaacaaugccaaggagauugggaacggauguuuugaguucuaucacaaaugcgauaauacauguauggaaagcgugaagaacggcacguacgacuauccuaaguacucugaagaggccaaacugaauagagagaagaucgaugggguuaaacuugaauccacccggaucuaucagauucuggcuaucuacagcacaguggccucuucccucguccuggugguuagccugggcgcgauuuccuuuuggaugugcucuaacggaagccuccagugccgcaucuguauuuga

SEQ ID NO: 195079 - RNA, 1701 nt, Artificial Sequence
  derived and/or modified sequence opt5 from hemagglutinin__InfluenzaA__AHV83945
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacaaccgaccagcagucucucuaccagaaugccgaugcuuacguguucgugggcacgagcagauauuccaaaaaguuuaaaccugagauugccauccggccgaagguccgcgaccaagaggggagaaugaacuacuauuggacacugguugaacccggagauaaaauuaccuucgaggcuacaggcaaccugguggugccucgguacgccuuuaccauggaacgcaaugcggggagcggaaucauuaucucugacacccccguccaugauugcaacacaacgugucagaccccugagggcgccaucaauacaucccuccccuuccagaacauucacccgaucaccauuggcaagugcccuaaauauguuaagagcacaaagcugagacuugcuaccgggcugcggaaugugcccucuauccagagccgcggacucuuuggcgccauugcuggguucaucgaaggaggcuggacggggaugguggacggaugguacggcuaucaucaccaaaacgagcagggcuccggguacgccgccgaccugaaaucuacacagaaugcuaucgauaagauuaccaacaaagucaauagcgugaucgagaagaugaacacccaguuuacagcgguuggaaaagaguucaaucaccuugagaagagaauugaaaaccugaauaagaaaguggacgauggcuuccucgacaucuggaccuacaacgccgagcugcugguccuccuggaaaaugagcggacacuugauuaucaugacuccaacgugaagaaccuguacgagaaaguccgcaaucaacucaagaacaaugcuaaagaaauugggaacggauguuuugaguucuaucacaagugcgauaauacguguauggaaagcgugaagaacggcaccuacgacuauccuaaauacucugaggaagccaagcugaauagagagaaaaucgaugggguuaaacuugaguccacacggaucuaucagauucuggccaucuacagcaccguggcuucuucccucguccuggugguuagccugggcgccauuuccuuuuggaugugcucuaacggaagccuccagugccgcaucuguauuuga

SEQ ID NO: 195080 - RNA, 1701 nt, Artificial Sequence
  derived and/or modified sequence opt5 from hemagglutinin__InfluenzaA__AHV83947
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacagucaagcgcaaugccgggagcggaaucauuaucucugacacccccgugcaugauugcaacaccacaugucagacgccugaaggcgcuaucaauaccucccuccccuuccagaacauucacccgaucacaauuggcaaaugcccuaaguauguuaagagcaccaaacugagacuugccacagggcugcggaaugugcccucuauccagagccgcggacucuuuggcgcuauugccggguucaucgagggaggcuggaccgggauggucgacggaugguacggcuaucaucaccaaaacgaacagggcuccggguacgccgcugaccagaagucuacgcagaaugcgaucgauaaaauuacaaacaaggugaauagcguuaucgagaaaaugaacacccaauuuaccgccgugggaaaggaguucaaucaccuggaaaagagaauugagaaccuuaauaaaaaggucgacgauggcuuccuggacaucuggacauacaacgcugaacuccuggugcugcucgagaaugaacggacccuggauuaucaugacuccaacgucaaaaaccuuuacgagaaggugcgcaaucagcugaaaaacaaugccaaggagauugggaacggauguuuugaguucuaucacaagugcgauaauacauguauggagagcguuaaaaacggcacguacgacuauccuaaguacucugaagaggccaaacucaauagagaaaagaucgauggggugaaacuggaguccacccggaucuaucagauucuugcuaucuacagcacagucgccucuucccuggugcucguugugagccugggcgcgauuuccuuuuggaugugcucuaacggaagccugcaaugccgcaucuguauuuga

SEQ ID NO: 195081 - RNA, 1701 nt, Artificial Sequence; identical to SEQ ID NO: 193064
  derived and/or modified sequence opt5 from hemagglutinin__InfluenzaA__AHV83948

SEQ ID NO: 195082 - RNA, 1701 nt, Artificial Sequence; identical to SEQ ID NO: 193064
  derived and/or modified sequence opt5 from hemagglutinin__InfluenzaA__AHV83949

SEQ ID NO: 195083 - RNA, 1701 nt, Artificial Sequence; identical to SEQ ID NO: 193064
  derived and/or modified sequence opt5 from hemagglutinin__InfluenzaA__AHV83950

SEQ ID NO: 195084 - RNA, 1701 nt, Artificial Sequence
  derived and/or modified sequence opt5 from hemagglutinin__InfluenzaA__AHV83953
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugauggauggaugguauggcuucagacaccagaacagcgagggccgggggcaggccgcugaccugaaauccacccaagccgccauugaucagaucaauggaaagcucaacagacugauuggcaaaacaaaugaaaaguuccaccagaucgagaaggaauuuagcgagguugaagggcgcauucaggaccuugagaaauacguggaggauaccaagaucgaccuguggucuuauaacgcugaacuccugguggcgcuggagaaccaacauacaaucgaucucaccgacuccgaaaugaauaaacuguucgagaagacgaaaaagcagcuucgggaaaacgccgaggaucugggaaauggcugcuuuaagauuuaccacaaaugugacaacgcuugcaucgggagcauuagaaauggcacauaugaucaugacgucuaccgcgacgaggcccucaacaaucgguuccagaucaagggaguggaacugaaaucuggcuacaaggauuggauucuuuggaucuccuuugccaucagcugcuuccugcucuguguugcucugcugggguuuauuaugugggccugccagaaaggaaacaucagauguaauauuugcaucuga

SEQ ID NO: 195085 - RNA, 1701 nt, Artificial Sequence; identical to SEQ ID NO: 194916
  derived and/or modified sequence opt5 from hemagglutinin__InfluenzaA__AHV83954

SEQ ID NO: 195086 - RNA, 1701 nt, Artificial Sequence
  derived and/or modified sequence opt5 from hemagglutinin__InfluenzaA__AHV83956
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagaauuucaacugggcuggagugacgcaaaauggcaccagcucugccugcauuagaggcuccaacagcagcuuuuucucccggcugaauuggcucacacaucugaacuuuaaguauccugcgcuuaacgucaccaugcccaauaacgagcaguucgacaagcuguacaucuggggagugcaccauccugggacagauaaagaccagauuuuucucuaugcccagagcucuggccgcaucaccguuuccacgaagagaagccaacaggcugugauuccgaauaucgggucccggccccgcaucagaaacauuccuucucggaucagcauuuacuggacaaucgucaaacccggagauauucugcugaucaauuccaccggcaaccucaucgccccucgcggguacuucaagauuagaagcggaaaaucuuccaucaugcggagcgacgcucccauuggcaaguguaagucugaaugcaucacaccgaauggcagcauuccuaacgacaaacccuuucagaaugugaaccgcaucaccuauggggccuguccuagauacgugaagcaguccacccugaaacuugcgacaggaaugcggaauguccaagagaagcagacgcgcggcaucuucggggccauugcuggauuuaucgaaaacggcugggaggggaugaaagauggaugguauggcuucagacaccaaaauucugagggccgggggcaggccgcugaccugaagucuacccaggccgccauugaucagaucaacggaaaacucaauagacugauuggcaagacaaacgaaaaguuccaccagaucgagaaagaauuuuccgagguugaagggcgcauucaagaccuugagaaguacguggaggauaccaaaaucgaccuguggagcuauaacgcugaacuccugguggcgcuggagaaucagcauacaaucgaucucaccgacucugaaaugaacaagcuguucgagaaaacgaagaagcagcuucgggaaaaugccgaggauaugggaaacggcugcuuuaaaauuuaccacaagugugacaaugcuugcaucggguccauuagaaacggcacauaugaucaugacgucuaccgcgacgaggcccugaauaaccgguuccagaucaaaggaguggaacucaagagcggcuacaaagauuggauucuguggaucucuuuugccaucuccugcuuccuucuguguguugcucuccugggguuuauuaugugggccugccaaaagggaaauaucagauguaacauuugcaucuga

SEQ ID NO: 195087 - RNA, 1701 nt, Artificial Sequence
  derived and/or modified sequence opt5 from hemagglutinin__InfluenzaA__AHZ13523
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuugucgaacgcagcaaagccuucuccaauuguuauccuuacgacgugcccgauuaugcuucucucagaagccugguugccuccagcgggacgcuugaguuuauuaacgaaggauucaauuggaccggcgugacacagucuggcggguccuacgcuugcaagcggggaagcgucaacuccuuuuucucucgccugaauuggcucuauaagagcgagucuaaauacccugugcugaacguuaccaugcccaauaacggcaaguuugacaaacuuuauaucuggggagugcaccauccuuccacagauaaggagcaaaccaaucuguacgucagagccagcgggcgggugacgguguccacaaaacgcucucagcagaccgucauuccgaacaucggcagcagacccuggguucgggggcucuccagccgcauuucuaucuacuggacaauugugaagccuggagacauccugcugaucaacuccaccggcaaucucauugcgcccagaggcuauuucaagauccggaccgggaaaagcucuauuaugcgcagcgaugccccuaucggaacauguuccuacgaaugcauuacgcccaacggcucuaucccgaaugacaagccuuuucagaacgugaauaaaaucaccuauggggcuugucccagauacgucaagcaaaacacacugaaacuugccaccggaaugcggaaugugccugagaagcagacacgcggcauuuucggggcuaucgccggauuuauugaaaacggcugggagggcaugguugacgggugguauggauucagacaccagaauagcgagggcaccgggcaggcggccgaucugaaauccacgcaagcugccaucgaccagauuaacggaaagcucaaucggcugaucgaaaagacaaacgagaaauuccaccagaucgaaaaggaguuuagcgaaguggagggccgcauucaagaucuugagaaauacgucgaagacaccaagaucgaucuguggucuuauaaugcugagcuccugguggcccuggaaaaccagcauaccauugaccucacagauuccgagaugaauaaacuguucgaaaagaccagaaagcagcuucgggagaacgccgaggacauggggaacggcugcuuuaaaaucuaccacaagugugauaaugcuugcauuggaagcaucagaaacggcacauacaaucaugacguuuaucgcgaugaagcgcugaacaaucgguuccagauuaaagggguggagcucaagucuggauacaaagacuggauccuguggaucuccuuugccauuagcugcuuccuucugugugucgugcuccugggcuuuaucaugugggcuugccaaaaggggaacauuagauguaauaucugcauuuga

SEQ ID NO: 195088 - RNA, 1698 nt, Artificial Sequence; identical to SEQ ID NO: 186640
  derived and/or modified sequence opt5 from hemagglutinin__InfluenzaA__AHZ13582

SEQ ID NO: 195089 - RNA, 1701 nt, Artificial Sequence
  derived and/or modified sequence opt5 from hemagglutinin__InfluenzaA__AHZ35584
augaagaccaucauugcccugagcuacauccucugccugauuuucgcucaggagauccccggcaacgacaauuccacagccacgcuuugucuggggcaccaugcggugccuaacggaaccauugucaaaacaaucaccaaugaucaaaucgaaguuacaaacgcuaccgagcucgugcagucuagcuccacaggcgaaauuugcaauucuccgcaccagauccuggacggggagaacuguacccuuauugaugcccugcucggagacccccagugcgaugacuuucaaaauaagaaaugggaucuguucguggaaagaagcaaggcccauuccaacuguuauccuuacgacguccccgauuaugcuucucugcggagccucguggccuccagcggcacgcuggaguuuaauaacgagucuuucaauuggaccgggguuacacagaacggaaccuccagcgcuugcauccgcagaucuaauaacuccuuuuucagccggcuuaauuggcugacacaccucaacuuuaaauacccugcccugaacgugaccaugcccaauaacgaacaguucgacaaacuuuauauuuggggcguccaucacccuggcacggauaaggaccagaucuuucuguacgcgcaagccucugggcgcauuacaguguccaccaagagaagccagcaggcuguuaucccgaauaucggaucccggccccgcgugagaaacauuccuucucgggucagcaucuauuggacaauugugaagcccggcgauauccuccugauuaauuccaccgggaaccugaucgccccucgcggauacuucaaaaucagaagcggcaagucuuccauuaugcggagcgacgcucccaucgggaaauguaauucugccugcauuaccccgaacggaagcaucccuaaugacaagcccuuucagaacgugaaucgcauuacauacggcgcguguccuagauaugucaagcaaaacacgcucaaacuggccaccggcaugcggaauguucccgagaagcagacacgcgggaucuucggagcuaucgccggcuuuauugaaaacgggugggagggaaugguggauggcugguacggguucagacaccaaaauuccgagggacggggccaggcugccgaccuuaaaucuacccaggccgcuaucgaucagauuaacggcaagcugaacagacucaucgggaaaacaaaugaaaaguuccaucagauugagaaagaauuuagcgagguggaaggacgcauccaagaccuggagaaguaugucgaggauaccaagauugaccuuugguccuacaacgcggaacugcucguggcccuggagaaucagcacacgaucgaucugacagacagcgaaaugaacaaacucuucgagaagaccaaaaagcagcugcgggaaaaugcugaggauaugggcaacgggugcuuuaaaaucuaucauaagugugacaaugccugcauuggaucuaucagaaacggcaccuacgaucacgacguuuaucgcgacgaggcccuuaauaaccgguuccagauuaaggggguggaacugaaauccggcuacaaggauuggauccucuggauuagcuuugcuaucucuugcuuccugcuuugugucgcccugcucggauuuaucaugugggcgugccaaaaaggcaauauuagauguaacaucugcauuuga

SEQ ID NO: 195090 - RNA, 1701 nt, Artificial Sequence
  derived and/or modified sequence opt5 from hemagglutinin__InfluenzaA__AHZ35608
augaagaccaucauugcccugagcuacauccucugccugauuuucgcucaggagauccccggcaacgacaauuccacagccacgcuuugucuggggcaccaugcggugccuaacggaaccauugucaaaacaaucaccaaugaucaaaucgaaguuacaaacgcuaccgagcucgugcagucuagcuccacaggcgaaauuugcaauucuccgcaccagauccuggacggggagaacuguacccuuauugaugcccugcucggagacccccagugcgaugacuuucaaaauaaggaaugggaucuguucguggagagaagcaaagcccauuccaacuguuauccuuacgacguccccgauuaugcuucucugcggagccucguggccuccagcggcacgcuggaguuuaauaacgaaucuuucaauuggaccgggguuacacagaacggaaccuccagcgcuugcauccgcagaucuaauaacuccuuuuucagccggcuuaauuggcugacacaccucaacuuuaaguacccugcccugaacgugaccaugcccaauaacgagcaguucgacaaacuuuauauuuggggcguccaucacccuggcacggauaaggaccagaucuuucuguacgcgcaagccucugggcgcauuacaguguccaccaagagaagccagcaggcuguuaucccgaauaucggaucccggccccgcgugagaaacauuccuucucgggucagcaucuauuggacaauugugaaacccggcgauauccuccugauuaauuccaccgggaaccugaucgccccucgcggauacuucaagaucagaagcggcaaaucuuccauuaugcggagcgacgcucccaucgggaaguguaauucugccugcauuaccccgaacggaagcaucccuaaugacaaacccuuucagaacgugaaucgcauuacauacggcacguguccuagauaugucaagcaaaacacccucaagcuggcgacaggcaugcggaauguucccgaaaaacagacccgcgggaucuucggagccaucgcuggcuuuauugagaacgggugggagggaaugguggauggcugguacggguucagacaccaaaauuccgaaggacggggccaggccgcugaccuuaagucuacacaggccgccaucgaucagauuaacggcaaacugaacagacucaucgggaagaccaaugagaaauuccaucagauugaaaaggaguuuagcgaaguggagggacgcauccaagaccuggagaaauaugucgaagauacgaagauugaccuuugguccuacaacgcugagcugcucguggcgcuggaaaaucagcacacaaucgaucugaccgacagcgagaugaacaaacucuucgaaaagaccaagaaacagcugcgggagaaugccgaggauaugggcaacgggugcuuuaagaucuaucauaaaugugacaaugcuugcauuggaucuaucagaaacggcacauacgaucacgacguuuaucgcgacgaagcccuuaauaaccgguuccagauuaaggggguggagcugaaguccggcuacaaagauuggauccucuggauuagcuuugccaucucuugcuuccugcuuugugucgcucugcucggauuuaucaugugggccugccaaaagggcaauauuagauguaacaucugcauuuga

SEQ ID NO: 195091 - RNA, 1701 nt, Artificial Sequence; identical to SEQ ID NO: 195089
  derived and/or modified sequence opt5 from hemagglutinin__InfluenzaA__AHZ35620

SEQ ID NO: 195092 - RNA, 1701 nt, Artificial Sequence; identical to SEQ ID NO: 195089
  derived and/or modified sequence opt5 from hemagglutinin__InfluenzaA__AHZ35632

SEQ ID NO: 195093 - RNA, 1701 nt, Artificial Sequence; identical to SEQ ID NO: 195089
  derived and/or modified sequence opt5 from hemagglutinin__InfluenzaA__AHZ35644

SEQ ID NO: 195094 - RNA, 1701 nt, Artificial Sequence; identical to SEQ ID NO: 195089
  derived and/or modified sequence opt5 from hemagglutinin__InfluenzaA__AHZ35656

SEQ ID NO: 195095 - RNA, 1701 nt, Artificial Sequence; identical to SEQ ID NO: 195089
  derived and/or modified sequence opt5 from hemagglutinin__InfluenzaA__AHZ35668

SEQ ID NO: 195096 - RNA, 1701 nt, Artificial Sequence; identical to SEQ ID NO: 195090
  derived and/or modified sequence opt5 from hemagglutinin__InfluenzaA__AHZ35680

SEQ ID NO: 195097 - RNA, 1701 nt, Artificial Sequence; identical to SEQ ID NO: 195089
  derived and/or modified sequence opt5 from hemagglutinin__InfluenzaA__AHZ35692

SEQ ID NO: 195098 - RNA, 1701 nt, Artificial Sequence; identical to SEQ ID NO: 195089
  derived and/or modified sequence opt5 from hemagglutinin__InfluenzaA__AHZ35716

SEQ ID NO: 195099 - RNA, 1701 nt, Artificial Sequence; identical to SEQ ID NO: 195090
  derived and/or modified sequence opt5 from hemagglutinin__InfluenzaA__AHZ35728

SEQ ID NO: 195100 - RNA, 1701 nt, Artificial Sequence; identical to SEQ ID NO: 195089
  derived and/or modified sequence opt5 from hemagglutinin__InfluenzaA__AHZ35740

SEQ ID NO: 195101 - RNA, 1701 nt, Artificial Sequence; identical to SEQ ID NO: 195089
  derived and/or modified sequence opt5 from hemagglutinin__InfluenzaA__AHZ35752

SEQ ID NO: 195102 - RNA, 1701 nt, Artificial Sequence; identical to SEQ ID NO: 195089
  derived and/or modified sequence opt5 from hemagglutinin__InfluenzaA__AHZ35764

SEQ ID NO: 195103 - RNA, 1701 nt, Artificial Sequence; identical to SEQ ID NO: 195089
  derived and/or modified sequence opt5 from hemagglutinin__InfluenzaA__AHZ35776

SEQ ID NO: 195104 - RNA, 1701 nt, Artificial Sequence
  derived and/or modified sequence opt5 from hemagglutinin__InfluenzaA__AHZ35823
augaaggccauccuggugguccuccuguacaccuucgcuauugccaacgcggacacacuuugcaucggcuaucacgcuaauaacagcacggauaccguugacacagugcuggagaaaaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacauccucuagcgacaacgggaccugcuauccgggcgauuuuaucaauuacgaagaacugcgggagcagcuuuccagcgucucuuccuucgaacgcuuugagauguuccccaagacgagcucuuggccuaaccacgacuccaauaagggagugaccgccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccacaaccgccgaccaacagucucucuaccagaaugcugaugccuacguguucgugggcacaagcagauauuccaagaaauuuaagccugagauugcuauccggccgaaaguccgcgaccaggaggggagaaugaacuacuauuggacccugguugaacccggagauaagauuacguucgaggccacaggcaaccugguggugccucgguacgcguuugccauggaacgcaaugcugggagcggaaucauuaucucugacacccccguccaugauugcaacacaaccugucaaaccccuaaaggcgccaucaauacaucccuccccuuccagaacauucacccgaucacgauuggcaagugcccuaaguaugugaaaagcaccaagcugagacuugcuacagggcugcggaauguucccucuauccagagccgcggacucuuuggcgccauugccggguucaucgagggaggcuggaccgggaugguggacggaugguacggcuaucaucaccagaacgaacaaggcuccggguacgcugcggaccugaaaucuacacagaaugccaucgauaagauuaccaacaaagucaauagcgugaucgagaagaugaacacgcaguuuacagcuguuggaaaggaguucaaucaccuugagaaaagaauugagaaccugaauaagaaaguggacgauggcuuccucgacaucuggaccuacaacgccgaacugcugguccuccuggagaaugaacggacccuugauuaucaugacuccaacgugaagaaccuguacgagaaaguccgcaaucagcucaagaacaaugccaaggagauugggaacggauguuuugaguucuaucacaaaugcgauaauacauguauggaaagcgugaagaacggcaccuacgacuauccuaaauacucugaagaggcuaagcugaauagagaagagaucgaugggguuaaacuugaguccacacggaucuaucaaauucuggccaucuacagcacgguggcgucuucccucguccuggugguuagccugggcgcuauuuccuuuuggaugugcucuaacggaagccuccagugccgcaucuguauuuga

SEQ ID NO: 195105 - RNA, 1701 nt, Artificial Sequence; identical to SEQ ID NO: 195104
  derived and/or modified sequence opt5 from hemagglutinin__InfluenzaA__AHZ35834

SEQ ID NO: 195106 - RNA, 1701 nt, Artificial Sequence; identical to SEQ ID NO: 195104
  derived and/or modified sequence opt5 from hemagglutinin__InfluenzaA__AHZ35845

SEQ ID NO: 195107 - RNA, 1701 nt, Artificial Sequence; identical to SEQ ID NO: 195104
  derived and/or modified sequence opt5 from hemagglutinin__InfluenzaA__AHZ35856

SEQ ID NO: 195108 - RNA, 1701 nt, Artificial Sequence
  derived and/or modified sequence opt5 from hemagglutinin__InfluenzaA__AHZ35867
augaagaccaacaucgcccugagcuacauucucugccugguguccgcucagaaacuucccggcaaugacaacucuacagccacgcugugucucgggcaccaugcggucccuaauggaaccaucguuaagacaauuaccaacgaucaaaucgaggugacaaaugcuaccgaacuggugcagagcuccucuacaggcgagauuugcaacagcccgcaccagauccuugacggggaaaauuguacccugaucgaugcccuccugggagacccccagugcgauggcuuccaaaacaaaaagugggaccuguuugucgagagauccaaagcccauucuaauuguuauccuuacgaugugcccgacuaugcuagccuccggucccugguugccagcucugggacgcuugaguucaacaaugaauccuuuaacuggaccggagugacacagaauggcaccagcucugcuugcauucgcagauccaacaauagcuucuuuucucggcugaacuggcucacacaccugaacuucaaguacccugcccuuaaugucaccaugcccaacaaugagcaguuugauaagcuguauaucuggggcgugcaucacccugggacggacaaagaucagauuuuccucuacgcgcaagccgcuggacgcaucacaguuuccaccaagagaagccagcaggccgugauuccgaacaucggcucccggccccgcgucagaaauauuccuucucgggugagcaucuauuggacaaucgugaaacccggggacauucugcugaucaacuccaccggaaaucucauugcuccucgcggcuacuuuaagaucagaagcgggaaaucuuccauuaugcggagcgaugcccccaucggaaaguguaacucugcgugcaucaccccgaauggcagcauuccuaacgacaagcccuuccagaaugucaaccgcaucacauacggcgccuguccuagauauguuaaacaaaauacgcugaaacuugcuaccgggaugcggaacgugcccgaaaaacagacacgcggaauuuuuggcgccaucgcuggguucauugagaauggaugggaaggcaugguggacgggugguacggauuuagacaccagaacuccgagggccggggccaagccgccgaucugaagucuacccaggcugcgaucgaccagaucaacgggaaacucaauagacugauuggaaagacaaacgagaaauuccaucagaucgaaaaggaguucagcgaagucgagggccgcauucaagaucuugaaaaguauguggaggacaccaaaaucgaucugugguccuacaaugccgagcuccugguugugcuggaaaaccagcacacgauugaccucacagauagcgagaugaauaagcuguuugaaaagaccaagaaacagcuucgggagaacgcugaagacauggggaauggaugcuucaagaucuaucauaagugugauaacgccugcauuggcucuaucagaaaugggaccuacgaccacgaugucuaucgcgacgaggcccugaacaaucgguuucagaucaaaggcguggagcucaaguccggauacaaagacuggauucuguggaucagcuucgcuauuucuugcuuucuucuguguguugcccuccugggcuucaucaugugggcgugccaaaaggggaacauuagauguaauaucugcaucuga

SEQ ID NO: 195109 - RNA, 1701 nt, Artificial Sequence
  derived and/or modified sequence opt5 from hemagglutinin__InfluenzaA__AHZ35879
augaagaccaacaucgcccugagcuacauucucugccugguguccgcucagaaacuucccggcaaugacaacucuacagccacgcugugucucgggcaccaugcggucccuaauggaaccaucguuaagacaauuaccaacgaucaaaucgaggugacaaaugcuaccgaacuggugcagagcuccucuacaggcgagauuugcaacagcccgcaccagauccuugacggggaaaauuguacccugaucgaugcccuccugggagacccccagugcgauggcuuccaaaacaaaaagugggaccuguuugucgagagauccaaagcccauucuaauuguuauccuuacgaugugcccgacuaugcuagccuccggucccugguugccagcucugggacgcuugaguucaacaaugaauccuuuaacuggaccggagugacacagaauggcaccagcucugcuugcauucgcagauccaacaauagcuucuuuucucggcugaacuggcucacacaccugaacuucaaguacccugcccuuaaugucaccaugcccaacaaugagcaguuugauaagcuguauaucuggggcgugcaucacccugggacggacaaagaucagauuuuccucuacgcgcaagccgcuggacgcaucacaguuuccaccaagagaagccagcaggccgugauuccgaacaucggcucccggccccgcgucagaaauauuccuucucgggugagcaucuauuggacaaucgugaaacccggggacauucugcugaucaacuccaccggaaaucucauugcuccucgcggcuacuuuaagaucagaagcgggaaaucuuccauuaugcggagcgaugcccccaucggaaaguguaacucugcgugcaucaccccgaauggcagcauuccuaacgacaagcccuuccagaaugucaaccgcaucacauacggcgccuguccuagauauguuaaacaaaauacgcugaaacuugcuaccgggaugcggaacgugcccgaaaaacagacacgcggaauuuuuggcgccaucgcuggguucauugagaauggaugggaaggcaugguggacgggugguacggauuuagacaccagaacuccgagggccggggccaagccgccgaucugaagucuacccaggcugcgaucgaccagaucaacgggaaacucaauagacugauuggaaagacaaacgagaaauuccaucagaucgaaaaggaguucagcgaagucgagggccgcauucaagaucuugaaaaguauguggaggacaccaaaaucgaucugugguccuacaaugccgagcuccugguugcucuggaaaaccagcacacgauugaccucacagauagcgagaugaauaagcuguuugaaaagaccaagaaacagcuucgggagaacgccgaagacauggggaauggaugcuucaagaucuaucauaagugugauaacgccugcauuggcucuaucagaaaugggaccuacgaccacgauguguaucgcgacgaggcucugaacaaucgguuucagaucaaaggcgucgagcucaaguccggauacaaagacuggauucuguggaucagcuucgccauuucuugcuuucuucuguguguggcgcuccugggcuucaucaugugggcuugccaaaaggggaacauuagauguaauaucugcaucuga

SEQ ID NO: 195110 - RNA, 1701 nt, Artificial Sequence; identical to SEQ ID NO: 195104
  derived and/or modified sequence opt5 from hemagglutinin__InfluenzaA__AHZ35891

SEQ ID NO: 195111 - RNA, 1701 nt, Artificial Sequence; identical to SEQ ID NO: 195104
  derived and/or modified sequence opt5 from hemagglutinin__InfluenzaA__AHZ35902

SEQ ID NO: 195112 - RNA, 1710 nt, Artificial Sequence
  derived and/or modified sequence opt5 from hemagglutinin__InfluenzaA__AHZ35913
augaaggccauccuggugguccuccuguacaccuucgcuauugccaacgcggacacacuuugcaucggcuaucacgcuaauaacagcacggauaccguugacacagugcuggagaaaaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacauccucuagcgacaacgggaccugcuauccgggcgauuuuaucaauuacgaagaacugcgggagcagcuuuccagcgucucuuccuucgaacgcuuugagauguuccccaagacgagcucuuggccuaaccacgacuccaauaagggagugaccgccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccacaaccgccgaccaacagucucucuaccagaaugcugaugccuacguguucgugggcacaagcagauauuccaagaaauuuaagccugagauugcuauccggccgaaaguccgcgaccaggaggggagaaugaacuacuauuggacccugguugaacccggagauaagauuacguucgaggccacaggcaaccugguggugccucgguacgcguuugccauggaacgcaaugcugggagcggaaucauuaucucugacacccccguccaugauugcaacacaaccugucaaaccccuaaaggcgccaucaauacaucccucacgagccugcccuuccagaacauucacccgaucaccauuggcaagugcccuaaguaugugaaaucuacaaaacuuagacuggcuaccgggcuccggaauguucccagcauccagucccgcggacuguuuggcgccauugccggguucaucgagggaggcuggacagggaugguggacggaugguacggcuaucaucaccagaacgaacaaggcucuggguacgcugcggaccuuaaaagcacccagaaugccaucgauaagauuacgaacaaagucaauuccgugaucgagaagaugaacacacaguuuaccgcuguuggaaaggaguucaaucaccuggaaaagagaauugagaaccucaauaagaaaguggacgauggcuuccuggacaucuggaccuacaacgccgaacugcucguccugcuugagaaugaacggacacuggauuaucaugacagcaacgugaagaaccucuacgagcgcgucagaaaucagcugaaaaacaaugccaaggagauugggaacggauguuuugaguucuaucacaagugcgauaauaccuguauggagucugugaaaaacggcacauacgacuauccuaaguacuccgaagaggcuaaacuuaaucgggaagagaucgaugggguuaagcuggagagcacgcgcaucuaucaaauucucgccaucuacucuaccguggcguccagccugguccuggugguuucccucggcgcuauuucuuuuuggaugugcagcaacggaucccugcagugcagaaucuguauuuga

SEQ ID NO: 195113 - RNA, 1701 nt, Artificial Sequence
  derived and/or modified sequence opt5 from hemagglutinin__InfluenzaA__AHZ35924
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaggaacugcgggagcagcuuuccagcgucucuuccuucgaacgcuuugagaucuuccccaagaccagcucuuggccuaaccacgacuccaauaagggagugacagccgcuuguccccaagccggcgcgaaaucuuuuuauaagaaccugaucuggcucguuaaaaagggcaauagcuacccuaaacuguccaagagcuauauuaacgauaaggggaaagaagugcuuguccuguggggaauccaucaccccuccaccucugccgaccagcagagccucuaccagaaugcugaugccuacguguucgugggcacauccaaguauagcaaaaaguuuaaaccugagauugcugucagaccgaagguucgggaccaagaggggcgcaugaacuacuauuggacccugguggaacccggagauaaaaucacguucgaggccacaggcaaccugcucgugccuagauacgcguuugccauggaacggaaugcugggucuggaauuaucauuuccgacacccccguccacgauugcaacacaaccugucagaccccuaagggcgccaucaauacaagccugcccuuccagaacauccauccgauuacgaucggcaagugcccuaaauaugugaagucuaccaaacuucgccuggcuacagggcucagaaauguucccagcacccagucccggggacuguuuggcgccauugccggguucaucgagggaggcuggacagggaugguggacggaugguacggcuaucaccaucaaaacgcucagggcucuggguacgcggccgaccuuaagagcacccagaaugcuauugauaaaaucacgaacaaggucaauuccgugaucgaaaagaugaacacacaguuuaccgccguuggaaaagaguucaaucaccuggagaagcgcauugaaaaccucaauaaaaagguggacgauggcuuccuggacaucuggaccuacaacgccgagcugcucguccugcuugaaaaugagagaacacuggauuaucacgacagcaacgugaaaaaccucuacgaaaagguccggucucaacugaagaauaacgcuaaagagauugggaauggauguuuugaguucuaucauaagugcgauaacaccuguauggaauccgugaaaaauggcacauacgacuauccuaaguacagcgaggaagccaaacuuaaccgcgaggaaaucgaugggguuaagcuggagucuacgagaauuuaucagauccucgcgaucuacuccaccguggcuagcucccugguccuggugguuucucucggcgccauuagcuuuuggaugugcuccaauggaucucugcagugccggaucuguauuuga

SEQ ID NO: 195114 - RNA, 1701 nt, Artificial Sequence
  derived and/or modified sequence opt5 from hemagglutinin__InfluenzaA__AHZ35935
augaaggccauccuggugguccuccuguacaccuucgcuauugccaacgcggacacacuuugcaucggcuaucacgcuaauaacagcacggauaccguugacacagugcuggagaaaaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacauccucuagcgacaacgggaccugcuauccgggcgauuuuaucaauuacgaagaacugcgggagcagcuuuccagcgucucuuccuucgaacgcuuugagauguuccccaagacgagcucuuggccuaaccacgacuccaauaagggagugaccgccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccacaaccgccgaccaacagucucucuaccagaaugcugaugccuacguguucgugggcacaagcagauauuccaagaaauuuaagccugagauugcuauccggccgaaaguccgcgaccaggaggggagaaugaacuacuauuggacccugguugaacccggagauaagauuacguucgaggccacaggcaaccugguggugccucgguacgcguuugccauggaacgcaaugcugggagcggaaucauuaucucugacacccccguccaugauugcaacacaaccugucaaaccccuaaaggcgccaucaauacaucccuccccuuccagaacauucacccgaucacgauuggcaagugcccuaaguaugugaaaagcaccaagcugagacuugcuacagggcugcggaauauccccucuauucagagccgcggacucuuuggcgccaucgccggguucaucgagggaggcuggaccgggaugguugacggaugguacggcuaucaucaccagaacgaacaaggcuccggguacgcugcggaccugaaaucuacacagaaugccauugauaagaucaccaacaaagugaauagcgucauugagaagaugaacacgcaguuuacagcugugggaaaggaguucaaucaccuugagaaaagaaucgagaaccugaauaagaaaguugacgauggcuuccucgacauuuggaccuacaacgccgaacugcuggugcuccuggagaaugaacggacccuugauuaucaugacuccaacgucaagaaccuguacgagaaagugcgcaaucagcucaagaacaaugccaaggagaucgggaacggauguuuugaguucuaucacaaaugcgauaauacauguauggaaagcgucaagaacggcaccuacgacuauccuaaauacucugaagaggcuaagcugaauagagaagagaucgauggggugaaacuugaguccacacggauuuaucaaauccuggccauuuacagcacgguugcgucuucccucgugcuggucgugagccugggcgcuaucuccuuuuggaugugcucuaacggaagccuccagugccgcauuuguaucuga

SEQ ID NO: 195115 - RNA, 1701 nt, Artificial Sequence; identical to SEQ ID NO: 195109
  derived and/or modified sequence opt5 from hemagglutinin__InfluenzaA__AHZ35946

SEQ ID NO: 195116 - RNA, 1701 nt, Artificial Sequence; identical to SEQ ID NO: 195104
  derived and/or modified sequence opt5 from hemagglutinin__InfluenzaA__AHZ35958

SEQ ID NO: 195117 - RNA, 1701 nt, Artificial Sequence; identical to SEQ ID NO: 195104
  derived and/or modified sequence opt5 from hemagglutinin__InfluenzaA__AHZ35980

SEQ ID NO: 195118 - RNA, 1701 nt, Artificial Sequence; identical to SEQ ID NO: 195104
  derived and/or modified sequence opt5 from hemagglutinin__InfluenzaA__AHZ35991

SEQ ID NO: 195119 - RNA, 1701 nt, Artificial Sequence; identical to SEQ ID NO: 195104
  derived and/or modified sequence opt5 from hemagglutinin__InfluenzaA__AHZ36002

SEQ ID NO: 195120 - RNA, 1701 nt, Artificial Sequence
  derived and/or modified sequence opt5 from hemagglutinin__InfluenzaA__AHZ36013
augaaggccauccuggugguccuccuguacaccuucgcuauugccaacgcggacacacuuugcaucggcuaucacgcuaauaacagcacggauaccguugacacagugcuggagaaaaaugugaccgucacacauuccgugaaccuccuggaagauaagcacaauagaaaacuuuguaagcugcgcgggguugcuccccuccaucugggaaaaugcaacauugccggcuggauccuggggaauccugagugugaaucucucagcaccgccuccucuuggagcuacauuguggagacauccucuagcgacaacggaaccugcuauccgggcgauuuuaucaauuacgaggagcugcgggagcagcuuuccagcgucucuuccuucgaaagauuugagauguuccccaagacgagcucuuggccuaaccacgacuccaauaagggggugaccgccgcuuguccccaugccggagcgaaaucuuuuuauaagaaccugaucuggcucguuaaaaagggcaauagcuacccuaaacuguccaagagcuauauuaacgauaagggcaaagaagugcuuguccugugggggauccaccaccccuccacaaccgccgaccaacagucucucuaccagaaugcugaugccuacguguucgugggaacaagccgguauuccaagaaauuuaagccugagauugcuauccgcccgaaagucagagaccaggagggccggaugaacuacuauuggacccugguugaacccggggauaagauuacguucgaggccacaggaaaccugguggugccucgcuacgcguuugccauggaaagaaaugcuggcagcgggaucauuaucucugacacccccguccaugauugcaacacaaccugucaaaccccuaaaggagccaucaauacaucccuccccuuccagaacauucacccgaucacgauuggcaagugcccuaaguaugugaaaagcaccaagcugcggcuugcuacaggccugcgcaauguucccucuauccagagcagagggcucuuuggagccauugccggcuucaucgaagggggauggaccggcaugguggacgggugguacggauaucaucaccagaacgaacaaggcuccggcuacgcugcggaccugaaaucuacacagaaugccaucgauaagauuaccaacaaagucaauagcgugaucgagaagaugaacacgcaguuuacagcuguugggaaggaguucaaucaccuugaaaaacggauugagaaccugaauaagaaaguggacgauggauuccucgacaucuggaccuacaacgccgaacugcugguccuccuggagaaugaacgcacccuugauuaucaugacuccaacgugaagaaccuguacgagaaagucagaaaucagcucaagaacaaugccaaggagauuggcaacggguguuuugaguucuaucacaaaugcgauaauacauguauggaaagcgugaagaacggaaccuacgacuauccuaaauacucugaagaggcuaagcugaaucgggaagagaucgauggcguuaaacuugaguccacacgcaucuaucaaauucuggccaucuacagcacgguggcgucuucccucguccuggugguuagccugggggcuauuuccuuuuggaugugcucuaacggcagccuccagugcagaaucuguauuuga

SEQ ID NO: 195121 - RNA, 1701 nt, Artificial Sequence
  derived and/or modified sequence opt5 from hemagglutinin__InfluenzaA__AHZ36024
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacagccgaccaacagucucucuaccagaaugcugaugccuacguguucgugggcaccagcagauauuccaagaaauuuaagccugagauugcuauccggccgaaaguccgcgaccaggaggggagaaugaacuacuauuggacgcugguugaacccggagauaagauuacauucgaggccaccggcaaccugguggugccucgguacgcguuugccauggaacgcaaugcugggagcggaaucauuaucucugacacacccguccaugauugcaacaccaccugucaaacaccuaaaggcgccaucaauacgucccuccccuuccagaacauucacccgaucaccauuggcaagugcccuaaguaugugaaaagcacaaagcugagacuugcuaccgggcugcggaauguucccucuauccagagccgcggacucuuuggcgccauugccggguucaucgagggaggcuggacagggaugguggacggaugguacggcuaucaucaccagaacgaacaaggcuccggguacgcugcggaccugaaaucuacccagaaugccaucgauaagauuacgaacaaagucaauagcgugaucgagaagaugaacacacaguuuaccgcuguuggaaaggaguucaaucaccuugagaaaagaauugagaaccugaauaagaaaguggacgauggcuuccucgacaucuggaccuacaacgccgaacugcugguccuccuggagaaugaacggacacuugauuaucaugacuccaacgugaagaaccuguacgagaaaguccgcaaucagcucaagaacaaugccaaggagauugggaacggauguuuugaguucuaucacaaaugcgauaauaccuguauggaaagcgugaagaacggcacauacgacuauccuaaauacucugaagaggcuaagcugaauagagaagagaucgaugggguuaaacuugaguccacgcggaccuaucaaauccuggccauuuacagcacaguggcgucuucccucguccuggugguuagccugggcgcuaucuccuuuuggaugugcucuaacggaagccuccagugccgcauuuguaucuga

SEQ ID NO: 195122 - RNA, 1701 nt, Artificial Sequence
  derived and/or modified sequence opt5 from hemagglutinin__InfluenzaA__AHZ36035
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacugauccagucuagcuccacaggcgagaucugcaauucuccgcaccagauucuugacggggaaaacuguacccugaucgaugcccuccugggagacccccagugcgauggcuuucaaaauaaaaagugggaccuguucguggagagaagcaaagcccauuccaacuguuauccuuacgauguccccgacuaugcuucucuccggagccugguggccuccagcgggacgcuugaauuuaauaacgagucuuucaauuggaccggaguuacacagaacggcaccuccagcgcuugcauucgcagaucuaauaacuccuuuuucagccggcugaauuggcucacacaccugaacuuuaaguacccugcccuuaacgugaccaugcccaauaacgagcaguucgauaagcuguauaucuggggcguccaucacccugggacggacaaagaucagauuuuucucuacgcgcaagccgcuggacgcaucacagugucuaccaagagaucccagcaggccguuauuccgaauaucggcagccggccccgcgugagaaacaucccuucccgggucucuauuuauuggacaaucgugaaacccggggacauucugcugaucaauagcaccggaaaccucauugcuccucgcggcuacuucaagaucagauccgggaaaagcucuaucaugcgguccgaugcccccauuggaaaguguaauagcgcgugcaucaccccgaacggcucuauuccuaaugacaagcccuuucagaacgugaaucgcaucacauacggcgccuguccuagauaugucaaacaaaacacgcugaaacuugcuaccgggaugcggaauguucccgaaaaacagacacgcggaauuuucggcgccaucgcuggguuuaucgagaacggaugggaaggcaugguggacgggugguacggauucagacaccagaauagcgagggccggggccaagccgccgaucugaaguccacccaggcugcgauugaccagaucaacgggaaacucaacagacugauuggaaagacaaaugagaaauuccaucagaucgaaaaggaguuuucugaaguggagggccgcauucaagaucuugaaaaguaugucgaggacaccaaaaucgaucuguggagcuacaacgccgagcuccugguggcucuggaaaaucagcacacgauugaccucacagauuccgagaugaacaagcuguucgaaaagaccaagaaacagcuucgggagaaugccgaagacauggggaacggaugcuuuaagaucuaucauaagugugauaaugccugcaucggcagcauuagaaacgggaccuacgaccacgauguuuaucgcgacgaggcucugaauaaccgguuccagaucaaaggcguggagcucaagucuggauacaaagacuggauucuguggaucuccuuugccauuagcugcuuccuucugugugucgcgcuccugggcuuuaucaugugggcuugccaaaaggggaauaucagauguaacauuugcaucuga

SEQ ID NO: 195123 - RNA, 1701 nt, Artificial Sequence; identical to SEQ ID NO: 189879
  derived and/or modified sequence opt5 from hemagglutinin__InfluenzaA__AHZ36047

SEQ ID NO: 195124 - RNA, 1701 nt, Artificial Sequence; identical to SEQ ID NO: 195104
  derived and/or modified sequence opt5 from hemagglutinin__InfluenzaA__AHZ36059

SEQ ID NO: 195125 - RNA, 1701 nt, Artificial Sequence; identical to SEQ ID NO: 195121
  derived and/or modified sequence opt5 from hemagglutinin__InfluenzaA__AHZ36070

SEQ ID NO: 195126 - RNA, 1701 nt, Artificial Sequence; identical to SEQ ID NO: 195120
  derived and/or modified sequence opt5 from hemagglutinin__InfluenzaA__AHZ36081

SEQ ID NO: 195127 - RNA, 1701 nt, Artificial Sequence; identical to SEQ ID NO: 195121
  derived and/or modified sequence opt5 from hemagglutinin__InfluenzaA__AHZ36092

SEQ ID NO: 195128 - RNA, 1701 nt, Artificial Sequence; identical to SEQ ID NO: 195104
  derived and/or modified sequence opt5 from hemagglutinin__InfluenzaA__AHZ36103

SEQ ID NO: 195129 - RNA, 1701 nt, Artificial Sequence; identical to SEQ ID NO: 195121
  derived and/or modified sequence opt5 from hemagglutinin__InfluenzaA__AHZ36114

SEQ ID NO: 195130 - RNA, 1701 nt, Artificial Sequence; identical to SEQ ID NO: 195104
  derived and/or modified sequence opt5 from hemagglutinin__InfluenzaA__AHZ36125

SEQ ID NO: 195131 - RNA, 1701 nt, Artificial Sequence; identical to SEQ ID NO: 195104
  derived and/or modified sequence opt5 from hemagglutinin__InfluenzaA__AHZ36136

SEQ ID NO: 195132 - RNA, 1701 nt, Artificial Sequence; identical to SEQ ID NO: 189879
  derived and/or modified sequence opt5 from hemagglutinin__InfluenzaA__AHZ36147

SEQ ID NO: 195133 - RNA, 1701 nt, Artificial Sequence
  derived and/or modified sequence opt5 from hemagglutinin__InfluenzaA__AHZ36158
augaaggccauccuggugguccuccuguacaccuucgcuauugccaacgcggacacacuuugcaucggcuaucacgcuaauaacagcacggauaccguugacacagugcuggagaaaaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacauccucuagcgacaacgggaccugcuauccgggcgauuuuaucaauuacgaagaacugcgggagcagcuuuccagcgucucuuccuucgaacgcuuugagauguuccccaagacgagcucuuggccuaaccacgacuccaauaagggagugaccgccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccacaaccgccgaccaacagucucucuaccagaaugcugaugccuacguguucgugggcacaagcagauauuccaagaaauuuaagccugagauugcuacccggccgaaaguccgcgaccaggaggggagaaugaacuacuauuggacgcugguugaacccggagauaagaucacauucgaggccaccggcaaccugguggugccucgguacgcguuugccauggaacgcaaugcugggagcggaauuaucauuucugacacacccguccaugauugcaacaccaccugucaaacaccuaaaggcgccaucaauacgucccuccccuuccagaacauccacccgauuaccaucggcaagugcccuaaguaugugaaaagcacaaagcugagacuugcuaccgggcugcggaauguucccucuauucagagccgcggacucuuuggcgccaucgccggguucauugagggaggcuggacagggaugguggacggaugguacggcuaucaucaccagaacgaacaaggcuccggguacgcugcggaccugaaaucuacccagaaugccaucgauaagaucacgaacaaagucaauagcgugauugagaagaugaacacacaguuuaccgcuguuggaaaggaguucaaucaccuugagaaaagaaucgagaaccugaauaagaaaguggacgauggcuuccucgacauuuggaccuacaacgccgaacugcugguccuccuggagaaugaacggacacuugauuaucaugacuccaacgugaagaaccuguacgagaaaguccgcaaucagcucaagaacaaugccaaggagaucgggaacggauguuuugaguucuaucacaaaugcgauaauaccuguauggaaagcgugaagaacggcacauacgacuauccuaaauacucugaagaggcuaagcugaauagagaagagauugaugggguuaaacuugaguccacgcggaucuaucaaauccuggccauuuacagcaccguggcgucuucccucguccuggugguuagccugggcgcuaucuccuuuuggaugugcucuaacggaagccuccagugccgcauuuguaucuga

SEQ ID NO: 195134 - RNA, 1701 nt, Artificial Sequence; identical to SEQ ID NO: 195104
  derived and/or modified sequence opt5 from hemagglutinin__InfluenzaA__AHZ36169

SEQ ID NO: 195135 - RNA, 1701 nt, Artificial Sequence
  derived and/or modified sequence opt5 from hemagglutinin__InfluenzaA__AHZ36180
augaaggccauccuggugguccuccuguacaccuucgcuauugccaacgcggacacacuuugcaucggcuaucacgcuaauaacagcacggauaccguugacacagugcuggagaaaaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacauccucuagcgacaacgggaccugcuauccgggcgauuuuaucaauuacgaagaacugcgggagcagcuuuccagcgucucuuccuucgaacgcuuugagauguuccccaagacgagcucuuggccuaaccacgacuccaauaagggagugaccgccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccacaaccgccgaccaacagucucucuaccagaaugcugaugccuacguguucgugggcacaagcagauauuccaagaaauuuaagccugagauugcuauccggccgaaaguccgcgaccaggaggggagaaugaacuacuauuggacccugguugaacccggagauaagauuacguucgaggccacaggcaaccugguggugccucgguacgcguuugccauggaacgcaaugcugggagcggaaucauuaucucugacacccccauccaugauugcaacacaaccugucaaaccccuaaaggcgccauuaauacaucccuccccuuccagaacauccacccgauuacgaucggcaagugcccuaaguaugucaaaagcaccaagcugagacuugcuacagggcugcggaaugugcccucuauucagagccgcggacucuuuggcgccaucgccggguucaucgagggaggcuggaccgggaugguugacggaugguacggcuaucaucaccagaacgaacaaggcuccggguacgcugcggaccugaaaucuacacagaaugccauugauaagaucaccaacaaagugaauagcgucauugagaagaugaacacgcaguuuacagcugugggaaaggaguucaaucaccuugagaaaagaaucgagaaccugaauaagaaaguugacgauggcuuccucgacauuuggaccuacaacgccgaacugcuggugcuccuggagaaugaacggacccuugauuaucaugacuccaacgucaagaaccuguacgagaaagugcgcaaucagcucaagaacaaugccaaggagaucgggaacggauguuuugaguucuaucacaaaugcgauaauacauguauggaaagcgucaagaacggcaccuacgacuauccuaaauacucugaagaggcuaagcugaauagagaagagaucgauggggugaaacuugaguccacacggauuuaucaaauccuggccauuuacagcacgguugcgucuucccucgugcuggucgugagccugggcgcuaucuccuuuuggaugugcucuaacggaagccuccagugccgcauuuguaucuga

SEQ ID NO: 195136 - RNA, 1701 nt, Artificial Sequence; identical to SEQ ID NO: 195109
  derived and/or modified sequence opt5 from hemagglutinin__InfluenzaA__AHZ36191

SEQ ID NO: 195137 - RNA, 1701 nt, Artificial Sequence; identical to SEQ ID NO: 189879
  derived and/or modified sequence opt5 from hemagglutinin__InfluenzaA__AHZ36203

SEQ ID NO: 195138 - RNA, 1701 nt, Artificial Sequence; identical to SEQ ID NO: 195104
  derived and/or modified sequence opt5 from hemagglutinin__InfluenzaA__AHZ36215

SEQ ID NO: 195139 - RNA, 1701 nt, Artificial Sequence; identical to SEQ ID NO: 189879
  derived and/or modified sequence opt5 from hemagglutinin__InfluenzaA__AHZ36226

SEQ ID NO: 195140 - RNA, 1701 nt, Artificial Sequence; identical to SEQ ID NO: 195104
  derived and/or modified sequence opt5 from hemagglutinin__InfluenzaA__AHZ36238

SEQ ID NO: 195141 - RNA, 1701 nt, Artificial Sequence; identical to SEQ ID NO: 195104
  derived and/or modified sequence opt5 from hemagglutinin__InfluenzaA__AHZ36249

SEQ ID NO: 195142 - RNA, 1701 nt, Artificial Sequence
  derived and/or modified sequence opt5 from hemagglutinin__InfluenzaA__AHZ36260
augaaggccauccuggugguccuccuguacaccuucgcuauugccaacgcggacacacuuugcaucggcuaucacgcuaauaacagcacggauaccguugacacagugcuggagaaaaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacauuuuccucugacaacgggaccugcuauccgggcgauuucaucaauuacgaagaacugcgggagcagcuuagcuccgucagcucuuuugaacgcuucgagauguuucccaagacguccagcuggccuaaccacgacucuaauaagggagugaccgccgcuuguccccaugccggcgcgaaauccuucuauaagaaccugaucuggcucguuaaaaagggcaauagcuacccuaaacugucuaaguccuauauuaacgauaaggggaaagaagugcuuguccuguggggaauccaccaccccagcacaaccgccgaccaacagucccucuaccagaaugcugaugccuacguguuugugggcacaucuagauauagcaagaaauucaagccugagauugcuauccggccgaaaguccgcgaccaggaggggagaaugaacuacuauuggacccugguugaacccggagauaagauuacguuugaggccacaggcaaccugguggugccucgguacgcguucgccauggaacgcaaugcuggguccggaaucauuaucagcgacacccccguccaugauugcaacacaaccugucaaaccccuaaaggcgccaucaauacaucucuccccuuucagaacauucacccgaucacgauuggcaagugcccuaaguaugugaaauccaccaagcugagacuugcuacagggcugcggaauguucccagcauccagucucgcggacucuucggcgccauugccggguuuaucgagggaggcuggaccgggaugguggacggaugguacggcuaucaucaccagaacgaacaaggcagcggguacgcugcggaccugaaauccacacagaaugccaucgauaagauuaccaacaaagucaauucugugaucgagaagaugaacacgcaguucacagcuguuggaaaggaguucaaucaccuugagaaaagaauugagaaccugaauaagaaaguggacgauggcuuucucgacaucuggaccuacaacgccgaacugcugguccuccuggagaaugaacggacccuugauuaucaugacagcaacgugaagaaccuguacgagaaaguccgcaaucagcucaagaacaaugccaaggagauugggaacggauguuucgaauuuuaucacaaaugcgauaauacauguauggaguccgugaagaacggcaccuacgacuauccuaaauacagcgaagaggcuaagcugaauagagaagagaucgaugggguuaaacuugagucuacacggaucuaucaaauucuggccaucuacuccacgguggcgagcucucucguccuggugguuucccugggcgcuauuagcuucuggaugugcuccaacggaucucuccagugccgcaucuguauuuga

SEQ ID NO: 195143 - RNA, 1701 nt, Artificial Sequence; identical to SEQ ID NO: 195089
  derived and/or modified sequence opt5 from hemagglutinin__InfluenzaA__AHZ36271

SEQ ID NO: 195144 - RNA, 1701 nt, Artificial Sequence; identical to SEQ ID NO: 195104
  derived and/or modified sequence opt5 from hemagglutinin__InfluenzaA__AHZ36283

SEQ ID NO: 195145 - RNA, 1701 nt, Artificial Sequence; identical to SEQ ID NO: 195089
  derived and/or modified sequence opt5 from hemagglutinin__InfluenzaA__AHZ36294

SEQ ID NO: 195146 - RNA, 1701 nt, Artificial Sequence
  derived and/or modified sequence opt5 from hemagglutinin__InfluenzaA__AHZ36306
augaaggccauccuggugguccuccuguacaccuucgcuauugccaacgcggacacacuuugcaucggcuaucacgcuaauaacagcacggauaccguugacacagugcuggagaagaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacauccucuagcgacaacgggaccugcuauccgggcgauuuuaucaauuacgaagaacugcgggagcagcuuuccagcgucucuuccuucgaacgcuuugagauguuccccaagacgagcucuuggccuaaccacgacuccaauaagggagugaccgccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccacaaccgccgaccaacagucucucuaccagaaugcugaugccuacguguucgugggcacaagcagauauuccaagaaauuuaagccugagauugcuauccggccgaaaguccgcgaccaggaggggagaaugaacuacuauuggacccugguugaacccggagauaagauuacguucgaggccacaggcaaccugguggugccucgguacgcguuugccauggaacgcaaugcugggagcggaaucauuaucucugacacccccguccaugauugcaacacaaccugucaaaccccuaaaggcgccaucaauacaucccuccccuuccagaacauucacccgaucacgauuggcaagugcccuaaguaugugaaaagcaagaaacugagacuugcuaccgggcugcggaauguucccucuauccagagccgcggacucuuuggcgccauugccggguucaucgagggaggcuggacagggaugguggacggaugguacggcuaucaucaccagaacgaacaaggcuccggguacgcugcggaccugaagucuacccagaaugccaucgauaaaauuacaaacaaggucaauagcgugaucgagaagaugaacacccaguuuacggcuguuggaaaagaguucaaucaccuugaaaagagaauugagaaccugaauaaaaagguggacgauggcuuccucgacaucuggacauacaacgccgaacugcugguccuccuggagaaugaacggacccuugauuaucaugacuccaacgugaaaaaccuguacgagaagguccgcaaucagcucaagaacaaugccaaagagauugggaacggauguuuugaguucuaucacaagugcgauaauaccuguauggagagcgugaaaaacggcacauacgacuauccuaaguacucugaagaggcuaaacugaauagagaagagaucgaugggguuaaacuugaguccacccggaucuaucaaauucuggccaucuacagcacaguggcgucuucccucguccuggugguuagccugggcgcuauuuccuuuuggaugugcucuaacggaagccuccagugccgcaucuguauuuga

SEQ ID NO: 195147 - RNA, 1701 nt, Artificial Sequence; identical to SEQ ID NO: 195104
  derived and/or modified sequence opt5 from hemagglutinin__InfluenzaA__AHZ36317

SEQ ID NO: 195148 - RNA, 1701 nt, Artificial Sequence; identical to SEQ ID NO: 195104
  derived and/or modified sequence opt5 from hemagglutinin__InfluenzaA__AHZ36328

SEQ ID NO: 195149 - RNA, 1701 nt, Artificial Sequence
  derived and/or modified sequence opt5 from hemagglutinin__InfluenzaA__AHZ36339
augaaggccauccuggugguccuccuguacaccuucgcuauugccaacgcggacacacuuugcaucggcuaucacgcuaauaacagcacggauaccguugacacagugcuggagaagaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacauccucuagcgacaacgggaccugcuauccgggcgauuuuaucaauuacgaagaacugcgggagcagcuuuccagcgucucuuccuucgaacgcuuugagauguuccccaagacgagcucuuggccuaaccacgacuccaauaagggagugaccgccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccacaaccgccgaccaacagucucucuaccagaaugcugaugccuacguguucgugggcacaagcagauauuccaagaaauuuaagccugagauugcuauccggccgaaaguccgcgaccaggaggggagaaugaacuacuauuggacccugguugaacccggagauaagauuacguucgaggccacaggcaaccugguggugccucgguacgcguuugccauggaacgcaaugcugggagcggaaucauuaucucugacacccccguccaugauugcaacacaaccugucaaaccccuaaaggcgccgugaauacaucccuccccuuccagaacauccacccgauuacgaucggcaagugcccuaaguauguuaaaagcaccaagcugagacuugcuacagggcugcggaaugugcccucuauucagagccgcggacucuuuggcgccaucgccggguucauugagggaggcuggaccgggauggucgacggaugguacggcuaucaucaccagaacgaacaaggcuccggguacgcugcggaccugaaaucuacacagaaugccaucgauaagaucaccaacaaagugaauagcguuauugagaagaugaacacgcaguuuacagcugugggaaaggaguucaaucaccuugaaagacggaucgagaaccugaauaaaaaggucgacgauggcuuccucgacauuuggaccuacaacgccgaacugcuggugcuccuggagaaugaacgcacccuugauuaucaugacuccaacgucaaaaaccuguacgagaaggugagaaaucagcucaaaaacaaugccaaggagaucgggaacggauguuuugaguucuaucacaagugcgauaauacauguauggagagcguuaaaaacggcaccuacgacuauccuaaguacucugaagaggcuaaacugaaucgggaagagauugauggggugaaacuugaguccacacgcaucuaucaaauccuggccauuuacagcacggucgcgucuucccucgugcugguugugagccugggcgcuaucuccuuuuggaugugcucuaacggaagccuccagugcagaauuuguaucuga

SEQ ID NO: 195150 - RNA, 1701 nt, Artificial Sequence
  derived and/or modified sequence opt5 from hemagglutinin__InfluenzaA__AHZ36362
augaaggccauccuggugguccuccuguacaccuucgcuauugccaacgcggacacacuuugcaucggcuaucacgcuaauaacagcacggauaccguugacacagugcuggagaagaaugugaccgucacacauuccauuaaccuccuggaagauaagcacaaugggaaacuuuguaagcugagaggaguggcuccccuccaucugggcaaaugcaacaucgccggguggauucugggaaauccugagugugaaucucucagcaccgccuccucuuggagcuacaucguugagacauccucuagcgacaacggaaccugcuauccgggggauuuuaucaauuacgaagaacugcgggagcagcuuuccagcgugucuuccuucgaacgcuuugagauguuccccaagacgagcucuuggccuaaccacgacuccaauaagggagucaccgccgcuuguccccaugccggcgcgaaaucuuuuuauaagaaccugauuuggcucgugaaaaagggcaauagcuacccuaaacuguccaagagcuauaucaacgauaaggggaaagaaguucuugugcuguggggcauucaccaccccuccacaaccgccgaccaacagucucucuaccagaaugcugaugccuacgucuucgugggcacaagcagauauuccaagaaauuuaagccugagaucgcuauucggccgaaagugcgcgaccaggaggggagaaugaacuacuauuggacccuggucgaacccggagauaagaucacguucgaggccacaggcaaccugguugugccucgguacgcguuugccauggaacgcaaugcugggagcggaauuaucaucucugacacccccgugcaugauugcaacacaaccugucaaaccccuaaaggcgccgucaauacaucccuccccuuccagaacauucacccgaucacgauuggcaagugcccuaaguaugugaaaagcaccaagcugagacuugcuacagggcugcggaauguucccucuauccagagccgcggacucuuuggcgccauugccggguucaucgagggaggcuggaccgggaugguggacggaugguacggcuaucaucaccagaacgaacaaggcuccggguacgcugcggaccugaaaucuacacagaaugccaucgauaagauuaccaacaaagucaauagcgugaucgagaagaugaacacgcaguuuacagcuguuggaaaggaguucaaucaccuugaaagacggauugagaaccugaauaaaaagguggacgauggcuuccucgacaucuggaccuacaacgccgaacugcugguccuccuggagaaugaacgcacccuugauuaucaugacuccaacgugaaaaaccuguacgagaaggucagaaaucagcucaaaaacaaugccaaggagauugggaacggauguuuugaguucuaucacaagugcgauaauacauguauggagagcgugaaaaacggcaccuacgacuauccuaaguacucugaagaggcuaaacugaaucgggaagagaucgaugggguuaaacuugaguccacacgcaucuaucaaauucuggccaucuacagcacgguggcgucuucccucguccuggugguuagccugggcgcuauuuccuuuuggaugugcucuaacggaagccuccagugcagaaucuguauuuga

SEQ ID NO: 195151 - RNA, 1701 nt, Artificial Sequence
  derived and/or modified sequence opt5 from hemagglutinin__InfluenzaA__AHZ36385
augaagaccaucauugcccugagcuacauccucugccugauuuucgcucaggagauccccggcaacgacaauuccacagccacgcuuugucuggggcaccaugcggugccuaacggaaccauugucaaaacaaucaccaaugaucaaaucgaaguuacaaacgcuaccgagcucgugcagucuagcuccacaggcgaaauuugcaauucuccgcaccagauccuggacggggagaacuguacccuuauugaugcccugcucggagacccccagugcgaugacuuucaaaauaagaaaugggaucuguucguggaaagaagcaaggcccauuccaacuguuauccuuacgacguccccgauuaugcuucucugcggagccucguggccuccagcggcacgcuggaguuuaauaacgagucuuucaauuggaccgggguuacacagaacggaaccuccagcgcuugcauccgcagaucuaauaacuccuuuuucagccggcuuaauuggcugacacaccucaacuuuaaauacccugcccugaacgugaccaugcccaauaacgaacaguucgacaaacuuuauauuuggggcguccaucacccuggcacggauaaggaccagaucuuucuguacgcgcaagccucugggcgcauuacaguguccaccaagagaagccagcaggcuguuaucccgaauaucggaucccggccccgcgugagaaacauuccuucucgggucagcaucuauuggacaauugugaagcccggcgauauccuccugauuaauuccaccgggaaccugaucgccccucgcggauacuucaaaaucagaagcggcaagucuuccauuaugcggagcgacgcucccaucgggaaauguaauucugccugcauuaccccgaacggaagcaucccuaaugacaagcccuuucagaacgugaaucgcauuacauacggcgcguguccuagauaugucaagcaaaacacgcucaaacuggccaccggcaugcggaauguucccgagaagcagacacgcgggaucuucggagcuaucgccggcuuuauugaaaacgggugggagggaaugguggauggcugguacggguucagacaccaaaauuccgagggacggggccaggcugccgaccuuaaaucuacccaggccgcuaucgaucagauuaacggcaagcugaacagacucaucgggaaaacaaaugaaaaguuccaucagauugagaaagaauuuagcgagguggaaggacgcauccaagaccuggagaaguaugucgaggauaccaagauugaccuuugguccuacaacgcggaacugcucguggcccuggagaaucagcacacgaucgaucugacagacagcgaaaugaacaaacucuucgagaagaccaaaaagcagcugcgggaaaaugcugaggauaugggcaacgggugcuuuaaaaucuaucauaagugugacaaugccugcauuggaucuaucagaaacggcaccuacgaucacgacguuuaucgcgacgaggcccuuaauaaccgguucaagauuaaagggguggaacugaaguccggcuacaaagauuggauccucuggauuagcuuugcuaucucuugcuuccugcuuugugucgcccugcucggauuuaucaugugggcgugccagaagggcaauauuagauguaacaucugcauuuga

SEQ ID NO: 195152 - RNA, 1701 nt, Artificial Sequence
  derived and/or modified sequence opt5 from hemagglutinin__InfluenzaA__AHZ36397
augaagaccaucauugcccugagcuacauccucugccugauuuucgcucaggagauccccggcaacgacaauuccacagccacgcuuugucuggggcaccaugcggugccuaacggaaccauugucaaaacaaucaccaaugaucaaaucgaaguuacaaacgcuaccgagcucgugcagucuagcuccacaggcgaaauuugcaauucuccgcaccagauccuggacggggagaacuguacccuuauugaugcccugcucggagacccccagugcgaugacuuucaaaauaagaaaugggaucuguucguggaaagaagcaaggcccauuccaacuguuauccuuacgacguccccgauuaugcuucucugcggagccucguggccuccagcggcacgcuggaguuuaauaacgagucuuucaauuggaccgggguuacacagaacggaaccuccagcgcuugcauccgcagaucuaauaacuccuuuuucagccggcuuaauuggcugacacaccucaacuuuaaauacccugcccugaacgugaccaugcccaauaacgaacaguucgacaaacuuuauauuuggggcguccaucacccuggcacggauaaggaccagaucuuucuguacgcgcaagccucugggcgcauuacaguguccaccaagagaagccagcaggcuguuaucccgaauaucggaucccggccccgcgugagaaacauuccuucucgggucagcaucuauuggacaauugugaagcccggcgauauccuccugauuaauuccaccgggaaccugaucgccccucgcggauacuucaaaaucagaagcggcaagucuuccauuaugcggagcgacgcucccaucgggaaauguaauucugccugcauuaccccgaacggaagcaucccuaaugacaagcccuuucagaacgugaaucgcauuacauacggcgcguguccuagauaugucaagcaaaacacgcucaaacuggccaccggcaugcggaauguucccgagaagcagacacgcgggaucuucggagcuaucgccggcuuuauugaaaacgggugggagggaaugguggauggcugguacggguucagacaccaaaauuccgagggacggggccaggcugccgaccuuaaaucuacccaggccgcuaucgaucagauuaacggcaagcugaacagacucaucgggaaaacaaaugaaaaguuccaucagauugagaaagaauuuagcgagguggaaggacgcauccaagaccuggagaaguaugucgaggauaccaagauugaccuuugguccuacaacgcggaacugcucguggcccuggagaaucagcacacgaucgaucugacagacagcgaaaugaacaaacucuucgagaagaccaaaaagcagcugcgggaaaaugcugaggauaugggcaacgggugcuuuaaaaucuaucauaagugugacaaugccugcauuggaucuaucagaaacggcaccuacgaucacaauguuuaucgcgacgaggcccuuaacaaucgguucaagauuaaagggguggaacugaaguccggcuacaaagacuggauccucuggauuagcuuugcuaucucuugcuuccugcuuugugucgcccugcucggauuuaucaugugggcgugccagaagggcaacauuagauguaauaucugcauuuga

SEQ ID NO: 195153 - RNA, 1701 nt, Artificial Sequence; identical to SEQ ID NO: 195089
  derived and/or modified sequence opt5 from hemagglutinin__InfluenzaA__AHZ36409

SEQ ID NO: 195154 - RNA, 1701 nt, Artificial Sequence; identical to SEQ ID NO: 195090
  derived and/or modified sequence opt5 from hemagglutinin__InfluenzaA__AHZ36433

SEQ ID NO: 195155 - RNA, 1701 nt, Artificial Sequence
  derived and/or modified sequence opt5 from hemagglutinin__InfluenzaA__AHZ36445
augaagaccaucauugcccugagcuacauccucugccugauuuucgcucaggagauccccggcaacgacaauuccacagccacgcuuugucuggggcaccaugcggugccuaacggaaccauugucaaaacaaucaccaaugaucaaaucgaaguuacaaacgcuaccgagcucgugcagucuagcuccacaggcgaaauuugcaauucuccgcaccagauccuggacggggagaacuguacccuuauugaugcccugcucggagacccccagugcgaugacuuucaaaauaagaaaugggaucuguucguggaaagaagcaaggcccauuccaacuguuauccuuacgacguccccgauuaugcuucucugcggagccucguggccuccagcggcacgcuggaguuuaauaacgagucuuucaauuggaccgggguuacacagaacggaaccuccagcgcuugcauccgcagaucuaauaacuccuuuuucagccggcuuaauuggcugacacaccucaacuuuaaauacccugcccugaacgugaccaugcccaauaacgaacaguucgacaaacuuuauauuuggggcguccaucacccuggcacggauaaggaccagaucuuucuguacgcgcaagccucugggcgcauuacaguguccaccaagagaagccagcaggcuguuaucccgaauaucggaucccggccccgcgugagaaacauuccuucucgggucagcaucuauuggacaauugugaagcccggcgauauccuccugauuaauuccaccgggaaccugaucgccccucgcggauacuucaaaaucagaagcggcaagucuuccauuaugcggagcgacgcucccaucgggaaauguaauucugccugcauuaccccgaacggaagcaucccuaaugacaagcccuuucagaacgugaaucgcauuacauacggcgcguguccuagauaugucaagcaaaacacgcucaaacuggccaccggcaugcggaauguucccgagaagcagacacgcgggaucuucggagcuaucgccggcuuuauugaaaacgggugggagggaaugguggauggcugguacggguucagacaccaaaauuccgagggacggggccaggcugccgaccuuaaaucuacccaggccgcuaucgaucagauuaacggcaagcugaacagacucaucgggaaaacaaaugaaaaguuccaucagauugagaaagaauuuagcgagguggaaggacgcauccaagaccuggagaaguaugucgaggauaccaagauugaccuuugguccuacaacgcggaacugcucguggcccuggagaaucagcacacgaucgaucugacagacagcgaaaugaacaaacucuucgagaagaccaaaaagcagcugcgggaaaaugcugaggauaugggcaacgggugcuuuaaaaucuaucauaagugugacgaugccugcauuggaucuaucagaaauggcaccuacgaccacgacguuuaucgcgaugaggcccuuaacaaucgguuccagauuaaggggguggaacugaaauccggcuacaaggacuggauccucuggauuagcuuugcuaucucuugcuuccugcuuugugucgcccugcucggauuuaucaugugggcgugccaaaaaggcaacauuagauguaauaucugcauuuga

SEQ ID NO: 195156 - RNA, 1701 nt, Artificial Sequence; identical to SEQ ID NO: 195089
  derived and/or modified sequence opt5 from hemagglutinin__InfluenzaA__AHZ36457

SEQ ID NO: 195157 - RNA, 1701 nt, Artificial Sequence; identical to SEQ ID NO: 195089
  derived and/or modified sequence opt5 from hemagglutinin__InfluenzaA__AHZ36469

SEQ ID NO: 195158 - RNA, 1701 nt, Artificial Sequence
  derived and/or modified sequence opt5 from hemagglutinin__InfluenzaA__AHZ36481
augaagaccaucauugcccugagcuacauccucugccugauuuucgcucaggagauccccggcaacgacaauuccacagccacgcuuugucuggggcaccaugcggugccuaacggaaccauugucaaaacaaucaccaaugaucaaaucgaaguuacaaacgcuaccgagcucgugcagucuagcuccacaggcgaaauuugcaauucuccgcaccagauccuggacggggagaacuguacccuuauugaugcccugcucggagacccccagugcgaugacuuucaaaauaagaaaugggaucuguucguggaaagaagcaaggcccauuccaacuguuauccuuacgacguccccgauuaugcuucucugcggagccucguggccuccagcggcacgcuggaguuuaauaacgagucuuucaauuggaccgggguuacacagaacggaaccuccagcgcuugcauccgcagaucuaauaacuccuuuuucagccggcuuaauuggcugacacaccucaacuuuaaauacccugcccugaacgugaccaugcccaauaacgaacaguucgacaaacuuuauauuuggggcguccaucacccuggcacggauaaggaccagaucuuucuguacgcgcaagccucugggcgcauuacaguguccaccaagagaagccagcaggcuguuaucccgaauaucggaucccggccccgcgugagaaacauuccuucucgggucagcaucuauuggacaauugugaagcccggcgauauccuccugauuaauuccaccgggaaccugaucgccccucgcggauacuucaaaaucagaaauggcaagagcucuauuaugcgguccgacgcucccaucgggaaauguaacagcgccugcauuaccccgaauggaucuaucccuaacgacaagcccuuucagaaugugaaccgcauuacauacggcgcguguccuagauaugucaagcaaaauacgcucaaacuggccaccggcaugcggaacguucccgagaagcagacacgcgggaucuucggagcuaucgccggcuuuauugaaaaugggugggagggaaugguggauggcugguacggguucagacaccagaacagcgagggacggggccaagcugccgaccuuaaauccacccaggccgcuaucgaucagauuaacggcaagcugaauagacucaucgggaaaacaaacgaaaaguuccaucagauugagaaagaauuuucugagguggaaggacgcauccaagaccuggagaaguaugucgaggauaccaagauugaccuuuggagcuacaaugcggaacugcucguggcccuggagaaccagcacacgaucgaucugacagacuccgaaaugaauaaacucuucgagaagaccaaaaagcagcugcgggaaaacgcugaggauaugggcaaugggugcuuuaaaaucuaucauaagugugacaacgccugcauuggaagcaucagaaauggcaccuacgaucacgacguuuaucgcgacgaggcccuuaacaaucgguuccagauuaaggggguggaacugaaaucuggcuacaaggauuggauccucuggauuuccuuugcuaucagcugcuuccugcuuugugucgcccugcucggauuuaucaugugggcgugccaaaaaggcaacauuagauguaauaucugcauuuga

SEQ ID NO: 195159 - RNA, 1701 nt, Artificial Sequence; identical to SEQ ID NO: 195090
  derived and/or modified sequence opt5 from hemagglutinin__InfluenzaA__AHZ36493

SEQ ID NO: 195160 - RNA, 1701 nt, Artificial Sequence; identical to SEQ ID NO: 195090
  derived and/or modified sequence opt5 from hemagglutinin__InfluenzaA__AHZ36505

SEQ ID NO: 195161 - RNA, 1701 nt, Artificial Sequence; identical to SEQ ID NO: 195090
  derived and/or modified sequence opt5 from hemagglutinin__InfluenzaA__AHZ36517

SEQ ID NO: 195162 - RNA, 1701 nt, Artificial Sequence
  derived and/or modified sequence opt5 from hemagglutinin__InfluenzaA__AHZ36529
augaagaccaucauugcccugagcuacauccucugccugauuuucgcucaggagauccccggcaacgacaauuccacagccacgcuuugucuggggcaccaugcggugccuaacggaaccauugucaaaacaaucaccaaugaucaaaucgaaguuacaaacgcuaccgagcucgugcagucuagcuccacaggcgaaauuugcaauucuccgcaccagauccuggacggggagaacuguacccuuauugaugcccugcucggagacccccagugcgaugacuuucaaaauaagaaaugggaucuguucguggaaagaagcaaggcccauuccaacuguuauccuuacgacguccccgauuaugcuucucugcggagccucguggccuccagcggcacgcuggaguuuaauaacgagucuuucaauuggaccgggguuacacagaacggaaccuccagcgcuugcauccgcagaucuaauaacuccuuuuucagccggcuuaauuggcugacacaccucaacuuuaaauacccugcccugaacgugaccaugcccaauaacgaacaguucgacaaacuuuauauuuggggcguccaucacccuggcacggauaaggaccagaucuuucuguacgcgcaagccucugggcgcauuacaguguccaccaagagaagccagcaggcuguuaucccgaauaucggaucccggccccgcgugagaaacauuccuucucgggucagcaucuauuggacaauugugaagcccggcgauauccuccugauuaauuccaccgggaaccugaucgccccucgcggauacuucaaaaucagaagcggcaagucuuccauuaugcggagcgacgcucccaucgggaaauguaauucuagcugcauuaccccgaacggauccaucccuaaugacaagcccuuucagaacgugaaucgcauuacauacggcgccuguccuagauaugucaagcaaaacacgcucaaacuggcgaccggcaugcggaauguucccgagaagcagacacgcgggaucuucggagccaucgcuggcuuuauugaaaacgggugggagggaaugguggauggcugguacggguucagacaccaaaauucugagggacggggccaggccgcugaccuuaaaagcacccaggccgccaucgaucagauuaacggcaagcugaacagacucaucgggaaaacaaaugaaaaguuccaucagauugagaaagaauuuuccgagguggaaggacgcauccaagaccuggagaaguaugucgaggauaccaagauugaccuuuggagcuacaacgcugaacugcucguggcgcuggagaaucagcacacgaucgaucugacagacucugaaaugaacaaacucuucgagaagaccaaaaagcagcugcgggaaaaugccgaggauaugggcaacgggugcuuuaaaaucuaucauaagugugacaaugcuugcauuggauccaucagaaacggcaccuacgaucacgacguuuaucgcgacgaggcccuuaauaaccgguuccagauuaaggggguggaacugaaaagcggcuacaaggauuggauccucuggauuucuuuugccaucuccugcuuccugcuuugugucgcucugcucggauuuaucaugugggccugccaaaaaggcaauauuagauguaacaucugcauuuga

SEQ ID NO: 195163 - RNA, 1701 nt, Artificial Sequence; identical to SEQ ID NO: 195089
  derived and/or modified sequence opt5 from hemagglutinin__InfluenzaA__AHZ36541

SEQ ID NO: 195164 - RNA, 1701 nt, Artificial Sequence
  derived and/or modified sequence opt5 from hemagglutinin__InfluenzaA__AHZ36553
augaagaccaucauugcccugagcuacauccucugccugauuuucgcucaggagauccccggcaacgacaauuccacagccacgcuuugucuggggcaccaugcggugccuaacggaaccauugucaaaacaaucaccaaugaucaaaucgaaguuacaaacgcuaccgagcucgugcagucuagcuccacaggcgaaauuugcaauucuccgcaccagauccuggacggggagaacuguacccuuauugaugcccugcucggagacccccagugcgaugacuuucaaaauaaggaaugggaucuguucguggagagaagcaaagcccauuccaacuguuauccuuacgacguccccgauuaugcuucucugcggagccucguggccuccagcggcacgcuggaguuuaagaaugaaucuuucaacuggaccgggguuacacagaauggaaccuccagcgcuugcauccgcagaucuaacaauuccuuuuucagccggcuuaacuggcugacacaccucaauuuuaaauacccugcccugaacgugaccaugcccaacaaugagcaguucgacaaacuuuauauuuggggcguccaucacccuggcacggauaaggaccagaucuuucuguacgcgcaagccucugggcgcauuacaguguccaccaagagaagccagcaggcuguuaucccgaacaucggaucccggccccgcgugagaaauauuccuucucgggucagcaucuauuggacaauugugaagcccggcgauauccuccugauuaacuccaccgggaaucugaucgccccucgcggauacuucaaaaucagaagcggcaagucuuccauuaugcggagcgacgcucccaucgggaaauguaacucugccugcauuaccccgaauggaagcaucccuaacgacaagcccuuucagaaugugaaccgcauuacauacggcacguguccuagauaugucaagcaaaauacccucaaacuggcgacaggcaugcggaacguucccgaaaagcagacccgcgggaucuucggagccaucgcuggcuuuauugagaaugggugggagggaaugguggauggcugguacggguucagacaccagaacuccgaaggacggggccaagccgcugaccuuaaaucuacacaggccgccaucgaucagauuaauggcaagcugaacagacucaucgggaaaaccaacgagaaguuccaucagauugaaaaagaguuuagcgaaguggagggacgcauccaagaccuggagaaguaugucgaagauacgaagauugaccuuugguccuacaaugcugagcugcucguggcgcuggaaaaccagcacacaaucgaucugaccgacagcgagaugaauaaacucuucgaaaagaccaaaaagcagcugcgggagaacgccgaggauaugggcaaugggugcuuuaaaaucuaucauaagugugacaacgcuugcauuggaucuaucagaaauggcacauacgaucacgacguuuaucgcgacgaagcccuuaacaaucgguuccagauuaaggggguggagcugaaauccggcuacaaggauuggauccucuggauuagcuuugccaucucuugcuuccugcuuugugucgcucugcucggauuuaucaugugggccugccaaaaaggcaacauuagauguaauaucugcauuuga

SEQ ID NO: 195165 - RNA, 1701 nt, Artificial Sequence; identical to SEQ ID NO: 195089
  derived and/or modified sequence opt5 from hemagglutinin__InfluenzaA__AHZ36565

SEQ ID NO: 195166 - RNA, 1701 nt, Artificial Sequence; identical to SEQ ID NO: 195089
  derived and/or modified sequence opt5 from hemagglutinin__InfluenzaA__AHZ36577

SEQ ID NO: 195167 - RNA, 1701 nt, Artificial Sequence; identical to SEQ ID NO: 195089
  derived and/or modified sequence opt5 from hemagglutinin__InfluenzaA__AHZ36589

SEQ ID NO: 195168 - RNA, 1701 nt, Artificial Sequence; identical to SEQ ID NO: 195164
  derived and/or modified sequence opt5 from hemagglutinin__InfluenzaA__AHZ36601

SEQ ID NO: 195169 - RNA, 1701 nt, Artificial Sequence
  derived and/or modified sequence opt5 from hemagglutinin__InfluenzaA__AHZ36613
augaagaccaucauugcccugagcuacauccucugccugauuuucgcucaggagauccccggcaacgacaauuccacagccacgcuuugucuggggcaccaugcggugccuaacggaaccauugucaaaacaaucaccaaugaucaaaucgaaguuacaaacgcuaccgagcucgugcagucuagcuccacaggcgaaauuugcaauucuccgcaccagauccuggacggggagaacuguacccuuauugaugcccugcucggagacccccagugcgaugacuuucaaaauaaggaaugggaucuguucguggagagaagcaaagcccauuccaacuguuauccuuacgacguccccgauuaugcuucucugcggagccucguggccuccagcggcacgcuggaguuuaauaacgaaucuuucaauuggaccgggguuacacagaacggaaccuccagcgcuugcauccgcagaucuaauaacuccuuuuucagccggcuuaauuggcugacacaccucaacuuuaaguacccugcccugaacgugaccaugcccaauaacgagcaguucgacaaacuuuauauuuggggcguccaucacccuggcacggauaaggaccagaucuuucuguacgcgcaagccucugggcgcauuacaguguccaccaagagaagccagcaggcuguuaucccgaauaucggaucccggccccgcgugagaaacauuccuucucgggucagcaucuauuggacaauugugaaacccggcgauauccuccugauuaauuccaccgggaaccugaucgccccucgcggauacuucaagaucagaagcggcaaaucuuccauuaugcggagcgacgcucccaucgggaaguguaauucugccugcauuaccccgaacggaagcaucccuaaugacaaacccuuucagaacgugaaucgcauuacauacggcacguguccuagauaugucaagcaaaacacccucaagcuggcgacaggcaugcggaauguucccgaaaaacagacccgcgggaucuucggagccaucgcuggcuuuauugagaacgggugggagggaaugguggauggcugguacggguucagacaccaaaauuccgaaggacggggccaggccgcugaccuuaagucuacacaggccgccaucgaucagauuaacggcaaacugaacagacucaucgggaagaccaaugagaaauuccaucagauugaaaaggaguuuagcgaaguggagggacgcauccaagaccuggagaaauaugucgaagauacgaagauugaccuuugguccuacaacgcugagcugcucguggcgcuggaaaaucagcacacaaucgaucugaccgacagcgagaugaacaaacucuucgaaaagaccaagaaacagcugcgggagaaugccgaggauaugggcaacgggugcuuuaagaucuaucauaaaugugacaaugcuugcauuggaucuaucagaaacggcacauacgaucacgacguuuaucgcgacgaagcccuuaauaaccgguuccagauuaaggggguggagcugaaguccggcuacaaagauuggauccucuggauuagcuuugccaccucuugcuuccugcuuugugucgcucugcucggauuuaucaugugggccugccaaaagggcaauaucagauguaacauuugcaucuga

SEQ ID NO: 195170 - RNA, 1701 nt, Artificial Sequence; identical to SEQ ID NO: 195089
  derived and/or modified sequence opt5 from hemagglutinin__InfluenzaA__AHZ36625

SEQ ID NO: 195171 - RNA, 1701 nt, Artificial Sequence; identical to SEQ ID NO: 195090
  derived and/or modified sequence opt5 from hemagglutinin__InfluenzaA__AHZ36637

SEQ ID NO: 195172 - RNA, 1701 nt, Artificial Sequence; identical to SEQ ID NO: 195090
  derived and/or modified sequence opt5 from hemagglutinin__InfluenzaA__AHZ36649

SEQ ID NO: 195173 - RNA, 1701 nt, Artificial Sequence; identical to SEQ ID NO: 193018
  derived and/or modified sequence opt5 from hemagglutinin__InfluenzaA__AHZ36661

SEQ ID NO: 195174 - RNA, 1701 nt, Artificial Sequence; identical to SEQ ID NO: 193018
  derived and/or modified sequence opt5 from hemagglutinin__InfluenzaA__AHZ36673

SEQ ID NO: 195175 - RNA, 1701 nt, Artificial Sequence
  derived and/or modified sequence opt5 from hemagglutinin__InfluenzaA__AHZ36685
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugguugauggaugguauggcuucagacaccagaacagcgagggccgggggcaggccgcugaccugaaauccacccaagccgccauugaucagaucaauggaaagcucaacagacugauuggcaaaacaaaugaaaaguuccaccagaucgagaaggaauuuagcgagguggaagggcgcauucaggaccuugagaaauacguggaggauaccaagaucgaccuguggucuuauaacgcugaacuccuggucgcgcuggagaaccaacauacaaucgaucucaccgacuccgaaaugaauaaacuguucgagaagacgaaaaagcagcuucgggaaaacgccgaggauaugggaaauggcugcuuuaagauuuaccacaaaugugacaacgcuugcaucgggagcauuagaaauggcacauaugaucaugacguguaccgcgacgaggcccugaacaaucgguuccagaucaagagaguugaacucaaaucuggauacaaggauuggauucuguggaucuccuuugccaucagcugcuuccuucuguguguggcucuccugggcuuuauuaugugggccugccagaaagggaacauccgcuguaauauuugcaucuga

SEQ ID NO: 195176 - RNA, 1683 nt, Artificial Sequence; identical to SEQ ID NO: 193012
  derived and/or modified sequence opt5 from hemagglutinin__InfluenzaA__AHZ39698

SEQ ID NO: 195177 - RNA, 1683 nt, Artificial Sequence
  derived and/or modified sequence opt5 from hemagglutinin__InfluenzaA__AHZ39722
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccaauauuccucgcaucuguuccaagggcaaaagaacaguugaucuggggcaaugcggacuccugggcaccaucacggggccgccccagugugaccaguuucuugaguucucugccgaucugauuaucgaacggcgcgagggaagcgacgugugcuacccuggcaaguuugucaacgaggaagcccucagacagauucugcgggaguccggcgggaucgauaaagaagcuaugggauucaccuauucuggcauucgcacagacggggccaccagcgcuuguagacgguccggaucuagcuuuuacgccgagaugaaguggcugcucuccaauacagaugacgcggccuucccccaaaugaccaagagcuauaaaaacacgcgcaagucuccugcucugaucguguggggcauucaccauuccguuagcacagccgagcagaccaaacuuuacgggucuggaaauaagcuggugacagucggcuccagcaacuaucagcagucuuuugugcccuccccuggcgcuagaccgcaagugaaugggcucagcggacggaucgauuuccacuggcugaugcuuaaccccaaugacaccgucaccuuuuccuucaacggcgccuuuaucgcgccugaucgcgccucuuuccugagagggaaaagcaugggcauucaguccggaguucagguggacgcuaauugcgaaggggauuguuaccauagcggaggcacaaucauuucuaaccuccccuuucagaacaucgacucccgggccgugggcaagugcccucgcuaugucaagcaaagaagccugcugcucgcuacggggaugaaaaaugugcccgagauuccgaagggacggggccuguucggggccaucgccggauucaucgaaaacggcugggaggggcuuauugacggcugguacggauuuagacaccagaaugcucagggcgaagggaccgcggccgauuacaaaucuacacaaagcgcuaucgaccagauuaccggaaagcugaaccgccucaucgagaaaacaaaucagcaguucgagcugauugauaacgaauuuaaugagguugaaaagcaaaucggcaacgugaucaauuggacccgggacuccauuacggaggucuggucuuauaacgccgaacuucugguggccauggagaaucagcacacaaucgaucucgcugacagcgagauggauaaacuguacgaaagaguuaagcgccagcugcgggagaacgccgaagaggacgggaccggauguuucgaaauuuuucauaagugcgaugacgauuguauggcguccaucagaaauaacaccuaugaccacagcaaauaccgcgaggaggcuaugcagaaucggauucaaaucgacccugugaagcucucuuccggcuauaaagaugucauucugugguucagcuuuggggccucuugcuucauccuucuggccaucgugaugggccucgucuuuauuugcgugaagaacggaaacaugagauguacaaucugcauuuga

SEQ ID NO: 195178 - RNA, 1683 nt, Artificial Sequence; identical to SEQ ID NO: 195177
  derived and/or modified sequence opt5 from hemagglutinin__InfluenzaA__AHZ39734

SEQ ID NO: 195179 - RNA, 1683 nt, Artificial Sequence
  derived and/or modified sequence opt5 from hemagglutinin__InfluenzaA__AHZ39746
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccaauauuccucgcaucuguuccaagggcaaaagaacaguugaucuggggcaaugcggacuccugggcaccaucacggggccgccccagugugaccaguuucuugaguucucugccgaucugauuaucgaacggcgcgagggaagcgacgugugcuacccuggcaaguuugucaacgaggaagcccucagacagauucugcgggaguccggcgggaucgauaaagaagcuaugggauucaccuauucuggcauucgcacaaauggggccaccagcgcuuguagacgguccggaucuagcuuuuacgccgagaugaaguggcugcucuccaacacagacaaugcggccuucccccaaaugaccaagagcuauaaaaacacgcgcaagucuccugcucugaucguguggggcauucaccauuccguuagcacagccgagcagaccaaacuuuacgggucuggaaauaagcuggugacagucggcuccagcaacuaucagcagucuuuugugcccuccccuggcgaaagaccgcaagugaaugggcucagcggacggaucgauuuccacuggcugaugcuuaaccccaaugacaccgucaccuuuuccuucaacggcgcuuuuaucgccccugaucgcgcgucuuuccugagagggaaaagcaugggcauucaguccggaguucagguggacgccaacugcgagggggauuguuaccauagcggaggcacaaucauuucuaaucuccccuuucagaacaucgacucccgggcugugggcaagugcccucgcuaugucaagcaaagaagccugcugcucgccacggggaugaaaaaugugcccgaaauuccgaagggacggggccuguucggggcuaucgccggauucaucgagaacggcugggaagggcuuauugauggcugguacggauuuagacaccagaaugcccagggcgaggggaccgcugcggacuacaaaucuacacaaagcgccaucgaccagauuaccggaaagcugaaccgccucaucgagaaaacaaaucagcaguucgaacugauugauaacgaguuuaaugaaguugagaagcaaaucggcaacgugaucaauuggacccgggacuccauuacggaagucuggucuuauaacgcugagcuucugguggccauggagaaucagcacacaaucgaucucgccgacagcgaaauggauaaacuguacgagagaguuaagcgccagcugcgggaaaacgcugaggaagacgggaccggauguuucgagauuuuucauaagugcgaugacgauuguauggccuccaucagaaauaacaccuaugaccacagcaaauaccgcgaggaagcgaugcagaaccggauucaaaucgauccugugaagcucucuuccggcuauaaagacgucauucugugguucagcuuuggggcuucuugcuucauccuucuggccaucgugaugggccucgucuuuauuugcgugaagaauggaaacaugagauguacaaucugcauuuga

SEQ ID NO: 195180 - RNA, 1683 nt, Artificial Sequence; identical to SEQ ID NO: 195177
  derived and/or modified sequence opt5 from hemagglutinin__InfluenzaA__AHZ39758

SEQ ID NO: 195181 - RNA, 1683 nt, Artificial Sequence; identical to SEQ ID NO: 195177
  derived and/or modified sequence opt5 from hemagglutinin__InfluenzaA__AHZ39770

SEQ ID NO: 195182 - RNA, 1683 nt, Artificial Sequence; identical to SEQ ID NO: 195177
  derived and/or modified sequence opt5 from hemagglutinin__InfluenzaA__AHZ39782

SEQ ID NO: 195183 - RNA, 1701 nt, Artificial Sequence; identical to SEQ ID NO: 192907
  derived and/or modified sequence opt5 from hemagglutinin__InfluenzaA__AHZ39794

SEQ ID NO: 195184 - RNA, 1701 nt, Artificial Sequence; identical to SEQ ID NO: 193021
  derived and/or modified sequence opt5 from hemagglutinin__InfluenzaA__AHZ39806

SEQ ID NO: 195185 - RNA, 1701 nt, Artificial Sequence
  derived and/or modified sequence opt5 from hemagglutinin__InfluenzaA__AHZ39818
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagacauuucucuacgcgcaagccgcuggacgcaucaccguuucuacaaagagaucccagcaggccgugauuccgaauaucggcagccggccccgcgucagaaacauuccuucccgggugucuaucuauuggaccaucgugaaacccggggacauucugcugaucaauagcaccggaaaccucauugcuccucgcggcuacuucaagaucagauccgggaaaagcucuauuaugcgguccgaugcccccaucggaaaguguaauagcgcgugcaucacaccgaacggcucuauuccuaaugacaagcccuuucagaacgucaaucgcaucacguacggcgccuguccuagauauguuaaacaaaacacccugaaacuugcuacagggaugcggaaugugcccgaaaaacagacccgcggaauuuucggcgccaucgcuggguuuauugagaacggaugggaaggcaugguggacgggugguacggauucagacaccagaauagcgagggccggggccaagccgccgaucugaaguccacacaggcugcgaucgaccagaucaacgggaaacucaacagacugauuggaaagaccaaugagaaauuccaucagaucgaaaaggaguuuucugaagucgagggccgcauucaagaucuugaaaaguauguggaggacacgaaaaucgaucuguggagcuacaacgccgagcucauuguugcucuggaaaaucagcacacaaucgaccugaccgauuccgagaugaacaaacucuucgaaaagaccaagaagcagcugcgggagaaugccgaagacauggggaacggaugcuuuaagauuuaucauaagugugauaaugccugcaucggcagcaucagaaacgggacauacgaccacgauguguaucgcgacgaggcucuuaauaaccgguuccagauuaaaggcgucgagcugaagucuggauacaaagacuggauccucuggauuuccuuugccaucagcugcuuccugcuuugugugguucugcucggcuuuauuaugugggcgugccaaaaggggaauaucagauguaacaucugcauuuga

SEQ ID NO: 195186 - RNA, 1701 nt, Artificial Sequence; identical to SEQ ID NO: 192907
  derived and/or modified sequence opt5 from hemagglutinin__InfluenzaA__AHZ39841

SEQ ID NO: 195187 - RNA, 1701 nt, Artificial Sequence; identical to SEQ ID NO: 192927
  derived and/or modified sequence opt5 from hemagglutinin__InfluenzaA__AHZ39853

SEQ ID NO: 195188 - RNA, 1701 nt, Artificial Sequence; identical to SEQ ID NO: 192907
  derived and/or modified sequence opt5 from hemagglutinin__InfluenzaA__AHZ39865

SEQ ID NO: 195189 - RNA, 1701 nt, Artificial Sequence
  derived and/or modified sequence opt5 from hemagglutinin__InfluenzaA__AHZ39877
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagucuacacugaaacuugccacggggaugcgcaacguccccgagaagcaaaccagaggaaucuucggcgcgauugccggguuuaucgaaaauggaugggagggcaugguugaugggugguauggauuccggcaccagaacagcgagggcagaggccaggcugccgaccugaaauccacacaagcugccauugaucagaucaaugggaagcucaaccgccugauuggaaaaaccaaugaaaaguuccaccagaucgagaaggaauuuagcgagguggaaggccggauucaggaccuugagaaauacguggaggauacaaagaucgaccuguggucuuauaacgccgaacuccuggucgcucuggagaaccaacauaccaucgaucucacggacuccgaaaugaauaaacuguucgagaagaccaaaaagcagcuuagagaaaacgcggaggauauggggaauggaugcuuuaagauuuaccacaaaugugacaacgccugcaucggcagcauucgcaaugggacauaugaucauaacguguaccgggacgaggcucugaauaacagauuccagaucaagggcguugaacucaaaucuggauacaaggacuggauucuguggaucuccuuugccaccagcugcuuccuucuguguguggcccuccugggcuuuaucaugugggcuugccagaaagggaauauucgcuguaacaucugcauuuga

SEQ ID NO: 195190 - RNA, 1701 nt, Artificial Sequence; identical to SEQ ID NO: 192927
  derived and/or modified sequence opt5 from hemagglutinin__InfluenzaA__AHZ39889

SEQ ID NO: 195191 - RNA, 1701 nt, Artificial Sequence; identical to SEQ ID NO: 192908
  derived and/or modified sequence opt5 from hemagglutinin__InfluenzaA__AHZ39913

SEQ ID NO: 195192 - RNA, 1701 nt, Artificial Sequence
  derived and/or modified sequence opt5 from hemagglutinin__InfluenzaA__AHZ39925
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccgggauauuccuagccgcaucuccauuuacuggaccaucgucaaacccggggacauucugcugaucaauagcacaggaaaccucaucgcuccuagaggcuacuucaagauucggucugggaaauccagcaucaugcgcucugacgcccccauuggaaaguguaagagcgaaugcaucaccccgaauggcuccauuccuaacgauaaacccuuucagaaugugaacagaaucaccuauggcgcuuguccucgguacgugaagcagucuacacugaaacuugccacggggaugcgcaauguccccgagaagcaaaccagaggaaucuucggcgcgauugccggguuuaucgaaaacggaugggagggcaugguugacgggugguauggauuccggcaccagaauagcgagggcagaggccaggcugccgaucugaaauccacacaagcugccauugaccagaucaacgggaagcucaaucgccugauuggaaaaaccaacgaaaaguuccaccagaucgagaaggaauuuagcgagguggaaggccggauucaggaucuugagaaauacguggaggacacaaagaucgaucuguggucuuauaaugccgaacuccuggucgcucuggagaaccaacauaccaucgaccucacggauuccgaaaugaacaaacuguucgagaagaccaaaaagcagcuuagagaaaaugcggaggacauggggaacggaugcuuuaagauuuaccacaaaugugauaaugccugcaucggcagcauucgcaacgggacauaugaccaugacguguaccgggaugaggcucugaauaacagauuccagaucaagggcguugaacucaaaucuggauacaaggacuggauucuguggaucuccuuugccaucagcugcuuccuucuguguguggcccuccugggcuuuauuaugugggcuugccagaaagggaauauccgcuguaacauuugcaucuga

SEQ ID NO: 195193 - RNA, 1701 nt, Artificial Sequence; identical to SEQ ID NO: 192907
  derived and/or modified sequence opt5 from hemagglutinin__InfluenzaA__AHZ39937

SEQ ID NO: 195194 - RNA, 1701 nt, Artificial Sequence; identical to SEQ ID NO: 192907
  derived and/or modified sequence opt5 from hemagglutinin__InfluenzaA__AHZ39949

SEQ ID NO: 195195 - RNA, 1701 nt, Artificial Sequence; identical to SEQ ID NO: 192907
  derived and/or modified sequence opt5 from hemagglutinin__InfluenzaA__AHZ39961

SEQ ID NO: 195196 - RNA, 1701 nt, Artificial Sequence; identical to SEQ ID NO: 192907
  derived and/or modified sequence opt5 from hemagglutinin__InfluenzaA__AHZ39973

SEQ ID NO: 195197 - RNA, 1701 nt, Artificial Sequence
  derived and/or modified sequence opt5 from hemagglutinin__InfluenzaA__AHZ39985
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgccagcauuggaaaguguaaguccgaaugcaucacccccaacggcucuauuccgaaugacaaaccuuuucagaacgugaauagaaucaccuauggcgcuuguccccgguacgugaagcagagcacacugaaacuugccacggggaugcgcaacgucccugagaagcaaaccagaggaaucuucggcgcgauugccggguuuaucgaaaauggaugggagggcaugguugaugggugguauggauuccggcaccagaacuccgagggcagaggccaggcugccgaccugaaaagcacacaagcugccauugaucagaucaaugggaagcucaaccgccugauuggaaaaaccaaugaaaaguuccaccagaucgagaaggaauuuucugagguggaaggccggauucaggaccuugagaaauacguggaggauacaaagaucgaccugugguccuauaacgccgaacuccuggucgcucuggagaaccaacauaccaucgaucucacggacagcgaaaugaauaaacuguucgagaagaccaaaaagcagcuuagagaaaacgcggaggauauggggaauggaugcuuuaagauuuaccacaaaugugacaacgccugcaucggcucuauucgcaaugggacauaugaucauaacguguaccgggacgaggcucugaauaacagauuccagaucaagggcguugaacucaaauccggauacaaggacuggauucuguggaucagcuuugccaccuccugcuuccuucuguguguggcccuccugggcuuuaucaugugggcuugccagaaagggaauauucgcuguaacaucugcauuuga

SEQ ID NO: 195198 - RNA, 1701 nt, Artificial Sequence; identical to SEQ ID NO: 192907
  derived and/or modified sequence opt5 from hemagglutinin__InfluenzaA__AHZ39997

SEQ ID NO: 195199 - RNA, 1701 nt, Artificial Sequence
  derived and/or modified sequence opt5 from hemagglutinin__InfluenzaA__AHZ40009
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaucucuagcaucggcgagauuugcgacuccccgcaccagauccuugauggggaaaauuguacacugauugacgcccuccugggagauccccagugcgacggcuuucagaacaaaaagugggaucuguucgucgagcggucuaaagccuauagcaauuguuacccuuaugacgugcccgauuacgcuucccuccgcucucugguugccagcuccgggacccuugaauuuaacaaugagagcuucaacuggacgggagugacccaaaauggcacaucuuccgcuugcaucagaaagagcaacucuuccuuuuucagccggcugaauuggcucacccaucugaacuuuaaguauccugcccuuaaugucacaaugcccaacaacgagcaguucgacaaacuguacauuuggggcgugcaccauccugggaccgauaaggaccagaucuuucucuaugcgcagucuuccggacgcauuacgguuagcacaaaaagaucccaacaggccgugaucccgaauaucggcucucggccccgcauuagaaacaucccuagccggauuuccaucuacuggaccauugucaagcccggggauauccugcugaucaauagcacaggaaaccucauugcuccucgcggcuacuucaaaaucagaucugggaaguccagcauuaugcggucugacgcccccaucggaaaguguaaaagcgaaugcauuaccccgaauggcuccaucccuaacgacaagcccuuucagaaugugaaccgcaucaccuauggcgcuuguccuagauacgugaaacagucuacacugaaacuugccacggggaugcggaauguccccgagaagcaaacccgcggaauuuucggcgcgaucgccggguuuauugaaaacggaugggagggcaugguugaugggugguauggauucagacaccagaauagcgagggccggggccaggcugccgaccugaaguccacacaagcugccaucgaucagauuaacgggaaacucaauagacugaucggaaagaccaacgaaaaguuccaccagauugagaaagaauuuagcgagguggaaggccgcauccaggaccuugagaaguacguggaggauacaaaaaucgaccuguggucuuauaaugccgaacuccuggucgcucuggagaaccaacauaccauugaucucacggacuccgaaaugaacaagcuguucgagaaaacaaagaagcagcuucgggaaaaugcggaggauauggggaacggaugcuuuaaaaucuaccacaagugugacaaugccugcauuggcagcaucagaaacgggaccuaugaucaugacguguaccgcgacgaggcucugaauaaccgguuccagauuaaaggcguugaacucaagucuggauacaaagauuggauccuguggaucuccuuugccauuagcugcuuccuucuguguguggcccuccugggcuuuaucaugugggcuugccagaaggggaauauuagauguaacaucugcauuuga

SEQ ID NO: 195200 - RNA, 1701 nt, Artificial Sequence; identical to SEQ ID NO: 192907
  derived and/or modified sequence opt5 from hemagglutinin__InfluenzaA__AHZ40021

SEQ ID NO: 195201 - RNA, 1701 nt, Artificial Sequence; identical to SEQ ID NO: 192882
  derived and/or modified sequence opt5 from hemagglutinin__InfluenzaA__AHZ40033

SEQ ID NO: 195202 - RNA, 1701 nt, Artificial Sequence; identical to SEQ ID NO: 192907
  derived and/or modified sequence opt5 from hemagglutinin__InfluenzaA__AHZ40045

SEQ ID NO: 195203 - RNA, 1701 nt, Artificial Sequence; identical to SEQ ID NO: 192907
  derived and/or modified sequence opt5 from hemagglutinin__InfluenzaA__AHZ40060

SEQ ID NO: 195204 - RNA, 1701 nt, Artificial Sequence; identical to SEQ ID NO: 192907
  derived and/or modified sequence opt5 from hemagglutinin__InfluenzaA__AHZ40072

SEQ ID NO: 195205 - RNA, 1701 nt, Artificial Sequence; identical to SEQ ID NO: 192907
  derived and/or modified sequence opt5 from hemagglutinin__InfluenzaA__AHZ40084

SEQ ID NO: 195206 - RNA, 1701 nt, Artificial Sequence; identical to SEQ ID NO: 192907
  derived and/or modified sequence opt5 from hemagglutinin__InfluenzaA__AHZ40096

SEQ ID NO: 195207 - RNA, 1701 nt, Artificial Sequence; identical to SEQ ID NO: 192908
  derived and/or modified sequence opt5 from hemagglutinin__InfluenzaA__AHZ40108

SEQ ID NO: 195208 - RNA, 1701 nt, Artificial Sequence; identical to SEQ ID NO: 193021
  derived and/or modified sequence opt5 from hemagglutinin__InfluenzaA__AHZ40120

SEQ ID NO: 195209 - RNA, 1701 nt, Artificial Sequence
  derived and/or modified sequence opt5 from hemagglutinin__InfluenzaA__AHZ40130
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagucuacacugaaacuugccacggggaugcgcaacguccccgagaagcaaaccagaggaaucuucggcgcgauugccggguuuaucgaaaauggaugggagggcaugguugaugggugguauggauuccggcaccagaacagcgagggcagaggccaggcugccgaccugaaauccacacaagcugccauugaucagaucaaugggaagcucaaccgccugauuggaaaaaccaaugaaaaguuccaccagaucgagaaggaauuuagcgagguggaaggccggauucaggaccuugagaaauacguggaggauacaaagaucgaccuguggucuuauaacgccgaacuccuggucgcucuggagaaccaacauaccaucgaucucacggacuccgaaaugaauaaacuguucgagaagaccaaaaagcagcuuagagaaaacgcggaggauauggggaauggaugcuuuaagauuuaccacaaaugugacaacgccugcaucggcagcauucgcaaugggacauaugaucauaacguguaccgggacgaggcucugaauaacagauuccagaucaagggcguugaacucaaaucuggauacaagaauuggauucuguggaucuccuuugccaucagcugcuuccuucuguguguggcccuccugggcuuuauuaugugggcuugccagaaagggaacauccgcuguaauauuugcaucuga

SEQ ID NO: 195210 - RNA, 1701 nt, Artificial Sequence
  derived and/or modified sequence opt5 from hemagglutinin__InfluenzaA__AHZ40142
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucaggauaaaaagugggaccuguucgucgagcggucuaaagccuauagcaauuguuacccuuaugaugugcccgacuacgcuucccuccgcucucugguugccagcuccgggacccuugaauuuaacaaugagaacuucaauuggacgggagugacccaaaacggcacaagcucugcuugcauuagacgguccaauagcuccuuuuucucucgccugaacuggcucacccaucugaauuuuaaguauccugcccuuaacgucacaaugcccaacaaugagcaguucgauaagcuguacaucuggggcgugcaccauccugggaccgacaaagaucagauuuuucucuaugcgcagagcucuggaagaaucacgguuuccacaaagcggagccaacaggccgugauuccgaacaucggcucccgccccagaauccggaauauuccuucucgcaucagcauuuacuggaccaucgucaaacccggggacauucugcugaucaacuccacaggaaaucucaucgcuccuagaggcuacuucaagauucggagcgggaaaucuuccaucaugcgcagcgacgcccccauuggaaaguguaagucugaaugcaucaccccgaacggcagcauuccuaaugauagacccuuucagaacgugaaucggaucaccuauggcgcuuguccucgcuacgugaaacaguccacacugaagcuggccacggggaugagaaacguccccgagaaacaaacccggggaaucuucggcgcgauugccggguuuaucgaaaauggaugggagggcaugguugacgggugguauggauucagacaccagaacucugagggccgcggccaggcugccgaucuuaagagcacacaagcugccauugaccagaucaaugggaaacucaaccggcugauuggaaagaccaaugaaaaauuccaccagaucgagaaggaauuuuccgagguggaaggccgcauucaggaucuugagaaguacguggaggacacaaaaaucgaucuguggagcuauaacgccgaacuccuggucgcucuggagaaccaacauaccaucgaccucacggauucugaaaugaauaagcuguucgagaaaacaaagaaacagcuuagagaaaacgcggaggacauggggaauggaugcuuuaagauuuaccacaagugugauaacgccugcaucggcuccauucggaaugggaccuaugaccaugacguguacagagaugaggcucugaacaaucgcuuccagaucaaaggcguugaacucaagagcggauacaaagacuggauucuguggaucucuuuugccaucuccugcuuccuucuguguguggcccuccugggcuuuauuaugugggcuugccagaaggggaacauccgguguaauauuugcaucuga

SEQ ID NO: 195211 - RNA, 1701 nt, Artificial Sequence
  derived and/or modified sequence opt5 from hemagglutinin__InfluenzaA__AHZ40154
augaagaccaucauugcccugagcuacauccucugccugggcuucgcucaggagcuucccgggaacgacaauuccacagccacgcugugucucggacaccaugcggugccuaacggcaccauugucaaaacaaucaccaaugaucaaauugaaguuacaaacgcuaccgagcuggugcagucuagcuccacaggggaaaucugcaauucuccgcaccagauccuugacggagagaacuguacccugauugaugcccuccugggcgacccccagugcgauggguuucaaaauaagaaaugggaccuguucguggaaagaagcaaggcccauuccaacuguuauccuuacgauguccccgacuaugcuucucuccggagccugguggccuccagcggaacgcuugaguuuaauaacgagucuuucaauuggaccggcguuacacagaacggcaccuccagcgcuugcauccgcgggucuaauaacuccuuuuucagcagacugaauuggcucacacaccugaacuuuaaauacccugcccuuaacgugaccaugcccaauaacgaacaguucgauaagcuguauauuuggggaguccaucacccuggcacggacaaggaucagaucuuucucuacgcgcaagccucugggcggauuacaguguccaccaaacgcagccagcaggcuguuaucccgaauauuggauccagaccccgggugcgcaacaucccuucuagagucagcaucuauuggacaauugugaagcccggcgacaugcugcugaucaauuccaccgggaaccucauugccccucggggauacuucaaaauccgcagcggcaagucuuccauuaugagaagcgaugcucccaucggcaaauguaauucugccugcaucaccccgaacgggagcauuccuaaugacaagcccuuucagaacgugaaucggaucacauacggagcguguccucgcuaugucaagcaaaacacgcugaaacuugccaccggcaugagaaauguucccgagaagcagacacgggggauuuucggagcuaucgccggcuuuauugaaaacgggugggagggaaugguggacggcugguacggcuuccgccaccaaaauuccgaggggagaggacaggcugccgaucugaaaucuacccaggccgcuaucgaccagaucaacggcaagcucaaccggcugauugggaaaacaaaugaaaaguuccaucagaucgagaaagaauuuagcgagguggaaggacgcauucaagaucuugagaaguaugucgaggacaccaagaucgaucugugguccuacaacgcggaacuccugguggcccuggagaaucagcacacgauugaccucacagauagcgaaaugaacaaacuguucgagaagaccaaaaagcagcuuagagaaaaugcugaggacaugggcaacgggugcuuuaaaaucuaucauaaguguaauaacgccugcauuggcucuauccggaauggaaccuacgaucacgacguuuauagagaugaggcccugaacaaucgcuuccagaucaagggcguggaacucaaauccggguacaaggacuggauucuguggaucagcuuugcuauuucuugcuuccuucugugugucgcccuccugggauuuaucaugugggcgugccaaaaaggcaacauucgguguaauaucugcaucuga

SEQ ID NO: 195212 - RNA, 1701 nt, Artificial Sequence
  derived and/or modified sequence opt5 from hemagglutinin__InfluenzaA__AHZ40166
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacagccgaccaacagucucucuaccagaaugcugaugccuacguguucgugggcaccagcagauauuccaagaaauuuaagccugagauugcuauccggccgaaaguccgcgaccaggaggggagaaugaacuacuauuggacgcugauugaacccggagauaagaucacauucgaggccaccggcaaccugguugugccucgguacgcguuugccauggaacgcaaugcugggagcggaauuaucaucucugacacacccgugcaugauugcaacaccaccugucaaacaccugagggcgccauuaauacgucccuccccuuccagaacauccacccgauuaccaucggcagaugcccuaaauaugucaagagcacaaagcugcggcuugcuaccgggcugcgcaaugugcccucuauucagagcagaggacucuuuggcgccaucgccggguucaucgaaggaggcuggacagggaugguugacggaugguacggcuaucaucaccagaacgagcaaggcuccggguacgcugcggaccugaaaucuacccagaaugccauugauaagaucacgaacaaagugaauagcgucauugagaagaugaacacacaguuuaccgcugugggaaaagaguucaaucaccuugagaagcggaucgaaaaccugaauaagaaaguugacgauggcuuccucgacauuuggaccuacaacgccgagcugcuggugcuccuggaaaaugagcgcacacuugauuaucaugacuccaacgucaagaaccuguacgagaaagugagaaaucagcucaagaacaaugccaaagaaaucgggaacggauguuuugaguucuaucacaagugcgauaauaccuguauggaaagcgucaagaacggcacauacgacuauccuaaauacucugaggaagcuaagcugaaucgggagaaaaucgauggggugaaacuugaguccacgcgcauuuaucaaauccuggccauuuacagcaccguugcgucuucccucgugcuggucgugagccugggcgcuaucuccuuuuggaugugcucuaacggaagccuccagugcagaauuuguaucuga

SEQ ID NO: 195213 - RNA, 1701 nt, Artificial Sequence; identical to SEQ ID NO: 192907
  derived and/or modified sequence opt5 from hemagglutinin__InfluenzaA__AHZ40177

SEQ ID NO: 195214 - RNA, 1701 nt, Artificial Sequence; identical to SEQ ID NO: 192907
  derived and/or modified sequence opt5 from hemagglutinin__InfluenzaA__AHZ40189

SEQ ID NO: 195215 - RNA, 1701 nt, Artificial Sequence; identical to SEQ ID NO: 192907
  derived and/or modified sequence opt5 from hemagglutinin__InfluenzaA__AHZ40201

SEQ ID NO: 195216 - RNA, 1701 nt, Artificial Sequence; identical to SEQ ID NO: 192892
  derived and/or modified sequence opt5 from hemagglutinin__InfluenzaA__AHZ40213

SEQ ID NO: 195217 - RNA, 1701 nt, Artificial Sequence; identical to SEQ ID NO: 192859
  derived and/or modified sequence opt5 from hemagglutinin__InfluenzaA__AHZ40225

SEQ ID NO: 195218 - RNA, 1701 nt, Artificial Sequence
  derived and/or modified sequence opt5 from hemagglutinin__InfluenzaA__AHZ40237
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacccuugaauuuaauaacgagagcuucaauugggcuggagugacgcagaacggcaccucuuccgccugcauucgcggcagcaauucuuccuuuuucagcagacugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccaaucuuccggccggaucaccguuagcacgaagcgcucccagcaggcugugauuccgaacaucgggucuagaccccggauccgcaauauuccuagcagaaucuccauuuacuggacaaucgucaaacccggagauauucugcugaucaacagcaccggcaaucucaucgccccucggggguacuucaagauucgcucuggaaaauccagcaucaugagaucugacgcucccauuggcaaguguaagagcgaaugcaucacaccgaacggcuccauuccuaccgacaaacccuuucagaaugugaaccggaucaccuauggggccuguccucgcuacgugaagcaaucuacacugaaacuugcgacgggaaugagaaauguccccgagaagcagacccggggcaucuucggggccauugcuggauuuaucgaaaacggcugggaggggaugguugauggaugguauggcuuccgccaccagaauagcgagggcagagggcaagccgcugaccugaaauccacacaggccgccauugaucagaucaacggaaagcucaaucggcugauuggcaaaaccaacgaaaaguuccaccagaucgagaaggaauuuagcgagguggaagggcgcauucaagaccuugagaaauacguggaggauacaaagaucgaccuguggucuuauaaugcugaacuccuggucgcgcuggagaaccagcauaccaucgaucucacggacuccgaaaugaacaaacuguucgagaagaccaaaaagcagcuuagagaaaaugccgaggauaugggaaacggcugcuuuaagauuuaccacaaaugugacaaugcuugcaucgggagcauucggaacggcacauaugaucaugacguguacagagacgaggcccugaauaaccgcuuccagaucaagggaguugaacucaaaucuggcuacaaggauuggauucuguggaucuccuuugccaucagcugcuuccuucuguguguggcucuccugggguuuauuaugugggccugccaaaaaggaaauauccgguguaacauuugcaucuga

SEQ ID NO: 195219 - RNA, 1701 nt, Artificial Sequence; identical to SEQ ID NO: 192915
  derived and/or modified sequence opt5 from hemagglutinin__InfluenzaA__AHZ40249

SEQ ID NO: 195220 - RNA, 1701 nt, Artificial Sequence; identical to SEQ ID NO: 192882
  derived and/or modified sequence opt5 from hemagglutinin__InfluenzaA__AHZ40261

SEQ ID NO: 195221 - RNA, 1701 nt, Artificial Sequence; identical to SEQ ID NO: 193021
  derived and/or modified sequence opt5 from hemagglutinin__InfluenzaA__AHZ40273

SEQ ID NO: 195222 - RNA, 1701 nt, Artificial Sequence
  derived and/or modified sequence opt5 from hemagglutinin__InfluenzaA__AHZ40285
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucugacuccagcuuuuucucucggcugaacuggcucacacaucugaauuuuaaguauccugcccuuaacgucaccaugcccaauaacgagcaguucgauaagcuguacauuuggggcgugcaccauccugggacggacaaagaucagaucuuucucuaugcgcaagccuccggacgcauuacaguuagcaccaagagaucccagcagucugugaucccgaacauuggcagccggccccgcaucagaaauaucccuucccggauuagcaucuacuggacaauugucaaacccggggacauccugcugauuaacucuaccggaaaucucaucgcuccucgcggcuacuucaagauccaguccgggaaaagcucuauuaugagaagcgacacccccaucggaaaguguaacuccgaaugcauuacaccgaauggcucuaucccuaacgauaagcccuuucaaaaugugaaccggauuacguauggcgccuguccucgcuacgugaaacagaauacccugaaacuugcuacagggaugagaaacguccccgagaagcagacccggggaaucuucggcgccaucgcgggguuuauugaaaauggaugggagggcaugguugacgggugguauggauuccgccaccaaaacagcgagggcagaggccaggccgcugaucugaaguccacacaggccgcuaucgaccagauuaaugggaaacucaaccggcugaucggaaagaccaaugaaaaauuccaccaaauugagaaggaauuuagcgagguggaaggcagaauccaggaucuugagaaguacguggaggacacgaaaauugaucuguggucuuauaacgccgaacuccuggucgcccuggagaaccagcauacaaucgaccucaccgauuccgaaaugaauaagcuguucgagaaaaccaagaaacagcuucgcgaaaacgcugaggacauggggaauggaugcuuuaagaucuaccacaagugugauaacgcgugcauuggcagcauccggaaugggacauauaaccaugacguguacagagacgaggcccugaauaaccgcuuccaaauuaaaggcguugaacucaagucuggauacaaagauuggauccuguggauuuccuuugcuaucagcugcuuccuucuguguguggcccuccugggcuuuaucaugugggccugccagaaggggaauauucgguguaacaucugcauuuga

SEQ ID NO: 195223 - RNA, 1701 nt, Artificial Sequence; identical to SEQ ID NO: 193018
  derived and/or modified sequence opt5 from hemagglutinin__InfluenzaA__AHZ40297

SEQ ID NO: 195224 - RNA, 1701 nt, Artificial Sequence
  derived and/or modified sequence opt5 from hemagglutinin__InfluenzaA__AHZ40309
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauaacuccuuuuucucucgccugaauuggcucacccaucugaacuuuaaguauccugcccuuaacgucacaaugcccaauaacgagcaguucgacaagcuguacaucuggggcgugcaccauccugggaccgauaaagaccagauuuuucucuaugcgcagagcucuggaagaaucacgguuuccacaaagcggagccaacaggccgugauuccgaauaucggcucccgccccagaauccggaacauuccuucucgcaucagcauuuacuggaccaucgucaaacccggggauauucugcugaucaauuccacaggaaaccucaucgcuccuagaggcuacuucaagauucggaaugggaaaagcucuaucaugcgcuccgacgcccccauuggaaaguguaagagcgaaugcaucaccccgaacggcucuauuccuaaugacaaacccuuucagaacgugaauagaaucaccuauggcgcuuguccucgguacgugaagcagagcacacugaaacuugccacggggaugcgcaacguccccgagaagcaaaccagaggaaucuucggcgcgauugccggguuuaucgaaaauggaugggagggcaugguugaugggugguauggauuccggcaccagaacuccgagggcagaggccaggcugccgaccugaaaucuacacaagcugccauugaucagaucaaugggaagcucaaccgccugauuggaaaaaccaacgaaaaguuccaccagaucgagaaggaauuuagcgagguggaaggccggauucaggaccuugagaaauacguggaggauacaaagaucgaccugugguccuauaaugccgaacuccuggucgcucuggagaaccaacauaccaucgaucucacggacagcgaaaugaauaaacuguucgagaagaccaaaaagcagcuuagagaaaacgcggaggauauggggaauggaugcuuuaagauuuaccacaaaugugacaacgccugcaucggcucuauucgcaaugggacauaugaucaugacguguaccgggacgaggcucugaacaauagauuccagaucaagggcguugaacucaaauccggauacaaggauuggauucuguggaucagcuuugccaucucuugcuuccuucugugugugguccuccugggcuuuauuaugugggccugccagaaagggaacauccgcuguaauauuugcaucuga

SEQ ID NO: 195225 - RNA, 1701 nt, Artificial Sequence; identical to SEQ ID NO: 192907
  derived and/or modified sequence opt5 from hemagglutinin__InfluenzaA__AHZ40321

SEQ ID NO: 195226 - RNA, 1701 nt, Artificial Sequence; identical to SEQ ID NO: 192907
  derived and/or modified sequence opt5 from hemagglutinin__InfluenzaA__AHZ40333

SEQ ID NO: 195227 - RNA, 1701 nt, Artificial Sequence
  derived and/or modified sequence opt5 from hemagglutinin__InfluenzaA__AHZ40345
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuucugacaaacccuuucagaaugugaacagaaucaccuauggcgcuuguccucgguacgugaagcagagcacacugaaacuugccacggggaugcgcaauguccccgagaagcaaaccagaggaaucuucggcgcgauugccggguuuaucgaaaacggaugggagggcaugguugaugggugguauggauuccggcaccaaaauuccgagggcagaggccaggcugccgaccugaaaagcacacaggcugccauugaucagaucaacgggaagcucaaucgccugauuggaaaaaccaacgaaaaguuccaccagaucgagaaggaauuuucugagguggaaggccggauucaggaccuugagaaauacguggaggauacaaagaucgaccugugguccuauaaugccgaacuccuggucgcucuggagaaccaacauaccaucgaucucacggacagcgaaaugaacaaacuguucgagaagaccaaaaagcagcuuagagaaaaugcggaggauauggggaacggaugcuuuaagauuuaccacaaaugugacaaugccugcaucggcucuauucgcaacgggacauaugaucaugacguguaccgggacgaggcucugaauaacagauuccagaucaagggcguugaacucaaauccggauacaaggauuggauucuguggaucagcuuugccaucuccugcuuccuucuguguguggcccuccugggcuuuauuaugugggcuugccagaaagggaauauccgcuguaacauuugcaucuga

SEQ ID NO: 195228 - RNA, 1701 nt, Artificial Sequence; identical to SEQ ID NO: 192908
  derived and/or modified sequence opt5 from hemagglutinin__InfluenzaA__AHZ40357

SEQ ID NO: 195229 - RNA, 1701 nt, Artificial Sequence
  derived and/or modified sequence opt5 from hemagglutinin__InfluenzaA__AHZ40369
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggcgcuccagcaucaugagaucugacgcccccauuggaaaauguaagagcgaaugcaucaccccgaacggcuccauuccuaaugacaagcccuuucagaacgugaaucggaucaccuauggcgcuuguccucgcuacgugaaacagucuacacugaaacuugccacggggaugagaaacguccccgagaagcaaacccggggaaucuucggcgcgauugccggguuuaucgaaaauggaugggagggcaugguugaugggugguauggauucagacaccagaacagcgagggccgcggccaggcugccgaccugaaguccacacaagcugccauugaucagaucaaugggaaacucaaccggcugauuggaaagaccaaugaaaaauuccaccagaucgagaaggaauuuagcgagguggaaggccgcauucaggaccuugagaaguacguggaggauacaaaaaucgaccuguggucuuauaacgccgaacuccuggucgcucuggagaaccaacauaccaucgaucucacggacuccgaaaugaauaagcuguucgagaaaacaaagaaacagcuuagagaaaacgcggaggauauggggaauggaugcuuuaagauuuaccacaagugugacaacgccugcaucggcagcauucggaaugggaccuaugaucaugacguguacagagacgaggcucugaacaaucgcuuccagaucaaaggcguugaacucaagucuggauacaaagauuggauucuguggaucuccuuugccaucagcugcuuccuucuguguguggcccuccugggcuuuauuaugugggcuugccagaaggggaacauccgguguaauauuugcaucuga

SEQ ID NO: 195230 - RNA, 1701 nt, Artificial Sequence; identical to SEQ ID NO: 193018
  derived and/or modified sequence opt5 from hemagglutinin__InfluenzaA__AHZ40381

SEQ ID NO: 195231 - RNA, 1701 nt, Artificial Sequence; identical to SEQ ID NO: 192907
  derived and/or modified sequence opt5 from hemagglutinin__InfluenzaA__AHZ40393

SEQ ID NO: 195232 - RNA, 1701 nt, Artificial Sequence; identical to SEQ ID NO: 192907
  derived and/or modified sequence opt5 from hemagglutinin__InfluenzaA__AHZ40405

SEQ ID NO: 195233 - RNA, 1701 nt, Artificial Sequence; identical to SEQ ID NO: 192907
  derived and/or modified sequence opt5 from hemagglutinin__InfluenzaA__AHZ40417

SEQ ID NO: 195234 - RNA, 1701 nt, Artificial Sequence
  derived and/or modified sequence opt5 from hemagglutinin__InfluenzaA__AHZ40429
augaagaccaucauugcccugagcuacauccucugccugguguucgcucaggagcuucccggcaacgacgauuccacagccacgcugugucucgggcaccaugcggucccuaauggaaccauuguuaaaacaaucaccaacgaccaaauugaagugacaaaugcuaccgagcuggugcagucuagcuccacaggcgaaaucugcaacucuccgcaccagauccuugauggggagaauuguacccugauugacgcccuccugggagauccccagugcgacggcuuucaaaacaagaaaugggaucuguucgucgaaagaagcaaggcccauuccaauuguuauccuuacgacgugcccgauuaugcuucucuccggagccugguugccuccagcgggacgcuugaguuuaaaaacgagucuuucaauuggaccggagugacacagaacggcaccuccagcgcuugcauccgcagaucuaauaacuccuuuuucagccggcugaauuggcucacacaccugaacuuuaaguacccugcccuuaaugucaccaugcccaacaacgaacaguucgacaagcuguauauuuggggcgugcaucacccugggacggauaaagaccagaucuuucucuacgcgcaagccucuggacgcauuacaguuuccaccaagagaagccagcaggcugugaucccgaauauuggcucccggccccgcgucagaaacaucccuucucgggugagcaucuauuggacaauugugaaacccggggauauccugcugauuaauuccaccggaaaccucaucgccccucgcggcuacuucaagauuagaagcgggaaaucuuccaucaugcggagcgacgcucccaucggaaaguguaauucugccugcauuaccccgaacggcagcaucccuaaugacaagcccuuucagaacgucaaucgcauuacauacggcgcguguccuagauauguuaaacaaaacacgcugaaacuugccaccgggaugcggaaugugcccgagaagcagacacgcggaaucuucggcgcuauugccggguuuaucgaaaacggaugggagggcaugguggaugggugguacggauucagacaccaaaauuccgagggccggggccaggcugccgaccugaagucuacccaggccgcuaucgaucagauuaacgggaaacucaauagacugaucggaaagacaaacgaaaaauuccaucagauugagaaggaauuuagcgaggucgaaggccgcauccaagaccuugagaaguauguggaggauaccaaaauugaccugugguccuacaacgcggaacuccugguugcccuggagaaucagcacacgaucgaucucacagacagcgaaaugaacaagcuguucgagaaaaccaagaaacagcuucgggaaaaugcugaggauauggggaacggaugcuuuaagauuuaucauaagugugacaaugccugcaucggcucuaucagaaacgggaccuacgaucacgacguguaucgcgacgaggcccugaauaaccgguuccagauuaaaggcgucgaacucaaguccggauacaaagauuggauccuguggauuagcuuugcuaucucuugcuuccuucuguguguggcccuccugggcuuuauuaugugggcgugccaaaaggggaauaucagauguaacaucugcauuuga

SEQ ID NO: 195235 - RNA, 1701 nt, Artificial Sequence; identical to SEQ ID NO: 192907
  derived and/or modified sequence opt5 from hemagglutinin__InfluenzaA__AHZ40441

SEQ ID NO: 195236 - RNA, 1701 nt, Artificial Sequence; identical to SEQ ID NO: 193050
  derived and/or modified sequence opt5 from hemagglutinin__InfluenzaA__AHZ40453

SEQ ID NO: 195237 - RNA, 1701 nt, Artificial Sequence
  derived and/or modified sequence opt5 from hemagglutinin__InfluenzaA__AHZ40465
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacaugcccgauuacgcuucccuccgcucucugguggccagcuccgggacccuugaauuuaauaacgagagcuucaauuggacgggaguuacccaaaacggcacaucuuccgcuugcauuagacggagcaauucuuccuuuuucagccgccugaacuggcucacccaucugaauuuuaaguauccugcccuuaacgugacaaugcccaacaaugagagauucgacaagcuguacaucuggggcguccaccauccugggaccgauaaagaccagauuuuucucuaugcgcagucuuccggacggaucacggugagcacaaagcgcucccagcaagccguuauuccgaacaucggcucuagaccccggauccgcaauauuccuagcagaaucuccauuuacuggaccaucgugaaacccggggauauucugcugaucaacagcacaggaaaucucaucgcuccucggggcuacuucaagauucgcucugggaaauccagcaucaugagaucugacgcccccauuggaaaguguaagagcgaaugcaucaccccgaacggcuccauuccuaaugacaaacccuuucagaacgucaaucggaucaccuauggcgcuuguccucgcuacgugaagcagucuacacugaaacuugccacggggaugagaaacgugcccgagaagcagacccggggaaucuucggcgcgauugccggguuuaucgaaaauggaugggagggcauggucgaugggugguauggauucagacaccaaaacagcgagggccgcggccaggcugccgaccugaaauccacacaggcugccauugaucaaaucaaugggaagcucaaccggcugauuggaaaaaccaaugaaaaguuccaccagaucgagaaggaauuuagcgagguugaaggccgcauucaggaccuugagaaauacguggaggauacaaagaucgaccuguggucuuauaacgccgaacuccugguggcucuggagaaccagcauaccaucgaucucacggacuccgaaaugaauaaacuguucgagaagaccaaaaagcaacuuagagaaaacgcggaggauauggggaauggaugcuuuaagauuuaccacaaaugugacaacgccugcaucggcagcauucggaaugggacauaugaucauaacgucuacagagacgaggcucugaauaaccgcuuccagaucaagggcguggaacucaaaucuggauacaaggacuggauucuguggaucuccuuugccaucagcugcuuccuucuguguguugcccuccugggcuuuauuaugugggcuugccagaaagggaauauccgguguaacauuugcaucuga

SEQ ID NO: 195238 - RNA, 1701 nt, Artificial Sequence; identical to SEQ ID NO: 192908
  derived and/or modified sequence opt5 from hemagglutinin__InfluenzaA__AHZ40477

SEQ ID NO: 195239 - RNA, 1701 nt, Artificial Sequence; identical to SEQ ID NO: 193084
  derived and/or modified sequence opt5 from hemagglutinin__InfluenzaA__AHZ40489

SEQ ID NO: 195240 - RNA, 1701 nt, Artificial Sequence; identical to SEQ ID NO: 192907
  derived and/or modified sequence opt5 from hemagglutinin__InfluenzaA__AHZ40500

SEQ ID NO: 195241 - RNA, 1701 nt, Artificial Sequence; identical to SEQ ID NO: 192907
  derived and/or modified sequence opt5 from hemagglutinin__InfluenzaA__AHZ40512

SEQ ID NO: 195242 - RNA, 1701 nt, Artificial Sequence
  derived and/or modified sequence opt5 from hemagglutinin__InfluenzaA__AHZ40524
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagcgccaaacgagaggcaucuucggggccauugcuggauuuaucgaaaauggcugggaggggaugguugauggaugguauggcuuccggcaccagaacagcgagggcagagggcaggccgcugaccugaaguccacccaagccgccauugaucagaucaauggaaaacucaaccgccugauuggcaagacaaaugaaaaauuccaccagaucgagaaggaauuuagcgagguggaagggcggauucaggaccuugagaaguacguggaggauaccaaaaucgaccuguggucuuauaacgcugaacuccuggucgcgcuggagaaccaacauacaaucgaucucaccgacuccgaaaugaauaagcuguucgagaaaacgaagaaacagcuuagagaaaacgccgaggauaugggaaauggcugcuuuaagauuuaccacaagugugacaacgcuugcaucgggagcauucgcaauggcacauaugaucaugacguguaccgggacgaggcccugaacaauagauuccagaucaaaggaguugaacucaagucuggcuacaaagauuggauucuguggaucuccuuugccaucagcugcuuccuucuguguguggcucuccugggguuuauuaugugggccugccagaagggaaacauccgcuguaauauuugcaucuga

SEQ ID NO: 195243 - RNA, 1701 nt, Artificial Sequence; identical to SEQ ID NO: 194794
  derived and/or modified sequence opt5 from hemagglutinin__InfluenzaA__AHZ40536

SEQ ID NO: 195244 - RNA, 1701 nt, Artificial Sequence; identical to SEQ ID NO: 192907
  derived and/or modified sequence opt5 from hemagglutinin__InfluenzaA__AHZ40548

SEQ ID NO: 195245 - RNA, 1701 nt, Artificial Sequence; identical to SEQ ID NO: 192882
  derived and/or modified sequence opt5 from hemagglutinin__InfluenzaA__AHZ40572

SEQ ID NO: 195246 - RNA, 1701 nt, Artificial Sequence; identical to SEQ ID NO: 192882
  derived and/or modified sequence opt5 from hemagglutinin__InfluenzaA__AHZ40583

SEQ ID NO: 195247 - RNA, 1701 nt, Artificial Sequence
  derived and/or modified sequence opt5 from hemagglutinin__InfluenzaA__AHZ40595
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacgacgggaaacuguguaaacuuagaggaguugcuccccugcaucucggcaagugcaauaucgccggguggauucugggaaacccugagugugaaucucugagcacagccuccucuuggagcuacaucguggagaccuccggcucugauaaugggacgugcuauccgggagacuuuauugauuacgaggaacuccgggagcagcugagcuccgucagcucuuucgaacgcuuugagaucuuccccaagaccuccagcuggccuaaccacgacucuaauaagggcgugacagccgcuuguccccaugccggcgcgaaaggguuuuauaagaaccuuaucuggcugguuaaaaagggaaauuccuacccuaaacucagcauuucuuauaucaacgauaagggcaaggaagugcugguccuuugggggauucaccaccccuccaccacagccgaccaacagagccuguaccagaaugcugauaccuacguguucgugggaacguccagauauucuaaaaaguuuaaaccugagaucgccauucggccgaagguccgcgaccaggagggcagaaugaacuacuauuggacacucguugaacccggggauaaaaucaccuucgaggcuacaggaaaucugguggugccucgguacgccuuugcgaugaagcgcaacgccggcagcggcauuaucaucuccgacacccccguccaugacugcaacaccacaugucaaacgccuaaaggggcuauuaauaccagccugcccuuccagaacauccacccgauuacaaucggaaagugcccuaaguaugugaaaucuaccaagcucagacuggccacaggccuucggaauguucccuccauucagagccgcgggcuguuuggagcuaucgccggcuucaucgaagggggauggaccggcaugguggauggcugguacggguaucaucaccagaacgagcaaggaucuggcuacgccgcugaccucaaaagcacgcagaaugcgauugauaagaucacaaacaaagucaauuccgugauugaaaagaugaacacccaguuuaccgccguugggaaggaguucaaucaccuggagaaaagaaucgaaaaccuuaauaagaaaguggacgauggauuccuggacauuuggacauacaacgcugagcuccugguccugcucgaaaaugagcggacccuggauuaucaugacucuaacgugaagaaucuuuacgaaaaaguccgcaaccagcugaagaacaaugccaaggagaucggcaacggguguuuugaguucuaucacaaaugcgauaauacauguauggaaagcgugaagaacggcacguacgacuauccuaaauacuccgaggaagccaagcucaauagagagaaaaucgauggaguuaagcuggaaagcacccggauuuaucaaauccuugcuauuuacucuacagccgcguccagccuggugcucgucgugucucugggcgcuaucuccuuuuggaugugcagcaacgggucccugcagugccgcauuuguaucuga

SEQ ID NO: 195248 - RNA, 1701 nt, Artificial Sequence
  derived and/or modified sequence opt5 from hemagglutinin__InfluenzaA__AHZ40606
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagucuacacugaaacuugccacggggaugcgcaacguccccgagaagcaaaccagaggaaucuucggcgcgauugccggguuuaucgaaaauggaugggagggcaugauggaugggugguauggauuccggcaccagaacagcgagggcagaggccaggcugccgaccugaaauccacacaagcugccauugaucagaucaaugggaagcucaaccgccugauuggaaaaaccaaugaaaaguuccaccagaucgagaaggaauuuagcgagguugaaggccggauucaggaccuugagaaauacguggaggauacaaagaucgaccuguggucuuauaacgccgaacuccugguggcucuggagaaccaacauaccaucgaucucacggacuccgaaaugaauaaacuguucgagaagaccaaaaagcagcuuagagaaaacgcggaggauauggggaauggaugcuuuaagauuuaccacaaaugugacaacgccugcaucggcagcauucgcaaugggacauaugaucaugacgucuaccgggacgaggcucugaacaauagauuccagaucaagggcguggaacucaaaucuggauacaaggauuggauucuguggaucuccuuugccaucagcugcuuccuucuguguguugcccuccugggcuuuauuaugugggcuugccagaaagggaacauccgcuguaauauuugcaucuga

SEQ ID NO: 195249 - RNA, 1701 nt, Artificial Sequence; identical to SEQ ID NO: 192907
  derived and/or modified sequence opt5 from hemagglutinin__InfluenzaA__AHZ40618

SEQ ID NO: 195250 - RNA, 1701 nt, Artificial Sequence; identical to SEQ ID NO: 192946
  derived and/or modified sequence opt5 from hemagglutinin__InfluenzaA__AHZ40626

SEQ ID NO: 195251 - RNA, 1701 nt, Artificial Sequence; identical to SEQ ID NO: 192907
  derived and/or modified sequence opt5 from hemagglutinin__InfluenzaA__AHZ40638

SEQ ID NO: 195252 - RNA, 1701 nt, Artificial Sequence; identical to SEQ ID NO: 192882
  derived and/or modified sequence opt5 from hemagglutinin__InfluenzaA__AHZ40650

SEQ ID NO: 195253 - RNA, 1701 nt, Artificial Sequence
  derived and/or modified sequence opt5 from hemagglutinin__InfluenzaA__AHZ40662
augaagaccaucauugcccugagcuacauccucugccugguguucgcucaggagcuucccggcaacgacgauuccacagccacgcugugucucgggcaccaugcggucccuaauggaaccauuguuaaaacaaucaccaacgacagaauugaagugacaaaugcuaccgagcuggugcaaucuagcuccacaggcgaaaucugcaacucuccgcaccagauccuugauggggagaauuguacccugauugacgcccuccugggagauccccagugcgacggcuuucagaacaagaaaugggaucuguucgucgaacggagcaaggcccauuccaauuguuauccuuacgacgugcccgauuaugcuucucuccgcagccugguugccuccagcgggacgcuugaguuuaacaaugagucuuucaacuggaccggagugacacaaaauggcaccuccagcgcuugcaucagacggucuaacaauuccuuuuucagccgccugaacuggcucacacaccugaauuuuaaauacccugcccuuaacgucaccauucccaacaaugaacaguucgacaagcuguauaucuggggcgugcaucacccugggacggauaaggaccagauuuuucucuacgcgcaggccucuggaagaaucacaguuuccaccaaacggagccaacagacagugauuccgaacaucggcucccgccccagaguccggaauaucccuucucgcgugagcauuuauuggaccaucgugaagcccggggauauucugcugaucaacuccaccggaaaucucauugcuccuagaggcuacuucaaaauccggagcgggaagucuuccaucaugcgcagcgacgcccccauuggaaaauguaacucugcuugcaucacaccgaauggcagcauuccuaacgacaagcccuuucagaaugucaacagaaucacguacggcgccuguccucgguauguuaagcagaauacccugaaacuugcgacagggaugcgcaacgugcccgagaagcaaaccagaggaauuuucggcgccaucgcuggguuuaucgaaaauggaugggagggcaugguggaugggugguacggauuccggcaccagaacuccgagggcagaggccaggccgcugaccugaaaucuacacaagccgccauugaucagaucaaugggaagcucaaccgccugauuggaaaaaccaacgaaaaguuccaucagaucgagaaagaauuuagcgaggucgaaggccggauucaggaccuugagaaguauguggaggauacgaagaucgaccugugguccuacaaugcugaacuccugguugcgcuggagaaccaacacacaauugaucucaccgacagcgaaaugaauaaacuguucgagaagaccaaaaagcagcuuagagaaaacgccgaggauauggggaauggaugcuuuaaaaucuaucauaagugugacaacgcuugcaucggcucuauucgcaaugggacauacgaucacgacguguaucgggacgaggcccugaacaauagauuccagaucaagggcgucgaacucaaauccggauacaaggauuggauucuguggaucagcuuugccauuucuugcuuccuucuguguguggcucuccugggcuuuaucaugugggccugccagaaagggaacauccgcuguaauauuugcaucuga

SEQ ID NO: 195254 - RNA, 1701 nt, Artificial Sequence; identical to SEQ ID NO: 192927
  derived and/or modified sequence opt5 from hemagglutinin__InfluenzaA__AHZ40674

SEQ ID NO: 195255 - RNA, 1701 nt, Artificial Sequence; identical to SEQ ID NO: 192907
  derived and/or modified sequence opt5 from hemagglutinin__InfluenzaA__AHZ40686

SEQ ID NO: 195256 - RNA, 1701 nt, Artificial Sequence; identical to SEQ ID NO: 192892
  derived and/or modified sequence opt5 from hemagglutinin__InfluenzaA__AHZ40698

SEQ ID NO: 195257 - RNA, 1701 nt, Artificial Sequence; identical to SEQ ID NO: 192892
  derived and/or modified sequence opt5 from hemagglutinin__InfluenzaA__AHZ40710

SEQ ID NO: 195258 - RNA, 1701 nt, Artificial Sequence; identical to SEQ ID NO: 193018
  derived and/or modified sequence opt5 from hemagglutinin__InfluenzaA__AHZ40722

SEQ ID NO: 195259 - RNA, 1701 nt, Artificial Sequence; identical to SEQ ID NO: 192915
  derived and/or modified sequence opt5 from hemagglutinin__InfluenzaA__AHZ40734

SEQ ID NO: 195260 - RNA, 1701 nt, Artificial Sequence; identical to SEQ ID NO: 193018
  derived and/or modified sequence opt5 from hemagglutinin__InfluenzaA__AHZ40746

SEQ ID NO: 195261 - RNA, 1701 nt, Artificial Sequence; identical to SEQ ID NO: 195211
  derived and/or modified sequence opt5 from hemagglutinin__InfluenzaA__AHZ40758

SEQ ID NO: 195262 - RNA, 1701 nt, Artificial Sequence; identical to SEQ ID NO: 185691
  derived and/or modified sequence opt5 from hemagglutinin__InfluenzaA__AHZ40782

SEQ ID NO: 195263 - RNA, 1701 nt, Artificial Sequence; identical to SEQ ID NO: 185691
  derived and/or modified sequence opt5 from hemagglutinin__InfluenzaA__AHZ40793

SEQ ID NO: 195264 - RNA, 1701 nt, Artificial Sequence; identical to SEQ ID NO: 185691
  derived and/or modified sequence opt5 from hemagglutinin__InfluenzaA__AHZ40804

SEQ ID NO: 195265 - RNA, 1701 nt, Artificial Sequence
  derived and/or modified sequence opt5 from hemagglutinin__InfluenzaA__AHZ40815
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccccguccucugacaacggcacgugcuaucccggggauuuuauugacuacgaagaacugcgggagcagcuuagcuccgucagcucuuucgaacgcuuugagaucuucccuaagaccuccagcuggcccaaucacgauucuaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcagcuccagauauagcaagaaauuuaagccggagauugcuauccggcccaaaguccgcgauagagaggggcggaugaauuacuauuggacacugguugaaccuggagacaagauuaccuucgaggccacgggcaaccugguggugccccgcuacgcguuugccauggaaagaaacgcugggucuggaaucauuaucuccgauacaccuguccaugacugcaauaccacaugucagacccccaaaggcgccaucaacaccagccucccguuccaaaauauucacccuaucacaauuggcaagugccccaaguaugugaaaucuacgaagcugcggcuugcuaccgggcugcgcaacaucccuagcauucaguccagaggacucuuuggcgccaucgccggguucaucgagggaggcuggacagggaugguugacggaugguacggcuaucaucaccagaaugaacagggcucuggguacgcugcggaucugaaaagcacccaaaacgccauugacgagaucacaaauaaggugaacuccgucauugagaaaaugaauacccaguuuacggcugugggaaaggaguucaaccaccuugagaagcggaucgaaaaucugaacaaaaagguugaugacggcuuccucgauauuuggacauacaaugccgagcugcuggugcuccuggaaaacgagcgcacccuugacuaucaugauagcaaugucaaaaaccuguacgagaaggugagaucucagcucaaaaacaaugccaaggaaaucgggaacggauguuuugaguucuaucacaagugcgacaauaccuguauggaauccgucaaaaacggcacauacgauuaucccaaguacagcgaggaagcuaaacugaaucgggaggagaucgacggggugaaacuugaaucuacccgcauuuaucagauccuggccauuuacuccacaguugcgagcucccucgugcuggucgugucucugggcgcuaucagcuuuuggaugugcuccaacggaucucuccaaugcagaauuuguaucuga

SEQ ID NO: 195266 - RNA, 1701 nt, Artificial Sequence
  derived and/or modified sequence opt5 from hemagglutinin__InfluenzaA__AHZ40826
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccccguccucugacaacggcacgugcuaucccggggauuuuauugacuacgaagaacugcgggagcagcuuagcuccgucagcucuuucgaacgcuuugagaucuucccuaagaccuccagcuggcccaaucacgauucuaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucuauuuaccagaacgcugacgccuacguguucgugggcagcuccagauauagcaagaaauuuaagccggagaucgcuauucggcccaaaguccgcgaucaggaggggagaaugaauuacuauuggacacucguugaaccuggagacaagaucaccuucgaggccacgggcaaccugguggugccccgguacgcguuugccauggaacgcaacgcugggucuggaauuaucaucuccgauacaccuguccaugacugcaauaccacaugucaaacccccaaaggcgccauuaacaccagccugccguuccagaauauccacccuauuacaaucggcaagugccccaaguaugugaaaucuacgaagcucagacuggcuaccgggcuucggaacauuccuagcauccagucccgcggacuguuuggcgccaucgccggguucauugagggaggcuggacagggaugguugacggaugguacggcuaucaucaccagaaugaacaaggcucuggguacgcugcggaucucaaaagcacccagaacgccaucgacgagauuacaaauaaggugaacuccgucaucgagaaaaugaauacccaguuuacggcugugggaaaggaguucaaccaccuggagaagagaauugaaaaucuuaacaaaaagguugaugacggcuuccuggauaucuggacauacaaugccgagcuccuggugcugcucgaaaacgagcggacccuggacuaucaugauagcaaugucaaaaaccuuuacgagaaggugcgcucucagcugaaaaacaaugccaaggaaaucgggaacggauguuuugaguucuaucacaagugcgacaauaccuguauggaauccgucaaaaacggcacauacgauuaucccaaguacagcgaggaagcuaaacucaauagagaggagauugacggggugaagcuggaaucuacccggaucuaucaaauucuugccaucuacuccacaguugcgagcucccuggugcucgucgugucucugggcgcuauuagcuuuuggaugugcuccaacggaucucugcagugccgcaucuguauuuga

SEQ ID NO: 195267 - RNA, 1701 nt, Artificial Sequence
  derived and/or modified sequence opt5 from hemagglutinin__InfluenzaA__AHZ40848
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccccguccucugacaacggcacgugcuaucccggggauuuuauugacuacgaagaacugcgggagcagcuuagcuccgucagcucuuucgaacgcuuugagaucuucccuaagaccuccagcuggcccaaucacgauucuaacaagggagugacagccgcuuguccucaugccggcgcgaaauccuuuuauaagaaucugaucuggcucguuaaagaaggcaacagcuaccccaagcugucuaaauccuauauuaaugacaaggggaaggaggugcuuguccuguggggaauccaccacccuagcaccuccgccgagcaacagucucucuaccagaacgcugaugccuacguguucgugggcagcuccagauauagcaaaaaguuuaaaccggaaauugcugcccggcccaagguccgcgggcaggcgggaagaaugaauuacuauuggacacugguugagccuggcgacaaaaucaccuucgaagccacggggaaccugguggugccccgguacgcuuuugccauggagcgcaacgcuggaucuggcauuaucauuuccgauacaccuguccaugacugcaauaccacaugucaaacccccaagggcgccaucaacaccagccucccguuccagaauauccacccuauuacaaucgggaaaugccccaaguaugugaagucuacgaaacugagacuugccaccggacugcggaacauuccuagcauccagucccgcggccucuuuggggcuauugcgggauucaucgaaggcggguggacaggaaugguugauggcugguacggcuaucaucaccagaaugagcaagggucuggauacgccgcugaccuuaagagcacccagaacgccaucgacgagauuacaaauaaagugaacuccgucaucgaaaagaugaauacccaguuuacggccgugggcaaagaguucaaccaccuggaaaagagaauugagaaucugaacaagaaaguugaugacggguuccucgauaucuggacauacaaugcugaacugcuggugcuccuggagaacgagcggacccuugacuaucaugauagcaaugucaagaaccuguacgaaaaagugcgcucucagcucaagaacaaugccaaagagauuggaaacggcuguuuugaguucuaucacaagugcgacaauaccuguauggaguccgucaagaacgggacauacgauuaucccaaauacagcgaagaggcgaagcugaauagagaggaaaucgacggcgugaaacuugagucuacccggaucuaucaaauucuggcuaucuacuccacaguugccagcucccucgugcuggucgugucucugggagccauuagcuuuuggaugugcuccaacggcucucuccagugccgcaucuguauuuga

SEQ ID NO: 195268 - RNA, 1701 nt, Artificial Sequence
  derived and/or modified sequence opt5 from hemagglutinin__InfluenzaA__AHZ40881
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccccguccucugacaacggcacgugcuaucccggggauuuuauugacuacgaagaacugcgggagcagcuuagcuccgucagcucuuucgaacgcuuugagaucuucccuaagaccuccagcuggcccaaucacgauucuaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgagcaacagucucucuaccagaacgcugaugccuacguguucgugggcagcuccagauauagcaagaaauuuaagccggagauugcugcccggcccaaaguccgcgggcaggcgggaagaaugaauuacuauuggacacugguugaaccuggcgacaagaucaccuucgaggccacggggaaccugguggugccccgguacgcuuuugccauggaacgcaacgcuggaucuggcauuaucauuuccgauacaccuguccaugacugcaauaccacaugucaaacccccaaaggcgccaucaacaccagccucccguuccagaauauccacccuauuacaaucgggaagugccccaaguaugugaaaucuacgaagcugagacuugccaccggacugcggaacauuccuagcauccagucccgcggccucuuuggggcuauugcgggauucaucgagggcggguggacaggaaugguugauggcugguacggcuaucaucaccagaaugaacaagggucuggauacgccgcugaccugaaaagcacccagaacgccaucgacgagauuacaaauaaggugaacuccgucaucgagaaaaugaauacccaguuuacggccgugggcaaggaguucaaccaccuugagaagagaauugaaaaucugaacaaaaagguugaugacggguuccucgauaucuggacauacaaugcugagcugcuggugcuccuggaaaacgagcggacccuugacuaucaugauagcaaugucaaaaaccuguacgagaaggugcgcucucagcucaaaaacaaugccaaggaaauuggaaacggcuguuuugaguucuaucacaagugcgacaauaccuguauggaauccgucaaaaacgggacauacgauuaucccaaguacagcgaggaagcgaaacugaauagagaggagaucgacggcgugaaacuugaaucuacccggaucuaucaaauucuggcuaucuacuccacaguugccagcucccucgugcuggucgugucucugggagccauuagcuuuuggaugugcuccaacggcucucuccagugccgcaucuguauuuga

SEQ ID NO: 195269 - RNA, 1701 nt, Artificial Sequence; identical to SEQ ID NO: 195268
  derived and/or modified sequence opt5 from hemagglutinin__InfluenzaA__AHZ40892

SEQ ID NO: 195270 - RNA, 1701 nt, Artificial Sequence; identical to SEQ ID NO: 195267
  derived and/or modified sequence opt5 from hemagglutinin__InfluenzaA__AHZ40914

SEQ ID NO: 195271 - RNA, 1701 nt, Artificial Sequence; identical to SEQ ID NO: 195268
  derived and/or modified sequence opt5 from hemagglutinin__InfluenzaA__AHZ40925

SEQ ID NO: 195272 - RNA, 1701 nt, Artificial Sequence
  derived and/or modified sequence opt5 from hemagglutinin__InfluenzaA__AHZ40936
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccccguccucugacaacggcacgugcuaucccggggauuuuauugacuacgaagaacugcgggagcagcuuagcuccgucagcucuuucgaacgcuuugagaucuucccuaagaccuccagcuggcccaaucacgauucuaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgagcaacagucucucuaccagaacgcugaugccuacguguucgugggcagcuccagauauagcaagaaauuuaagccggagauugcugcccggcccaaaguccgcgaccaggcggggagaaugaauuacuauuggacacugguugaaccuggagauaagaucaccuucgaggccacgggcaaccugguggugccccgguacgcuuuugccauggaacgcaacgcugggucuggaauuaucauuuccgacacaccuguccaugauugcaauaccacaugucaaacccccaaaggcgccaucaacaccagccucccguuccagaauauccacccuauuacaaucggcaagugccccaaguaugugaaaucuacgaagcugagacuugccaccgggcugcggaacauuccuagcauccagucccgcggacucuuuggcgcuauugcgggguucaucgagggaggcuggacagggaugguugacggaugguacggcuaucaucaccagaaugaacaaggcucuggguacgccgcugaccugaaaagcacccagaacgccaucgaugagauuacaaauaaggugaacuccgucaucgagaaaaugaauacccaguuuacggccgugggaaaggaguucaaccaccuugagaagagaauugaaaaucugaacaaaaagguugacgauggcuuccucgacaucuggacauacaaugcugagcugcuggugcuccuggaaaacgagcggacccuugauuaucaugacagcaaugucaaaaaccuguacgagaaggugcgcucucagcucaaaaacaaugccaaggaaauugggaacggauguuuugaguucuaucacaagugcgauaauaccuguauggaauccgucaaaaacggcacauacgacuaucccaaguacagcgaggaagcgaaacugaauagagaggagaucgauggggugaaacuugaaucuacccggaucuaucaaauucuggcuaucuacuccacaguugccagcucccucgugcuggucgugucucugggcgccauuagcuuuuggaugugcuccaacggaucucuccagugccgcaucuguauuuga

SEQ ID NO: 195273 - RNA, 1701 nt, Artificial Sequence; identical to SEQ ID NO: 195267
  derived and/or modified sequence opt5 from hemagglutinin__InfluenzaA__AHZ40947

SEQ ID NO: 195274 - RNA, 1701 nt, Artificial Sequence; identical to SEQ ID NO: 195268
  derived and/or modified sequence opt5 from hemagglutinin__InfluenzaA__AHZ40958

SEQ ID NO: 195275 - RNA, 1701 nt, Artificial Sequence; identical to SEQ ID NO: 195272
  derived and/or modified sequence opt5 from hemagglutinin__InfluenzaA__AHZ40969

SEQ ID NO: 195276 - RNA, 1701 nt, Artificial Sequence; identical to SEQ ID NO: 195272
  derived and/or modified sequence opt5 from hemagglutinin__InfluenzaA__AHZ40980

SEQ ID NO: 195277 - RNA, 1701 nt, Artificial Sequence; identical to SEQ ID NO: 195272
  derived and/or modified sequence opt5 from hemagglutinin__InfluenzaA__AHZ40991

SEQ ID NO: 195278 - RNA, 1701 nt, Artificial Sequence; identical to SEQ ID NO: 195272
  derived and/or modified sequence opt5 from hemagglutinin__InfluenzaA__AHZ41002

SEQ ID NO: 195279 - RNA, 1701 nt, Artificial Sequence; identical to SEQ ID NO: 195272
  derived and/or modified sequence opt5 from hemagglutinin__InfluenzaA__AHZ41013

SEQ ID NO: 195280 - RNA, 1701 nt, Artificial Sequence; identical to SEQ ID NO: 195268
  derived and/or modified sequence opt5 from hemagglutinin__InfluenzaA__AHZ41024

SEQ ID NO: 195281 - RNA, 1701 nt, Artificial Sequence; identical to SEQ ID NO: 195268
  derived and/or modified sequence opt5 from hemagglutinin__InfluenzaA__AHZ41035

SEQ ID NO: 195282 - RNA, 1701 nt, Artificial Sequence; identical to SEQ ID NO: 195268
  derived and/or modified sequence opt5 from hemagglutinin__InfluenzaA__AHZ41046

SEQ ID NO: 195283 - RNA, 1701 nt, Artificial Sequence; identical to SEQ ID NO: 195268
  derived and/or modified sequence opt5 from hemagglutinin__InfluenzaA__AHZ41057

SEQ ID NO: 195284 - RNA, 1701 nt, Artificial Sequence; identical to SEQ ID NO: 195268
  derived and/or modified sequence opt5 from hemagglutinin__InfluenzaA__AHZ41068

SEQ ID NO: 195285 - RNA, 1701 nt, Artificial Sequence; identical to SEQ ID NO: 195272
  derived and/or modified sequence opt5 from hemagglutinin__InfluenzaA__AHZ41079

SEQ ID NO: 195286 - RNA, 1701 nt, Artificial Sequence; identical to SEQ ID NO: 195268
  derived and/or modified sequence opt5 from hemagglutinin__InfluenzaA__AHZ41090

SEQ ID NO: 195287 - RNA, 1701 nt, Artificial Sequence; identical to SEQ ID NO: 195272
  derived and/or modified sequence opt5 from hemagglutinin__InfluenzaA__AHZ41101

SEQ ID NO: 195288 - RNA, 1701 nt, Artificial Sequence; identical to SEQ ID NO: 195268
  derived and/or modified sequence opt5 from hemagglutinin__InfluenzaA__AHZ41112

SEQ ID NO: 195289 - RNA, 1701 nt, Artificial Sequence; identical to SEQ ID NO: 195268
  derived and/or modified sequence opt5 from hemagglutinin__InfluenzaA__AHZ41123

SEQ ID NO: 195290 - RNA, 1701 nt, Artificial Sequence; identical to SEQ ID NO: 195268
  derived and/or modified sequence opt5 from hemagglutinin__InfluenzaA__AHZ41134

SEQ ID NO: 195291 - RNA, 1701 nt, Artificial Sequence; identical to SEQ ID NO: 195268
  derived and/or modified sequence opt5 from hemagglutinin__InfluenzaA__AHZ41145

SEQ ID NO: 195292 - RNA, 1701 nt, Artificial Sequence; identical to SEQ ID NO: 195268
  derived and/or modified sequence opt5 from hemagglutinin__InfluenzaA__AHZ41156

SEQ ID NO: 195293 - RNA, 1701 nt, Artificial Sequence; identical to SEQ ID NO: 195268
  derived and/or modified sequence opt5 from hemagglutinin__InfluenzaA__AHZ41167

SEQ ID NO: 195294 - RNA, 1701 nt, Artificial Sequence; identical to SEQ ID NO: 195268
  derived and/or modified sequence opt5 from hemagglutinin__InfluenzaA__AHZ41178

SEQ ID NO: 195295 - RNA, 1701 nt, Artificial Sequence; identical to SEQ ID NO: 195268
  derived and/or modified sequence opt5 from hemagglutinin__InfluenzaA__AHZ41189

SEQ ID NO: 195296 - RNA, 1701 nt, Artificial Sequence; identical to SEQ ID NO: 195267
  derived and/or modified sequence opt5 from hemagglutinin__InfluenzaA__AHZ41246

SEQ ID NO: 195297 - RNA, 1701 nt, Artificial Sequence; identical to SEQ ID NO: 195272
  derived and/or modified sequence opt5 from hemagglutinin__InfluenzaA__AHZ41263

SEQ ID NO: 195298 - RNA, 1701 nt, Artificial Sequence; identical to SEQ ID NO: 195268
  derived and/or modified sequence opt5 from hemagglutinin__InfluenzaA__AHZ41281

SEQ ID NO: 195299 - RNA, 1701 nt, Artificial Sequence; identical to SEQ ID NO: 195268
  derived and/or modified sequence opt5 from hemagglutinin__InfluenzaA__AHZ41292

SEQ ID NO: 195300 - RNA, 1701 nt, Artificial Sequence; identical to SEQ ID NO: 195267
  derived and/or modified sequence opt5 from hemagglutinin__InfluenzaA__AHZ41303

SEQ ID NO: 195301 - RNA, 1701 nt, Artificial Sequence; identical to SEQ ID NO: 195267
  derived and/or modified sequence opt5 from hemagglutinin__InfluenzaA__AHZ41314

SEQ ID NO: 195302 - RNA, 1701 nt, Artificial Sequence; identical to SEQ ID NO: 195267
  derived and/or modified sequence opt5 from hemagglutinin__InfluenzaA__AHZ41325

SEQ ID NO: 195303 - RNA, 1701 nt, Artificial Sequence; identical to SEQ ID NO: 195267
  derived and/or modified sequence opt5 from hemagglutinin__InfluenzaA__AHZ41336

SEQ ID NO: 195304 - RNA, 1701 nt, Artificial Sequence; identical to SEQ ID NO: 195267
  derived and/or modified sequence opt5 from hemagglutinin__InfluenzaA__AHZ41347

SEQ ID NO: 195305 - RNA, 1701 nt, Artificial Sequence; identical to SEQ ID NO: 195268
  derived and/or modified sequence opt5 from hemagglutinin__InfluenzaA__AHZ41358

SEQ ID NO: 195306 - RNA, 1701 nt, Artificial Sequence; identical to SEQ ID NO: 195268
  derived and/or modified sequence opt5 from hemagglutinin__InfluenzaA__AHZ41366

SEQ ID NO: 195307 - RNA, 1701 nt, Artificial Sequence; identical to SEQ ID NO: 195272
  derived and/or modified sequence opt5 from hemagglutinin__InfluenzaA__AHZ41377

SEQ ID NO: 195308 - RNA, 1701 nt, Artificial Sequence; identical to SEQ ID NO: 195268
  derived and/or modified sequence opt5 from hemagglutinin__InfluenzaA__AHZ41388

SEQ ID NO: 195309 - RNA, 1701 nt, Artificial Sequence; identical to SEQ ID NO: 195272
  derived and/or modified sequence opt5 from hemagglutinin__InfluenzaA__AHZ41410

SEQ ID NO: 195310 - RNA, 1701 nt, Artificial Sequence; identical to SEQ ID NO: 195268
  derived and/or modified sequence opt5 from hemagglutinin__InfluenzaA__AHZ41432

SEQ ID NO: 195311 - RNA, 1701 nt, Artificial Sequence
  derived and/or modified sequence opt5 from hemagglutinin__InfluenzaA__AHZ41441
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccccguccucugacaacggcacgugcuaucccggggauuuuauugacuacgaagaacugcgggagcagcuuagcuccgucagcucuuucgaacgcuuugagaucuucccuaagaccuccagcuggcccaaucacgauucuaacaagggagugacagccgcuuguccucaugccggcgcgaaauccuuuuauaagaaucugaucuggcucguuaaagaaggcaacagcuaccccaagcugucuaaauccuauauuaaugacaaggggaaggaggugcuuguccuguggggaauccaccacccuagcaccuccgccgagcaacagucucucuaccagaacgcugaugccuacguguucgugggcagcuccagauauagcaaaaaguuuaaaccggaaauugcugcccggcccaagguccgcgaccaggcggggagaaugaauuacuauuggacacugguugagccuggagauaaaaucaccuucgaagccacgggcaaccugguggugccccgguacgcuuuugccauggagcgcaacgcugggucuggaauuaucauuuccgacacaccuguccaugauugcaauaccacaugucaaacccccaagggcgccaucaacaccagccucccguuccagaauauccacccuauuacaaucggcaaaugccccaaguaugugaagucuacgaaacugagacuugccaccgggcugcggaacauuccuagcauccagucccgcggacucuuuggcgcuauugcgggguucaucgaaggaggcuggacagggaugguugacggaugguacggcuaucaucaccagaaugagcaaggcucuggguacgccgcugaccuuaagagcacccagaacgccaucgaugagauuacaaauaaagugaacuccgucaucgaaaagaugaauacccaguuuacggccgugggaaaagaguucaaccaccuggaaaagagaauugagaaucugaacaagaaaguugacgauggcuuccucgacaucuggacauacaaugcugaacugcuggugcuccuggagaacgagcggacccuugauuaucaugacagcaaugucaagaaccuguacgaaaaagugcgcucucagcucaagaacaaugccaaagagauugggaacggauguuuugaguucuaucacaagugcgauaauaccuguauggaguccgucaagaacggcacauacgacuaucccaaauacagcgaagaggcgaagcugaauagagaggaaaucgauggggugaaacuugagucuacccggaucuaucaaauucuggcuaucuacuccacaguugccagcucccucgugcuggucgugucucugggcgccauuagcuuuuggaugugcuccaacggaucucuccagugccgcaucuguauuuga

SEQ ID NO: 195312 - RNA, 1701 nt, Artificial Sequence; identical to SEQ ID NO: 195267
  derived and/or modified sequence opt5 from hemagglutinin__InfluenzaA__AHZ41452

SEQ ID NO: 195313 - RNA, 1701 nt, Artificial Sequence
  derived and/or modified sequence opt5 from hemagglutinin__InfluenzaA__AHZ41463
augaaggccauccuggugguccuccuguacaccuucgcuacagccaacgcggacacgcuuugcauuggcuaucacgcuaauaacagcaccgauacaguuuacaccgugcuggagaagaaugugacagucacccauuccgugaaccuccuggaagacaagcacaaugggaaacuuuguaagcugagaggaguugcuccccuccaucugggcaaaugcaacaucgccggguggauucugggaaauccugagugugaaucucucagcacagccuccucuuggagcuauaucguggagaccccguccucugauaacggcacgugcuaccccggggacuuuauugauuaugaagaacugcgggagcagcuuagcuccgucagcucuuucgaacgcuuugagaucuucccuaagaccuccagcuggcccaaucacgacucuaacaagggagugacagccgcuuguccucaugccggcgcgaaauccuuuuacaagaaucugaucuggcucguuaaaaagggcaacagcuaucccaaacugucuaaguccuacauuaaugauaaggggaaagaagugcuuguccuguggggaauccaccacccuagcaccuccgccgagcaacagucucucuaccagaacgcugacgccuauguguucgugggcagcuccagauacagcaagaaauuuaagccggagauugcugcccggcccaaaguccgcgggcaggcgggaagaaugaauuauuacuggacacugguugaaccuggcgauaagaucaccuucgaggccacggggaaccugguggugccccgguaugcuuuugccauggaacgcaacgcuggaucuggcauuaucauuuccgacacaccuguccaugauugcaauaccacaugucaaacccccaaaggcgccaucaacaccagccucccguuccagaauauccacccuauuacaaucgggaagugccccaaguacgugaaaucuacgaagcugagacuugccaccggacugcggaacauuccuagcauccagucccgcggccucuuuggggcuauugcgggauucaucgagggcggguggacaggaaugguugacggcugguauggcuaccaucaccagaaugaacaagggucuggauacgccgcugaucugaaaagcacccagaacgccaucgacgagauuacaaauaaggugaacuccgucaucgagaaaaugaauacccaguuuacggccgugggcaaggaguucaaccaccuugagaagagaauugaaaaucugaacaaaaagguugacgauggguuccucgacaucuggacauauaaugcugagcugcuggugcuccuggaaaacgagcggacccuugauuaccaugacagcaaugucaaaaaccuguaugagaaggugcgcucucagcucaaaaacaaugccaaggaaauuggaaacggcuguuuugaguucuaccacaagugcgauaauaccuguauggaauccgucaaaaacgggacauaugacuaccccaaguauagcgaggaagcgaaacugaauagagaggagaucgauggcgugaaacuugaaucuacccggaucuaccaaauucuggcuaucuacuccacaguugccagcucccucgugcuggucgugucucugggagccauuagcuuuuggaugugcuccaacggcucucuccagugccgcaucuguauuuga

SEQ ID NO: 195314 - RNA, 1701 nt, Artificial Sequence; identical to SEQ ID NO: 195267
  derived and/or modified sequence opt5 from hemagglutinin__InfluenzaA__AHZ41473

SEQ ID NO: 195315 - RNA, 1701 nt, Artificial Sequence; identical to SEQ ID NO: 195267
  derived and/or modified sequence opt5 from hemagglutinin__InfluenzaA__AHZ41484

SEQ ID NO: 195316 - RNA, 1701 nt, Artificial Sequence; identical to SEQ ID NO: 195272
  derived and/or modified sequence opt5 from hemagglutinin__InfluenzaA__AHZ41495

SEQ ID NO: 195317 - RNA, 1701 nt, Artificial Sequence; identical to SEQ ID NO: 195267
  derived and/or modified sequence opt5 from hemagglutinin__InfluenzaA__AHZ41506

SEQ ID NO: 195318 - RNA, 1701 nt, Artificial Sequence
  derived and/or modified sequence opt5 from hemagglutinin__InfluenzaA__AHZ41517
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccccguccucugacaacggcacgugcuaucccggggauuuuauugacuacgaagaacugcgggagcagcuuagcuccgucagcucuuucgaacgcuuugagaucuucccuaagaccuccagcuggcccaaucacgauucuaacaagggagugacagccgcuuguccucaugccggcgcgaaauccuuuuauaagaaucugaucuggcucguuaaaaagggcaacagcuaccccaaacugucugaauccuauauuaaugacaaggggaaggaggugcuuguccuguggggaauccaccacccuagcaccuccgccgagcaacagucucucuaccagaacgcugaugccuacguguucgugggcagcuccagauauagcaaaaaguuuaaaccggaaauugcugcccggcccaagguccgcgggcaggcgggaagaaugaauuacuauuggacacugguugagccuggcgacaaaaucaccuucgaagccacggggaaccugguggugccccgguacgcuuuugccauggagcgcaacgcuggaucuggcauuaucauuuccgauacaccuguccaugacugcaauaccacaugucaaacccccaagggcgccaucaacaccagccucccguuccagaauauccacccuauuacaaucgggaaaugccccaaguaugugaagucuacgaaacugagacuugccaccggacugcggaacauuccuagcauccagucccgcggccucuuuggggcuauugcgggauucaucgaaggcggguggacaggaaugguugauggcugguacggcuaucaucaccagaaugagcaagggucuggauacgccgcugaccuuaagagcacccagaacgccaucgacgagauuacaaauaaagugaacuccgucaucgaaaagaugaauacccaguuuacggccgugggcaaagaguucaaccaccuggaaaagagaauugagaaucugaacaagaaaguugaugacggguuccucgauaucuggacauacaaugcugaacugcuggugcuccuggagaacgagcggacccuugacuaucaugauagcaaugucaagaaccuguacgaaaaagugcgcucucagcucaagaacaaugccaaagagauuggaaacggcuguuuugaguucuaucacaagugcgacaauaccuguauggaguccgucaagaacgggacauacgauuaucccaaauacagcgaagaggcgaagcugaauagagaggaaaucgacggcgugaaacuugagucuacccggaucuaucaaauucuggcuaucuacuccacaguugccagcucccucgugcuggucgugucucugggagccauuagcuuuuggaugugcuccaacggcucucuccagugccgcaucuguauuuga

SEQ ID NO: 195319 - RNA, 1701 nt, Artificial Sequence
  derived and/or modified sequence opt5 from hemagglutinin__InfluenzaA__AHZ41528
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccccguccucugacaacggcacgugcuaucccggggauuuuauugacuacgaagaacugcgggagcagcuuagcuccgucagcucuuucgaacgcuuugagaucuucccuaagaccuccagcuggcccaaucacgauucuaacaagggagugacagccgcuuguccucaugccggcgcgaaauccuuuuauaagaaucugaucuggcucguuaaaaagggcaacagcuaccccaaacugucugaauccuauauuaaugacaaggggaaggaggugcuuguccuguggggaauccaccacccuagcaccuccgccgaucaacagucucucuaccagaacgcugacgccuacguguucgugggcagcuccagauauagcaaaaaguuuaaaccggagauugcugcccggcccaagguccgcgggcaggcgggaagaaugaauuacuauuggacacugguugaaccuggcgauaaaaucaccuucgaggccacggggaaccugguggugccccgguacgcuuuugccauggaacgcaacgcuggaucuggcauuaucauuuccgacacaccuguccaugauugcaauaccacaugucaaacccccaagggcgccaucaacaccagccucccguuccagaauauccacccuauuacaaucgggaaaugccccaaguaugugaagucuacgaaacugagacuugccaccggacugcggaacauuccuagcauccagucccgcggccucuuuggggcuauugcgggauucaucgagggcggguggacaggaaugguugacggcugguacggcuaucaucaccagaaugaacaagggucuggauacgccgcugaccuuaagagcacccagaacgccaucgaugagauuacaaauaaagugaacuccgucaucgagaagaugaauacccaguuuacggccgugggcaaagaguucaaccaccuggagaagagaauugaaaaucugaacaagaaaguugacgauggguuccucgacaucuggacauacaaugcugagcugcuggugcuccuggaaaacgagcggacccuugauuaucaugacagcaaugucaagaaccuguacgagaaagugcgcucucagcucaagaacaaugccaaagaaauuggaaacggcuguuuugaguucuaucacaagugcgauaauaccuguauggaauccgucaagaacgggacauacgacuaucccaaauacagcgaggaagcgaagcugaauagagaggagaucgauggcgugaaacuugaaucuacccggaucuaucaaauucuggcuaucuacuccacaguugccagcucccucgugcuggucgugucucugggagccauuagcuuuuggaugugcuccaacggcucucuccagugccgcaucuguauuuga

SEQ ID NO: 195320 - RNA, 1701 nt, Artificial Sequence; identical to SEQ ID NO: 195272
  derived and/or modified sequence opt5 from hemagglutinin__InfluenzaA__AHZ41539

SEQ ID NO: 195321 - RNA, 1701 nt, Artificial Sequence; identical to SEQ ID NO: 195267
  derived and/or modified sequence opt5 from hemagglutinin__InfluenzaA__AHZ41550

SEQ ID NO: 195322 - RNA, 1701 nt, Artificial Sequence; identical to SEQ ID NO: 195268
  derived and/or modified sequence opt5 from hemagglutinin__InfluenzaA__AHZ41561

SEQ ID NO: 195323 - RNA, 1701 nt, Artificial Sequence
  derived and/or modified sequence opt5 from hemagglutinin__InfluenzaA__AHZ41572
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccccguccucugacaacggcacgugcuaucccggggauuuuauugacuacgaagaacugcgggagcagcuuagcuccgucagcucuuucgaacgcuuugagaucuucccuaagaccuccagcuggcccaaucacgauucuaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgagcaacagucucucuaccagaacgcugaugccuacguguucgugggcagcuccagauauagcaagaaauuuaagccggagauugcugcccggcccaaaguccgcgggcaggcgggaagaaugaauuacuauuggacacugguugaaccuggcgacgagaucaccuucgaagccacggggaaccugguggugccccgguacgcuuuugccauggagcgcaacgcuggaucuggcauuaucauuuccgauacaccuguccaugacugcaauaccacaugucaaacccccaagggcgccaucaacaccagccucccguuccagaauauccacccuauuacaaucgggaaaugccccaaguaugugaagucuacgaaacugagacuugccaccggacugcggaacauuccuagcauccagucccgcggccucuuuggggcuauugcgggauucaucgaaggcggguggacaggaaugguugauggcugguacggcuaucaucaccagaaugagcaagggucuggauacgccgcugaccuuaagagcacccagaacgccaucgacgagauuacaaauaaagugaacuccgucaucgaaaagaugaauacccaguuuacggccgugggcaaagaguucaaccaccuggaaaagagaauugagaaucugaacaagaaaguugaugacggguuccucgauaucuggacauacaaugcugaacugcuggugcuccuggagaacgagcggacccuugacuaucaugauagcaaugucaagaaccuguacgaaaaagugcgcucucagcucaagaacaaugccaaagagauuggaaacggcuguuuugaguucuaucacaagugcgacaauaccuguauggaguccgucaagaacgggacauacgauuaucccaaauacagcgaagaggcgaagcugaauagagaggaaaucgacggcgugaaacuugagucuacccggaucuaucaaauucuggcuaucuacuccacaguugccagcucccucgugcuggucgugucucugggagccauuagcuuuuggaugugcuccaacggcucucuccagugccgcaucuguauuuga

SEQ ID NO: 195324 - RNA, 1701 nt, Artificial Sequence; identical to SEQ ID NO: 195272
  derived and/or modified sequence opt5 from hemagglutinin__InfluenzaA__AHZ41583

SEQ ID NO: 195325 - RNA, 1701 nt, Artificial Sequence; identical to SEQ ID NO: 195267
  derived and/or modified sequence opt5 from hemagglutinin__InfluenzaA__AHZ41594

SEQ ID NO: 195326 - RNA, 1701 nt, Artificial Sequence
  derived and/or modified sequence opt5 from hemagglutinin__InfluenzaA__AHZ41605
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccccguccucugacaacggcacgugcuaucccggggauuuuauugacuacgaagaacugcgggagcagcuuagcuccgucagcucuuucgaacgcuuugagaucuucccuaauaccuccagcuggcccaaccacgauucuaauaagggagugacagccgcuuguccucaugccggcgcgaaguccuuuuauaaaaaccugaucuggcucguuaagaaaggcaauagcuaccccaagcugucuaaauccuauauuaacgacaaggggaaggaagugcuuguccuguggggaauccaccacccuagcaccuccgccgagcaacagucucucuaccagaaugcugaugccuacguguucgugggcagcuccagauauagcaaaaaguuuaaaccggagauugcugcccggcccaaggucauggggcaggcgggacgcaugaacuacuauuggacacugguugaaccuggcgacaaaaucaccuucgaggccacggggaaccugguggugcccagauacgcuuuugccauggaacggaaugcuggaucuggcauuaucauuuccgauacaccuguccaugacugcaacaccacaugucaaacccccaagggcgccaucaauaccagccucccguuccagaacauccacccuauuacaaucgggaaaugccccaaguaugugaagucuacgaaacugcgccuugccaccggacugagaaauauuccuagcauccagucccggggccucuuuggggcuauugcgggauucaucgagggcggguggacaggaaugguugauggcugguacggcuaucaucaccagaacgaacaagggucuggauacgccgcugaccugaaguccacccagaaugccaucgacgagauuacaaacaaagugaauagcgucaucgagaagaugaacacccaguuuacggccgugggcaaagaguucaaucaccuugagaagcgcauugaaaaccugaauaagaaaguugaugacggguuccucgauaucuggacauacaacgcugagcugcuggugcuccuggaaaaugagagaacccuugacuaucaugauagcaacgucaagaaccuguacgagaaagugcggucucagcucaagaauaacgccaaagaaauuggaaauggcuguuuugaguucuaucacaagugcgacaacaccuguauggaauccgucaagaaugggacauacgauuaucccaaauacagcgaggaagcgaagcugaaccgcgaggagaucgacggcgugaaacuugaaucuaccagaaucuaucaaauucuggcuaucuacuccacaguugccagcucccucgugcuggucgugucucugggagccauuagcuuuuggaugugcuccaauggcucucuccagugccggaucuguauuuga

SEQ ID NO: 195327 - RNA, 1701 nt, Artificial Sequence; identical to SEQ ID NO: 195267
  derived and/or modified sequence opt5 from hemagglutinin__InfluenzaA__AHZ41616

SEQ ID NO: 195328 - RNA, 1701 nt, Artificial Sequence; identical to SEQ ID NO: 195272
  derived and/or modified sequence opt5 from hemagglutinin__InfluenzaA__AHZ41627

SEQ ID NO: 195329 - RNA, 1701 nt, Artificial Sequence; identical to SEQ ID NO: 195272
  derived and/or modified sequence opt5 from hemagglutinin__InfluenzaA__AHZ41638

SEQ ID NO: 195330 - RNA, 1701 nt, Artificial Sequence; identical to SEQ ID NO: 195268
  derived and/or modified sequence opt5 from hemagglutinin__InfluenzaA__AHZ41649

SEQ ID NO: 195331 - RNA, 1701 nt, Artificial Sequence; identical to SEQ ID NO: 195268
  derived and/or modified sequence opt5 from hemagglutinin__InfluenzaA__AHZ41660

SEQ ID NO: 195332 - RNA, 1701 nt, Artificial Sequence; identical to SEQ ID NO: 195272
  derived and/or modified sequence opt5 from hemagglutinin__InfluenzaA__AHZ41671

SEQ ID NO: 195333 - RNA, 1701 nt, Artificial Sequence; identical to SEQ ID NO: 195272
  derived and/or modified sequence opt5 from hemagglutinin__InfluenzaA__AHZ41682

SEQ ID NO: 195334 - RNA, 1701 nt, Artificial Sequence; identical to SEQ ID NO: 195272
  derived and/or modified sequence opt5 from hemagglutinin__InfluenzaA__AHZ41693

SEQ ID NO: 195335 - RNA, 1701 nt, Artificial Sequence; identical to SEQ ID NO: 195272
  derived and/or modified sequence opt5 from hemagglutinin__InfluenzaA__AHZ41704

SEQ ID NO: 195336 - RNA, 1701 nt, Artificial Sequence; identical to SEQ ID NO: 195272
  derived and/or modified sequence opt5 from hemagglutinin__InfluenzaA__AHZ41715

SEQ ID NO: 195337 - RNA, 1701 nt, Artificial Sequence; identical to SEQ ID NO: 195272
  derived and/or modified sequence opt5 from hemagglutinin__InfluenzaA__AHZ41726

SEQ ID NO: 195338 - RNA, 1701 nt, Artificial Sequence; identical to SEQ ID NO: 195272
  derived and/or modified sequence opt5 from hemagglutinin__InfluenzaA__AHZ41737

SEQ ID NO: 195339 - RNA, 1701 nt, Artificial Sequence; identical to SEQ ID NO: 195272
  derived and/or modified sequence opt5 from hemagglutinin__InfluenzaA__AHZ41748

SEQ ID NO: 195340 - RNA, 1701 nt, Artificial Sequence; identical to SEQ ID NO: 195272
  derived and/or modified sequence opt5 from hemagglutinin__InfluenzaA__AHZ41759

SEQ ID NO: 195341 - RNA, 1701 nt, Artificial Sequence; identical to SEQ ID NO: 193099
  derived and/or modified sequence opt5 from hemagglutinin__InfluenzaA__AHZ42561

SEQ ID NO: 195342 - RNA, 1701 nt, Artificial Sequence
  derived and/or modified sequence opt5 from hemagglutinin__InfluenzaA__AHZ42572
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagucuacacugaaacuugccacggggaugcgcaacguccccgagaagcaaaccagaggaaucuucggcgcgauugccggguuuaucgaaaauggaugggagggcaugguugaugggugguauggauuccggcaccagaacagcgagggcagaggccaggcugccgaccugaaauccacacaagcugccauugaucagaucaaugggaagcucaaccgccugauuggaaaaaccaaugaaaaguuccaccagaucgagaaggaauuuagcgagguggaaggccggauucaggaccuugagaaauacguggaggauacaaagaucgaccuguggucuuauaacgccgaacuccuggucgcucuggagaaccaacauaccaucgaucucacggacuccgaaauggauaaacuguucgagaagaccaaaaagcagcuuagagaaaaugcggaggacauggggaacggaugcuuuaagauuuaccacaaaugugauaaugccugcaucggcagcauucgcaacgggacauaugaccaugacguguaccgggaugaggcucugaauaacagauuccagaucaagggcguugaacucaaaucuggauacaaggacuggauucuguggaucuccuuugccaucagcugcuuccuucuguguguggcccuccugggcuuuauuaugugggcuugccagaaagggaauauccgcuguaacauuugcaucuga

SEQ ID NO: 195343 - RNA, 1701 nt, Artificial Sequence; identical to SEQ ID NO: 194810
  derived and/or modified sequence opt5 from hemagglutinin__InfluenzaA__AHZ42584

SEQ ID NO: 195344 - RNA, 1701 nt, Artificial Sequence; identical to SEQ ID NO: 192907
  derived and/or modified sequence opt5 from hemagglutinin__InfluenzaA__AHZ42596

SEQ ID NO: 195345 - RNA, 1701 nt, Artificial Sequence; identical to SEQ ID NO: 193084
  derived and/or modified sequence opt5 from hemagglutinin__InfluenzaA__AHZ42608

SEQ ID NO: 195346 - RNA, 1701 nt, Artificial Sequence; identical to SEQ ID NO: 192907
  derived and/or modified sequence opt5 from hemagglutinin__InfluenzaA__AHZ42619

SEQ ID NO: 195347 - RNA, 1701 nt, Artificial Sequence
  derived and/or modified sequence opt5 from hemagglutinin__InfluenzaA__AHZ42631
augaagaccaucauugcccugagcuacauccucugccugguguucgcucagaaacuucccggcaacuauaauuccacagccacgcugugucucgggcaccaugcggucccuaacggaaccauuguuaagacaaucaccaaugacagaauugaggugacaaacgcuaccgaacuggugcaaaauucuagcaucggcgagaucugcgauuccccgcaccagauucuugacggggaaaacuguacacugaucgaugcccuccugggagacccccagugcgauggcuuucagaauaaaaagugggaccuguucgucgagcggucuaaagccuacagcaacuguuauccuuacgaugugcccgacuaugcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguacccugcccuuaacgucacaaugcccaacaaugagcaguucgauaagcuguauaucuggggcgugcaccauccugggaccgacaaagaucagauuuuucucuacgcgcagucuuccggaagaaucacgguuagcacaaagcggucccaacaggccgugauuccgaacaucggcucucgccccagaauccggaauauuccuagccgcaucuccauuuacuggaccaucgucaaacccggggacauucugcugaucaacagcacaggaaaucucaucgcuccuagaggcuauuucaagauucggucugggaaauccagcaucaugcgcucugaugcccccauuggaaaguguaagagcgaaugcaucaccccgaacggcuccauuccuaaugacaaacccuuucagaacgugaauagaaucaccuacggcgcuuguccucgguaugugaagcagucuacacugaaacuugccacggggaugcgcaacguccccgagaagcaaaccagaggaaucuucggcgcgauugccggguuuaucgaaaauggaugggagggcaugguugacgggugguacggauuccggcaccagaacagcgagggcagaggccaggcugccgaucugaaauccacacaagcugccauugaccagaucaaugggaagcucaaccgccugauuggaaaaaccaaugaaaaguuccaccagaucgagaaggaauuuagcgagguggaaggccggauucaggaucuugagaaauauguggaggacacaaagaucgaucuguggucuuacaacgccgaacuccuggucgcucuggagaaccaacauaccaucgaccucacggauuccgaaaugaauaaacuguucgagaagaccaaaaagcagcuuagagaaaacgcggaggacauggggaauggaugcuuuaagauuuaucacaaaugugauaacgccugcaucggcagcauucgcaaugggacauacgaccaugauguguaccgggacgaggcucugaacaauagauuccagaucaagggcguugaacucaaaucuggauauaaggacuggauucuguggaucuccuuugccaucagcugcuuccuucuguguguggcccuccugggcuuuauuaugugggcuugccagaaagggaacauccgcuguaauauuugcaucuga

SEQ ID NO: 195348 - RNA, 1701 nt, Artificial Sequence
  derived and/or modified sequence opt5 from hemagglutinin__InfluenzaA__AHZ42643
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaagugcaacaucgccggguggauucugggaaauccugagugugaaucucugagcacagccuccucuuggagcuacaucguggagaccuccggcucugacaacgggacgugcuauccgggagauuuuauugacuacgaggagcuccgggagcagcugagcuccgucagcucuuucgaacgcuuugagaucuuccccaaggccuccagcuggccuaaucacgauucuaacaagggcgugaccgcugccuguccccaugcgggcgccaaaggguuuuauaagaaucuuaucuggcugguuaaaaagggaaacuccuacccuaaacucagcauuucuuauaucaaugacaagggcaaggaagugcugguccuuugggggauucaccaccccuccacaaccgcugaucaacagagccuguaccagaacgccgacacauacguguucgugggaaccuccagauauucuaaaaaguuuaaaccugagaucgcuauucggccgaagguccgcgaucaggagggcagaaugaauuacuauuggacgcucguugaacccggggacaaaaucacauucgaggccaccggaaaccugguggugccucgguacgcguuugccauggaacgcaacgcuggcagcggcauuaucaucuccgauacacccguccaugacugcaauaccaccugucaaacaccuaagggggccauuaacacgagccugcccuuccagaauauccacccgauuaccaucggaaaaugcccuaaguaugugaagucuacaaaacucagacuggcuaccggccuucggaacguucccuccauucagagccgcgggcuguuuggagccaucgccggcuucaucgaagggggauggacaggcaugguggacggcugguacggguaucaucaccagaaugaacaaggaucuggcuacgcugcggaucucaagagcacccagaacgccauugacaaaaucacgaauaaggucaacuccgugauugagaaaaugaauacacaguuuaccgcuguugggaaggaguucaaccaccuggaaaagagaaucgagaaucuuaacaaaaagguggaugacggauuccuggauauuuggaccuacaaugccgaacuccugguccugcucgagaacgaacggacacuggacuaucaugauucuaaugugaaaaaccuuuacgagaagguccgcaaccagcugaaaaauaacgccaaggagaucggcaauggguguuuugaguucuaucacaagugcgacaacaccuguauggaaagcgugaaaaauggcacauacgauuauccuaaguacuccgaagaggcuaaacucaacagagaaaagaucgacggaguuaaacuggagagcacgcggauuuaucaaauccuugccauuuacucuaccgcggcuuccagccuggugcucgucgugucucugggcgccaucuccuuuuggaugugcagcaaugggucccugcagugccgcauuuguaucuga

SEQ ID NO: 195349 - RNA, 1701 nt, Artificial Sequence; identical to SEQ ID NO: 192907
  derived and/or modified sequence opt5 from hemagglutinin__InfluenzaA__AHZ42654

SEQ ID NO: 195350 - RNA, 1701 nt, Artificial Sequence; identical to SEQ ID NO: 192882
  derived and/or modified sequence opt5 from hemagglutinin__InfluenzaA__AHZ42666

SEQ ID NO: 195351 - RNA, 1701 nt, Artificial Sequence; identical to SEQ ID NO: 192882
  derived and/or modified sequence opt5 from hemagglutinin__InfluenzaA__AHZ42678

SEQ ID NO: 195352 - RNA, 1701 nt, Artificial Sequence
  derived and/or modified sequence opt5 from hemagglutinin__InfluenzaA__AHZ42690
augaaggccauccuggugguccuccuguacaccuaugcuacagccaacgcggacacgcuuugcauuggcuaccacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuauaucguggagaccuccucuagcgacaacggcacgugcuacccgggggauuucauuaauuaugaggaacugcgggagcagcuuuccagcgucucuuccuuugaacgcuucgagaucuuucccaagaccagcucuuggccuaaccacgacuccaauaagggagugacagccgcuuguccccaugccggcgcgaaaucuuucuacaagaaccugaucuggcucguuaaaaagggcaauagcuauccuaaacuguccaagagcuacauuaacgauaaggggaaagaagugcuuguccuguggggaauccaccaccccuccaccacaaccgaccaacagucucucuaccagaaugccgaugcuuauguguuugugggcacgagcagauacuccaagaaauucaagccugagauugccauccggccgaaaguccgcgaccaggaggggagaaugaacuauuacuggacacugauugaacccggagauaagaucaccuuugaggcuacaggcaaccugguugugccucgguaugccuucgcgauggaacgcaaugccgggagcggaauuaucaucucugacacccccgugcaugauugcaacaccacaugucaaacgccugagggcgcuauuaauaccucccuccccuuucagaacauccacccgauuacaaucggcaaaugcccuaaguacgucaagagcaccaaacugagacuugccacagggcugcggaaugugcccucuauucagagccgcggacucuucggcgcuaucgccggguuuaucgaaggaggcuggaccgggaugguugacggaugguauggcuaccaucaccagaacgagcaaggcuccggguacgccgcugaccugaagucuacgcagaaugcgauugauaaaaucacaaacaaggugaauagcgucauugagaaaaugaacacccaguucaccgccgugggaaaggaauuuaaucaccuugagaagagaaucgaaaaccugaauaaaaagguugacgauggcuuccucgacauuuggacauauaacgcugagcugcuggugcuccuggaaaaugagcggacccuugauuaccaugacuccaacgucaaaaaccuguaugagaaggugcgcaaucagcucaaaaacaaugccaaggaaaucgggaacggauguuucgaguuuuaccacaagugcgauaauacauguauggaaagcgucaaaaacggcacguaugacuacccuaaguauucugaggaagccaaacugaauagagagaagaucgauggggugaaacuugaguccacccggauuuaccaaauccuggcuauuuacagcacaguugccucuucccucgugcuggucgugagccugggcgcgaucuccuucuggaugugcucuaacggaagccuccagugccgcauuuguaucuga

SEQ ID NO: 195353 - RNA, 1701 nt, Artificial Sequence; identical to SEQ ID NO: 192907
  derived and/or modified sequence opt5 from hemagglutinin__InfluenzaA__AHZ42701

SEQ ID NO: 195354 - RNA, 1701 nt, Artificial Sequence; identical to SEQ ID NO: 192882
  derived and/or modified sequence opt5 from hemagglutinin__InfluenzaA__AHZ42713

SEQ ID NO: 195355 - RNA, 1701 nt, Artificial Sequence
  derived and/or modified sequence opt5 from hemagglutinin__InfluenzaA__AHZ42725
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggaacgggaaaucuuccaucaugcgcagcgacgcccccauuggaaaguguaagucugaaugcaucaccccgaauggcagcauuccuaacgacaaacccuuucagaaugugaacagaaucaccuauggcgcuuguccucgguacgugaagcaguccacacugaaacuugccacggggaugcgcaauguccccgagaagcaaaccagaggaaucuucggcgcgauugccggguuuaucgaaaacggaugggagggcaugguugaugggugguauggauuccggcaccaaaauucugagggcagaggccaggcugccgaccugaaaagcacacaggcugccauugaucagaucaacgggaagcucaaucgccugauuggaaaaaccaacgaaaaguuccaccagaucgagaaggaauuuuccgagguggaaggccggauucaggaccuugagaaauacguggaggauacaaagaucgaccuguggagcuauaacgccgaacuccuggucgcucuggagaaucaacauaccaucgaucucacggacucugaaaugaacaaacuguucgagaagaccaaaaagcagcuuagagaaaaugcggaggauauggggaacggaugcuuuaagauuuaccacaaaugugacaaugccugcaucggcuccauucgcaacgggacauaugaucaugacguguaccgggacgaggcucugaauaacagauuccagaucaagggcguugaacucaaaagcggauacaaggauuggauucuguggaucucuuuugccaucuccugcuuccuucuguguguggcccuccugggcuuuauuaugugggcuugccagaaagggaauauccgcuguaacauuugcaucuga

SEQ ID NO: 195356 - RNA, 1701 nt, Artificial Sequence
  derived and/or modified sequence opt5 from hemagglutinin__InfluenzaA__AHZ42737
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacagccgaccaacagucucucuaccagaaugcugaugccuacguguucgugggcaccagcagauauuccaagaaauuuaagccugagauugcuauccggccgaaaguccgcgaccaggaggggagaaugaacuacuauuggacgcugauugaacccggagauaagaucacauucgaggccaccggcaaccugguugugccucgguacgcguuugccauggaacgcaaugcugagagcgggauuaucaucucugacacacccgugcaugauugcaacaccaccugucaaacaccugaaggagccauuaauacgucccuccccuuccagaacauccacccgauuaccaucggcaaaugcccuaaguaugucaagagcacaaaacugagacuugcuaccggccugcggaaugugcccucuauucagagccgcgggcucuuuggagccaucgccggcuucaucgaagggggauggacaggcaugguugacgggugguacggauaucaucaccagaacgagcaaggcuccggcuacgcugcggaccugaagucuacccagaaugccauugauaaaaucacgaacaaggugaauagcgucauugagaaaaugaacacacaguuuaccgcuguggggaaggaguucaaucaccuugaaaagagaaucgagaaccugaauaaaaagguugacgauggauuccucgacauuuggaccuacaacgccgaacugcuggugcuccuggagaaugagcggacacuugauuaucaugacuccaacgucaaaaaccuguacgaaaaggugcgcaaucagcucaaaaacaaugccaaggagaucggcaacggguguuuugaguucuaucacaagugcgauaauaccuguauggagagcgucaaaaacggaacauacgacuauccuaaguacucugaagaggcuaaacugaauagagagaagaucgauggcgugaaacuugaauccacgcggauuuaucaaauccuggccauuuacagcaccguugcgucuucccucgugcuggucgugagccugggggcuaucuccuuuuggaugugcucuaacggcagccuccagugccgcauuuguaucuga

SEQ ID NO: 195357 - RNA, 1701 nt, Artificial Sequence; identical to SEQ ID NO: 192907
  derived and/or modified sequence opt5 from hemagglutinin__InfluenzaA__AHZ42748

SEQ ID NO: 195358 - RNA, 1701 nt, Artificial Sequence; identical to SEQ ID NO: 192927
  derived and/or modified sequence opt5 from hemagglutinin__InfluenzaA__AHZ42760

SEQ ID NO: 195359 - RNA, 1701 nt, Artificial Sequence
  derived and/or modified sequence opt5 from hemagglutinin__InfluenzaA__AHZ42772
augaagaccaucauugcccugagcuacauccucugccugguguucgcucaggagcuucccggcaacgacgauuccacagccacgcugugucucgggcaccaugcggucccuaauggaaccauuguuaaaacaaucaccaacgacagaauugaagugacaaaugcuaccgagcuggugcaaucuagcuccacaggcgaaaucugcaacucuccgcaccagauccuugauggggagaauuguacccugauugacgcccuccugggagauccccagugcgacggcuuucagaacaagaaaugggaucuguucgucgaacggagcaaggcccauuccaauuguuauccuuacgacgugcccgauuaugcuucucuccgcagccugguugccuccagcgggacgcuugaguuuaacaaugagucuuucaacuggaccggagugacacaaaauggcaccuccagcgcuugcaucagacggucuaacaauuccuuuuucagccgccugaacuggcucacacaccugaauuuuaaauacccugcccuuaacgucaccaugcccaacaaugaacaguucgacaagcuguauauuuggggcgugcaucacccugggacggauaaggaccagaucuuucucuacgcgcaggccucuggaagaauuacaguuuccaccaaacggagccaacagacagugaucccgaacauuggcucccgccccagaguccggaauaucccuucucgcgugagcaucuauuggaccauugugaagcccggggauauccugcugauuaacuccaccggaaaucucaucgcuccuagaggcuacuucaaaauucggagcgggaagucuuccaucaugcgcagcgacgcccccaucggaaaauguaacucugcuugcauuacaccgaauggcagcaucccuaacgacaagcccuuucagaaugucaacagaauuacguacggcgccuguccucgguauguuaagcagaauacccugaaacuugcgacagggaugcgcaacgugcccgagaagcaaaccagaggaaucuucggcgccauugcuggguuuaucgaaaauggaugggagggcaugguggaugggugguacggauuccggcaccagaacuccgagggcagaggccaggccgcugaccugaaaucuacacaagccgccaucgaucagauuaaugggaagcucaaccgccugaucggaaaaaccaacgaaaaguuccaucagauugagaaagaauuuagcgaggucgaaggccggauccaggaccuugagaaguauguggaggauacgaagauugaccugugguccuacaaugcugaacuccugguugcgcuggagaaccaacacacaaucgaucucaccgacagcgaaaugaauaaacuguucgagaagaccaaaaagcagcuuagagaaaacgccgaggauauggggaauggaugcuuuaaaauuuaucauaagugugacaacgcuugcaucggcucuauccgcaaugggacauacgaucacgacguguaucgggacgaggcccugaacaauagauuccagauuaaggaagucgagcucaaauccggcuacaaggauuggauccuguggauuagcuuugccaucucuugcuuccuucuguguguggcucuccugggauuuauuaugugggccugccagaaaggcaacauccgcuguaauaucugcauuuga

SEQ ID NO: 195360 - RNA, 1701 nt, Artificial Sequence; identical to SEQ ID NO: 192907
  derived and/or modified sequence opt5 from hemagglutinin__InfluenzaA__AHZ42784

SEQ ID NO: 195361 - RNA, 1701 nt, Artificial Sequence; identical to SEQ ID NO: 192882
  derived and/or modified sequence opt5 from hemagglutinin__InfluenzaA__AHZ42796

SEQ ID NO: 195362 - RNA, 1701 nt, Artificial Sequence; identical to SEQ ID NO: 192882
  derived and/or modified sequence opt5 from hemagglutinin__InfluenzaA__AHZ42808

SEQ ID NO: 195363 - RNA, 1701 nt, Artificial Sequence; identical to SEQ ID NO: 195356
  derived and/or modified sequence opt5 from hemagglutinin__InfluenzaA__AHZ42820

SEQ ID NO: 195364 - RNA, 1701 nt, Artificial Sequence; identical to SEQ ID NO: 193491
  derived and/or modified sequence opt5 from hemagglutinin__InfluenzaA__AHZ42831

SEQ ID NO: 195365 - RNA, 1701 nt, Artificial Sequence
  derived and/or modified sequence opt5 from hemagglutinin__InfluenzaA__AHZ42843
augaagaccaucauugcccugagcuacauccucugccugguguucgcucagaaacuucccggcaacgacaauuccacagccacgcugugucucgggcaccaugcggucccuaacggaaccaugguuaagacaauuaccaaugauagaaucgaggugacaaacgcuaccgaacuggugcaaaauucuagcauuggcgagaucugcgacuccccgcaccagauccuugauggggaaaacuguacacugauugacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcaucagacggagcaauucuuccuuuuucagccgccugaacuggcucacccaucugaauuuuaaguauccugcccuuaacgucacaaugcccaacaaugagcaguucgacaagcuguacauuuggggcgugcaccauccugggaccgauaaagaccagaucuuucucuaugcgcagucuuccggaagaauuacgguuagcacaaagcggucccaacaggccgugaucccgaacauuggcucucgccccagaauccggaauaucccuagccgcauuuccaucuacuggaccauugucaaacccggggauauccugcugauuaacagcacaggaaaucucaucgcuccuagaggcuacuucaagauccggucugggaaauccagcauuaugcgcucugacgcccccaucggaaaguguaagagcgaaugcauuaccccgaacggcuccaucccuaaugacaaacccuuucagaacgugaauagaauuaccuauggcgcuuguccucgguacgugaagcagucuacacugaaacuugccacggggaugcgcaacguccccgagaagcaaaccagaggaaucuucggcgcgaucgccggguuuauugaaaauggaugggagggcaugguugaugggugguauggauuccggcaccagaacagcgagggcagaggccaggcugccgaccugaaauccacacaagcugccaucgaucagauuaaugggaagcucaaccgccugaucggaaaaaccaaugaaaaguuccaccagauugagaaggaauuuagcgagguggaaggccggauccaggaccuugagaaauacguggaggauacaaagauugaccuguggucuuauaacgccgaacuccuggucgcucuggagaaccaacauaccaucgaucucacggacuccgaaaugaauaaacuguucgagaagaccaaaaagcagcuuagagaaaacgcggaggauauggggaauggaugcuuuaagaucuaccacaaaugugacaacgccugcauuggcagcauccgcaaugggacauaugaucauaacguguaccgggacgaggcucugaauaacagauuccagauuaagggcguugaacucaaaucuggauacaaggacuggauccuguggauuuccuuugccaucagcugcuuccuucuguguguggcccuccugggcuuuaucaugugggcuugccagaaagggaauauucgcuguaacaucugcauuuga

SEQ ID NO: 195366 - RNA, 1701 nt, Artificial Sequence
  derived and/or modified sequence opt5 from hemagglutinin__InfluenzaA__AHZ42855
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacaugacaaugcccaacaaugagcaguucgacaagcuguacaucuggggcguccaccauccugggaccgauaaagaccagauuuuucucuaugcgcagucuuccggaagaaucacggugagcacaaagcggucccaacaggccguuauuccgaacaucggcucucgccccagaauccggaauauuccuagccgcaucuccauuuacuggaccaucgugaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgucaauagaaucaccuauggcgcuuguccucgguacgugaagcagucuacacugaaacuugccacggggaugcgcaacgugcccgagaagcaaaccagaggaaucuucggcgcgauugccggguuuaucgaaaauggaugggagggcauggucgaugggugguauggauuccggcaccagaacagcgagggcagaggccaggcugccgaccugaaauccacacaagcugccauugaucagaucaaugggaagcucaaccgccugauuggaaaaaccaaugaaaaguuccaccagaucgagaaggaauuuagcgagguugaaggccggauucaggaccuugagaaauacguggaggauacaaagaucgaccuguggucuuauaacgccgaacuccugguggcucuggagaaccaacauaccaucgaucucacggacuccgaaaugaauaaacuguucgagaagaccaaaaagcagcuuagagaaaacgcggaggauauggggaauggaugcuuuaagauuuaccacaaaugugacaacgccugcaucggcagcauucgcaaugggacauaugaucauaacgucuaccgggacgaggcucugaauaacagauuccagaucaagggcguggaacucaaaucuggauacaaggacuggauucuguggaucuccuuugccaucagcugcuuccuucuguguguugcccuccugggcuuuauuaugugggcuugccagaaagggaauauccgcuguaacauuugcaucuga

SEQ ID NO: 195367 - RNA, 1701 nt, Artificial Sequence
  derived and/or modified sequence opt5 from hemagglutinin__InfluenzaA__AHZ42867
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacccuugaauuuaauaacgagagcuucaauugggcuggagugacgcagaacggcaccucuuccgccugcauucgcggcagcaauucuuccuuuuucagcagacugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccaaucuuccggccggaucaccguuagcacgaagcgcucccagcaggcugugauuccgaacaucgggucuagaccccggauccgcaauauuccuagcagaaucuccauuuacuggacaaucgucaaacccggagauauucugcugaucaacagcaccggcaaucucaucgccccucggggguacuucaagauucgcucuggaaaauccagcaucaugagaucugacgcucccauuggcaaguguaagagcgaaugcaucacaccgaacggcuccauuccuaaugacaaacccuuucagaacgugaaucggaucaccuauggggccuguccucgcuacgugaagcaaucuacccugaaacuugcgacaggaaugagaaacguccccgagaagcagacgcggggcaucuucggggccauugcuggauuuaucgaaaauggcugggaggggaugguugauggaugguauggcuuccgccaccagaacagcgagggcagagggcaagccgcugaccugaaauccacccaggccgccauugaucagaucaauggaaagcucaaccggcugauuggcaaaacaaaugaaaaguuccaccagaucgagaaggaauuuagcgagguggaagggcgcauucaagaccuugagaaauacguggaggauaccaagaucgaccuguggucuuauaacgcugaacuccuggucgcgcuggagaaccagcauacaaucgaucucaccgacuccgaaaugaauaaacuguucgagaagacgaaaaagcagcuuagagaaaacgccgaggauaugggaaauggcugcuuuaagauuuaccacaaaugugacaacgcuugcaucgggagcauucggaauggcacauaugaucaugacguguacagagacgaggcccugaacaaucgcuuccagaucaagggaguugaacucaaaucugaguacaaggauuggauucuguggaucuccuuugccaucagcugcuuccuucuguguguggcucuccugggcuuuauuaugugggccugccaaaaagggaacauccgguguaauauuugcaucuga

SEQ ID NO: 195368 - RNA, 1701 nt, Artificial Sequence; identical to SEQ ID NO: 192882
  derived and/or modified sequence opt5 from hemagglutinin__InfluenzaA__AHZ42879

SEQ ID NO: 195369 - RNA, 1701 nt, Artificial Sequence
  derived and/or modified sequence opt5 from hemagglutinin__InfluenzaA__AHZ42891
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcuccuguuacccuuaugacgugcccgauuacgcuucucuccgcagccugguugccuccagcgggacccuugaauuuaacaaugagucuuucaacugggcuggagugacgcaaaauggcaccuccagcgccugcauuagacggucuaacuccagcuuuuucucucgccugaauuggcucacacaucugaacuuuaaguauccugcgcuuaaugucaccaugcccaacaacgagcaguucgacaagcuguacaucuggggcgugcaccauccugggacagauaaagaccagauuuuucucuaugcccaguccagcggaagaaucaccguuuccacgaagcggucucaacaggcugugauuccgaauaucggcagccgccccagaauccggaacauuccuucccgcaucagcauuuacuggacaaucgucaaacccggggauauucugcugaucaauucuaccggaaaccucaucgccccuagaggcuacuucaagauucgguccgggaaaagcucuaucaugcgcagcgacgcucccauuggaaaguguaaguccgaaugcaucacaccgaauggcucuauuccuaacgacaaacccuuucagaaugugaacagaaucaccuauggcgccuguccucgguacgugaagcagagcacccugaaacuugcgacagggaugcgcaauguccccgagaagcaaacgagaggaaucuucggcgccauugcuggguuuaucgaaaacggaugggagggcaugguugaugggugguauggauuccggcaccaaaauuccgagggcagaggccaggccgcugaccugaaaagcacccaggccgccauugaucagaucaacgggaagcucaaucgccugauuggaaaaacaaacgaaaaguuccaccagaucgagaaggaauuuucugagguggaaggccggauucaggaccuugagaaauacguggaggauaccaagaucgaccugugguccuauaaugcugaacuccuggucgcgcuggagaaccaacauacaaucgaucucaccgacagcgaaaugaacaaacuguucgagaagacgaaaaagcagcuuagagaaaaugccgaggauauggggaacggaugcuuuaagauuuaccacaaaugugacaaugcuugcaucggcucuauucgcaacgggacauaugaucaugacguguaccgggacgaggcccugaauaacagauuccagaucaagggcguugaacucaaauccggauacaaggauuggauucuguggaucagcuuugccaucuccugcuuccuucuguguguggcucuccugggcuuuauuaugugggccugccagaaagggaauauccgcuguaacauuugcaucuga

SEQ ID NO: 195370 - RNA, 1701 nt, Artificial Sequence
  derived and/or modified sequence opt5 from hemagglutinin__InfluenzaA__AHZ42903
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcaauucuuccuuuuucagccgccuuaacuggcugacccaucucaauuuuaaguauccugcccugaacgucacaaugcccaacaaugagcaguucgacaaacuuuacauuuggggcgugcaccauccugggaccgauaaagaccagaucuuucuguaugcgcagucuuccggaagaauuacgguuagcacaaagcggucccaacaggccgugaucccgaacaucggcucucgcccccggauuagaaauaucccuagccgcauuuccaucuacuggaccauugucaaacccggggauauccuccugaucaacagcacaggaaaucugauugcuccuagaggcuacuucaagauccggucugggaaauccagcauuaugcgcucugacgcccccaucggaaaguguaagagcgaaugcauuaccccgaacggcuccaucccuaaugacaaacccuuucagaacgugaauagaaucaccuauggcgcuuguccucgguacgugaagcagucuacacucaaacuggccacggggaugcgcaacguccccgagaagcaaaccagaggaauuuucggcgcgaucgccggguuuauugaaaauggaugggagggcaugguugaugggugguauggauuccggcaccagaacagcgagggcagaggccaggcugccgaccuuaaauccacacaagcugccaucgaucagauuaaugggaagcugaaccgccucaucggaaaaaccaaugaaaaguuccaccagauugagaaggaauuuagcgagguggaaggccggauccaggaccuggagaaauacguggaggauacaaagaucgaccuuuggucuuauaacgccgaacugcucgucgcucuggagaaccaacauaccauugaucugacggacuccgaaaugaauaaacucuucgagaagacaaagaagcagcugagagaaaacgcggaggauauggggaauggaugcuuuaagaucuaccacaaaugugacaacgccugcauuggcagcauccgcaaugggaccuaugaucauaacguguaccgggacgaggcucuuaauaacagauuccagauuaagggcguugaacugaaaucuggauacaaggacuggauccucuggaucuccuuugccauuagcugcuuccugcuuuguguggcccugcucggcuuuaucaugugggcuugccagaaagggaauauucgcuguaacaucugcauuuga

SEQ ID NO: 195371 - RNA, 1701 nt, Artificial Sequence; identical to SEQ ID NO: 192859
  derived and/or modified sequence opt5 from hemagglutinin__InfluenzaA__AHZ42915

SEQ ID NO: 195372 - RNA, 1683 nt, Artificial Sequence; identical to SEQ ID NO: 193012
  derived and/or modified sequence opt5 from hemagglutinin__InfluenzaA__AHZ59747

SEQ ID NO: 195373 - RNA, 1683 nt, Artificial Sequence
  derived and/or modified sequence opt5 from hemagglutinin__InfluenzaA__AHZ59759
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccaauauuccucgcaucuguuccaagggcaaaagaacaguugaucuggggcaaugcggacuccugggcaccaucacggggccgccccagugugaccaguuucuugaguucucugccgaucugauuaucgaacggcgcgagggaagcgacgugugcuacccuggcaaguuugucaacgaggaagcccucagacagauucugcgggaguccggcgggaucgauaaagaagcuaugggauucaccuauucuggcauucgcacaaauggggccaccagcgcuuguagacgguccggaucuagcuuuuacgccgagaugaaguggcugcucuccaacacagacaaugcggccuucccccaaaugaccaagagcuauaaaaacacgcgcaagucuccugcucugaucguguggggcauucaccauuccguuagcacagccgagcagaccaaacuuuacgggucuggaaauaagcuggugacagucggcuccagcaacuaucagcagucuuuugugcccuccccuggcgcuagaccgcaagugaaugggcucagcggacggaucgauuuccacuggcugaugcuuaaccccaaugacaccgucaccuuuuccuucaacggcgccuuuaucgcgccugaucgcgccucuuuccugagagggaaaagcaugggcauucaguccggaguucagguggacgcuaacugcgaaggggauuguuaccauagcggaggcacaaucauuucuaaucuccccuuucagaacaucgacucccgggccgugggcaagugcccucgcuaugucaagcaaagaagccugcugcucgcuacggggaugaaaaaugugcccgagauuccgaagggacggggccuguucggggccaucgccggauucaucgaaaacggcugggaggggcuuauugauggcugguacggauuuagacaccagaaugcucagggcgaagggaccgcggccgacuacaaaucuacacaaagcgcuaucgaccagauuaccggaaagcugaaccgccucaucgagaaaacaaaucagcaguucgagcugauugauaacgaauuuaaugagguugaaaagcaaaucggcaacgugaucaauuggacccgggacuccauuacggaggucuggucuuauaacgccgaacuucugguggccauggagaaucagcacacaaucgaucucgcugacagcgagauggauaaacuguacgaaagaguuaagcgccagcugcgggagaacgccgaagaggacgggaccggauguuucgaaauuuuucauaagugcgaugacgauuguauggcguccaucagaaauaacaccuaugaccacagcaaaucucgcgaggaggcuaugcagaaccggauucaaaucgauccugugaagcucuccagcggcuacaaagacgucauucugugguucucuuuuggggccuccugcuucauccuucuggccaucgugaugggccucgucuuuauuugcgugaagaauggaaacaugagauguacaaucugcauuuga

SEQ ID NO: 195374 - RNA, 1683 nt, Artificial Sequence
  derived and/or modified sequence opt5 from hemagglutinin__InfluenzaA__AHZ59771
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccaauauuccucgcaucuguuccaagggcaaaagaacaguugaucuggggcaaugcggacuccugggcaccaucacggggccgccccagugugaccaguuucuugaguucucugccgaucugauuaucgaacggcgcgagggaagcgacgugugcuacccuggcaaguuugucaacgaggaagcccucagacagauucugcgggaguccggcgggaucgauaaagaagcuaugggauucaccuauucuggcauucgcacaaauggggccaccagcgcuuguagacgguccggaucuagcuuuuacgccgagaugaaguggcugcucuccaacacagacaaugcggccuucccccaaaugaccaagagcuauaaaaacacgcgcaagucuccugcucugaucguguggggcauucaccauuccguuagcacagccgagcagaccaaacuuuacgggucuggaaauaagcuggugacagucggcuccagcaacuaucagcagucuuuugugcccuccccuggcgcuagaccgcaagugaaugggcagagcggacggaucgauuuccacuggcucaugcugaaccccaaugacaccgucaccuuuuccuucaacggcgccuuuaucgcgccugaucgcgccucuuuccuuagagggaaaagcaugggcauucaguccggaguucagguggacgcuaacugcgaaggggauuguuaccauagcggaggcacaaucauuucuaaucugcccuuucaaaacaucgacucccgggccgugggcaagugcccucgcuaugucaagcagagaagccuccugcuggcuacggggaugaaaaaugugcccgagauuccgaagggacggggccucuucggggccaucgccggauucaucgaaaacggcugggaggggcugauugauggcugguacggauuuagacaccagaaugcucaaggcgaagggaccgcggccgacuacaaaucuacacagagcgcuaucgaccagauuaccggaaaacuuaaccgccugaucgagaagacaaaucagcaauucgagcucauugauaacgaauuuaaugagguugaaaagcagaucggcaacgugaucaauuggacccgggacuccauuacggaggucuggucuuauaacgccgaacugcuuguggccauggagaaucagcacacaaucgaucuggcugacagcgagauggauaaacucuacgaaagaguuaagcgccagcugcgggagaacgccgaagaggacgggaccggauguuucgaaauuuuucauaagugcgaugacgauuguauggcguccaucagaaauaacaccuaugaccacagcaaauaccgcgaggaggcuaugcaaaaccggauucagaucgauccugugaagcugucuuccggcuauaaagacgucauucucugguucagcuuuggggccucuugcuucauccugcuugccaucgugaugggccuggucuuuauuugcgugaagaauggaaacaugagauguacaaucugcauuuga

SEQ ID NO: 195375 - RNA, 1683 nt, Artificial Sequence
  derived and/or modified sequence opt5 from hemagglutinin__InfluenzaA__AHZ59795
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccaauauuccucgcaucuguuccaagggcaaaagaacaguugaucuggggcaaugcggacuccugggcaccaucacggggccgccccagugugaccaguuucuugaguucucugccgaucugauuaucgaacggcgcgagggaagcgacgugugcuacccuggcaaguuugucaacgaggaagcccucagacagauucugcgggaguccggcgggaucgauaaagaagcuaugggauucaccuauucuggcauucgcacaaaugggaccacaagcgccuguagacgguccggaucuagcuuuuacgcugagaugaaguggcugcucuccaacaccgacaaugccgcguucccccaaaugacaaagagcuauaaaaacacgcgcaagucuccugcccugaucguguggggcauucaccauuccguuagcaccgcugagcagacaaaacuuuacgggucuggaaauaagcuggugaccgucggcuccagcaacuaucagcagucuuuugugcccuccccuggcgccagaccgcaagugaaugggcucagcggacggaucgauuuccacuggcugaugcuuaaccccaaugacaccgucacauuuuccuucaacggcgcuuuuaucgccccugaucgcgcgucuuuccugagagggaaaagcaugggcauucaguccggaguucagguggacgccaacugcgaaggggauuguuaccauagcggaggcacgaucauuucuaaucuccccuuucagaacaucgacucccgggcugugggcaagugcccucgcuaugucaagcaaagaagccugcugcucgccaccgggaugaaaaaugugcccgagauuccgaagggacggggccuguucggggcuaucgccggauucaucgaaaacggcugggaggggcuuauugauggcugguacggauuuagacaccagaaugcccagggcgaagggacagcugcggacuacaaaucuacccaaagcgccaucgaccagauuacaggaaagcugaaccgccucaucgagaaaaccaaucagcaguucgagcugauugauaacgaauuuaaugagguugaaaagcaaaucggcaacgugaucaauuggacgcgggacuccauuacagaggucuggucuuauaacgcugaacuucugguggccauggagaaucagcacaccaucgaucucgccgacagcgagauggauaaacuguacgaaagaguuaagcgccagcugcgggagaacgcugaagaggacgggaccggauguuucgaaauuuuucauaagugcgaugacgauuguauggccuccaucagaaauaacacauaugaccacagcaaauaccgcgaggaggcgaugcagaaccggauucaaaucgauccugugaagcucucuuccggcuauaaagacgucauucugugguucagcuuuggggcuucuugcuucauccuucuggccaucgugaugggccucgucuuuauuugcgugaagaauggaaacaugagauguaccaucugcauuuga

SEQ ID NO: 195376 - RNA, 1683 nt, Artificial Sequence; identical to SEQ ID NO: 195375
  derived and/or modified sequence opt5 from hemagglutinin__InfluenzaA__AHZ59807

SEQ ID NO: 195377 - RNA, 1683 nt, Artificial Sequence; identical to SEQ ID NO: 195375
  derived and/or modified sequence opt5 from hemagglutinin__InfluenzaA__AHZ59819

SEQ ID NO: 195378 - RNA, 1683 nt, Artificial Sequence; identical to SEQ ID NO: 193012
  derived and/or modified sequence opt5 from hemagglutinin__InfluenzaA__AHZ59831

SEQ ID NO: 195379 - RNA, 1683 nt, Artificial Sequence; identical to SEQ ID NO: 193012
  derived and/or modified sequence opt5 from hemagglutinin__InfluenzaA__AHZ59843

SEQ ID NO: 195380 - RNA, 1683 nt, Artificial Sequence; identical to SEQ ID NO: 193012
  derived and/or modified sequence opt5 from hemagglutinin__InfluenzaA__AHZ59855

SEQ ID NO: 195381 - RNA, 1683 nt, Artificial Sequence; identical to SEQ ID NO: 195374
  derived and/or modified sequence opt5 from hemagglutinin__InfluenzaA__AHZ59867

SEQ ID NO: 195382 - RNA, 1683 nt, Artificial Sequence; identical to SEQ ID NO: 193012
  derived and/or modified sequence opt5 from hemagglutinin__InfluenzaA__AHZ59879

SEQ ID NO: 195383 - RNA, 1683 nt, Artificial Sequence; identical to SEQ ID NO: 195374
  derived and/or modified sequence opt5 from hemagglutinin__InfluenzaA__AHZ59915

SEQ ID NO: 195384 - RNA, 1683 nt, Artificial Sequence; identical to SEQ ID NO: 193012
  derived and/or modified sequence opt5 from hemagglutinin__InfluenzaA__AHZ59927

SEQ ID NO: 195385 - RNA, 1683 nt, Artificial Sequence; identical to SEQ ID NO: 195374
  derived and/or modified sequence opt5 from hemagglutinin__InfluenzaA__AHZ59939

SEQ ID NO: 195386 - RNA, 1683 nt, Artificial Sequence; identical to SEQ ID NO: 193012
  derived and/or modified sequence opt5 from hemagglutinin__InfluenzaA__AHZ59951

SEQ ID NO: 195387 - RNA, 1683 nt, Artificial Sequence; identical to SEQ ID NO: 193012
  derived and/or modified sequence opt5 from hemagglutinin__InfluenzaA__AHZ59963

SEQ ID NO: 195388 - RNA, 1683 nt, Artificial Sequence; identical to SEQ ID NO: 193012
  derived and/or modified sequence opt5 from hemagglutinin__InfluenzaA__AHZ59988

SEQ ID NO: 195389 - RNA, 1683 nt, Artificial Sequence; identical to SEQ ID NO: 193012
  derived and/or modified sequence opt5 from hemagglutinin__InfluenzaA__AHZ60000

SEQ ID NO: 195390 - RNA, 1683 nt, Artificial Sequence; identical to SEQ ID NO: 193012
  derived and/or modified sequence opt5 from hemagglutinin__InfluenzaA__AHZ60012

SEQ ID NO: 195391 - RNA, 1683 nt, Artificial Sequence; identical to SEQ ID NO: 193012
  derived and/or modified sequence opt5 from hemagglutinin__InfluenzaA__AHZ60024

SEQ ID NO: 195392 - RNA, 1683 nt, Artificial Sequence; identical to SEQ ID NO: 195375
  derived and/or modified sequence opt5 from hemagglutinin__InfluenzaA__AHZ60036

SEQ ID NO: 195393 - RNA, 1683 nt, Artificial Sequence; identical to SEQ ID NO: 195375
  derived and/or modified sequence opt5 from hemagglutinin__InfluenzaA__AHZ60048

SEQ ID NO: 195394 - RNA, 1683 nt, Artificial Sequence; identical to SEQ ID NO: 195375
  derived and/or modified sequence opt5 from hemagglutinin__InfluenzaA__AHZ60060

SEQ ID NO: 195395 - RNA, 1683 nt, Artificial Sequence; identical to SEQ ID NO: 195375
  derived and/or modified sequence opt5 from hemagglutinin__InfluenzaA__AHZ60072

SEQ ID NO: 195396 - RNA, 1683 nt, Artificial Sequence; identical to SEQ ID NO: 195375
  derived and/or modified sequence opt5 from hemagglutinin__InfluenzaA__AHZ60084

SEQ ID NO: 195397 - RNA, 1683 nt, Artificial Sequence
  derived and/or modified sequence opt5 from hemagglutinin__InfluenzaA__AHZ60096
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccaauauuccucgcaucuguuccaagggcaaaagaacaguugaucuggggcaaugcggacuccugggcaccaucacggggccgccccagugugaccaguuucuugaguucucugccgaucugauuaucgaacggcgcgagggaagcgacgugugcuacccuggcaaguuugucaacgaggaagcccucagacagauucugcgggaguccggcgggaucgauaaagaagcuaugggauucaccuauucuggcauucgcacaaauggggccaccagcgcuuguagacgguccggaucuagcuuuuacgccgagaugaaguggcugcucuccaacacagacgaugcggccuucccccaaaugaccaagagcuauaaaaauacgcgcaagucuccugcucugaucguguggggcauucaccauuccguuagcacagccgagcagaccaaacuuuacgggucuggaaacaagcuggugacagucggcuccagcaauuaucagcagucuuuugugcccuccccuggcgcuagaccgcaagugaacgggcucagcggacggaucgacuuccacuggcugaugcuuaaucccaacgauaccgucaccuuuuccuucaauggcgccuuuaucgcgccugaccgcgccucuuuccugagagggaaaagcaugggcauucaguccggaguucagguggaugcuaacugcgaaggggacuguuaccauagcggaggcacaaucauuucuaaccuccccuuucagaauaucgauucccgggccgugggcaagugcccucgcuaugucaagcaaagaagccugcugcucgcuacggggaugaaaaacgugcccgagauuccgaagggacggggccuguucggggccaucgccggauucaucgaaaauggcugggaggggcuuauugacggcugguacggauuuagacaccagaacgcucagggcgaagggaccgcggccgacuacaaaucuacacaaagcgcuaucgaucagauuaccggaaagcugaaucgccucaucgagaaaacaaaccagcaguucgagcugauugacaaugaauuuaacgagguugaaaagcaaaucggcaaugugaucaacuggacccgggauuccauuacggaggucuggucuuauaaugccgaacuucugguggccauggagaaccagcacacaaucgaccucgcugauagcgagauggacaaacuguacgaaagaguuaagcgccagcugcgggagaaugccgaagaggaugggaccggauguuucgaaauuuuucauaagugcgacgaugacuguauggcguccaucagaaacaauaccuaugaucacagcaaauaccgcgaggaggcuaugcagaaccggauucaaaucgacccugugaagcucucuuccggcuauaaagacgucauucugugguucagcuuuggggccucuugcuucauccuucuggccaucgugaugggccucgucuuuauuugcgugaagaacggaaauaugagauguacaaucugcauuuga

SEQ ID NO: 195398 - RNA, 1701 nt, Artificial Sequence
  derived and/or modified sequence opt5 from hemagglutinin__InfluenzaA__AIC64889
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaaaugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaaggaaaacagcuacccuaaacucuccaagagcuauaucaaugacaagggcaaagaggugcugguccuuugggggauucaccaccccuccaccucugccgaucaacagagccuguaccagaacgcugacgccuacguguucgugggauccagcagauauucuaagaaauuuaagccugagaucgcuauucggccgaaaguccgcggccaggaagggagaaugaauuacuauuggacacucguugagcccggagauaagaucaccuucgaagccacgggcaaccugguggugccucgguacgcguuugccauggagcgcaacgcuggguccggaauuaucaucagcgacacacccguccaugauugcaauaccacaugucaaaccccuaaaggcgccauuaacaccucucugcccuuccagaauauccacccgauuacaaucggcaagugcccuaaguaugugaaaagcacgaagcucagacuggcuaccgggcuucggaacguucccuccauucagucucgcggacuguuuggcgccaucgccggguucaucgaaggaggcuggacagggaugguggacggaugguacggcuaucaucaccagaaugagcaaggcagcggguacgcugcggaccucaaauccacccagaacgccauugaugagaucacaaauaaggucaacagcgugauugaaaagaugaauacccaguuuacggcuguuggaaaggaguucaaccaccuggaaaagagaaucgagaaucuuaacaaaaagguggacgauggcuuccuggacauuuggacauacaaugccgaacuccugguccugcucgagaacgagcggacccuggauuaucaugacucuaaugugaaaaaccuuuacgaaaagguccgcucccagcugaaaaacaaugccaaggagaucgggaacggauguuuugaguucuaucacaagugcgauaauaccuguauggagagcgugaaaaacggcacauacgacuauccuaaguacucugaagaggcuaaacucaauagagaggaaaucgaugggguuaagcuggaguccacccggauuuaucaaauccuugccauuuacagcacaguggcguccucucugguccucgugguuagccugggcgcuaucuccuuuuggaugugcucuaacggaagccugcagugccgcauuuguaucuga

SEQ ID NO: 195399 - RNA, 1701 nt, Artificial Sequence; identical to SEQ ID NO: 193064
  derived and/or modified sequence opt5 from hemagglutinin__InfluenzaA__AIC73738

SEQ ID NO: 195400 - RNA, 1701 nt, Artificial Sequence
  derived and/or modified sequence opt5 from hemagglutinin__InfluenzaA__AIC73739
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgccaugccgggagcggaaucauuaucucugacacccccguccacgauugcaauaccacaugucagacgccugagggcgcuaucaacaccucccuccccuuccagaauauucauccgaucacaauuggcaagugcccuaaauauguuaagagcaccaagcugagacuugccacagggcugcggaacgugcccucuauccagagccgcggacucuuuggcgcuauugccggguucaucgaaggaggcuggaccgggaugguggacggaugguacggcuaucaccaccaaaaugagcagggcuccggguacgccgcugaccugaaaucuacgcagaacgcgaucgauaagauuacaaauaaagucaacagcgugaucgagaagaugaauacccaguuuaccgccguuggaaaagaguucaaccaucuugagaagagaauugaaaaucugaacaagaaaguggacgauggcuuccucgacaucuggacauacaaugcugagcugcugguccuccuggaaaacgagcggacccuugauuaucacgacuccaaugugaagaaccuguacgagaaaguccgcaaccaacucaagaauaacgccaaagaaauugggaauggauguuuugaguucuaucauaagugcgauaacacauguauggaaagcgugaagaauggcacguacgacuauccuaaauacucugaggaagccaagcugaacagagagaaaaucgaugggguuaaacuugaguccacccggaucuaucagauucuggcuaucuacagcacaguggccucuucccucguccuggugguuagccugggcgcgauuuccuuuuggaugugcucuaauggaagccuccagugccgcaucuguauuuga

SEQ ID NO: 195401 - RNA, 1701 nt, Artificial Sequence
  derived and/or modified sequence opt5 from hemagglutinin__InfluenzaA__AIC73740
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauuaauuacgaagaacugcgggagcagcuuuccagcgucucuuccuucgaacgcuuugagaucuuccccaagacaagcucuuggccuaaccacgacuccaauaagggagugaccgcugccuguccccaugcuggcgccaagagcuuuuauaaaaaccugaucuggcucguuaaaaagggcaauucuuacccuaaacugucccaaagcuauauuaacgauaaggggaaggaagugcuuguccuguggggaauccaccaucccccuacaaccgcggaccagcagucccucuaccagaaugccgaugcuuacguguucgugggcacgucuagauauagcaaaaaguuuaaaccggagauugccauccggcccaagguccgcgaccaagaggggagaaugaacuacuauuggacacugguugaaccuggagauaaaauuaccuucgaggcuacaggcaaccugguggugccccgguacgccuuuaccauggaacgcaaugcgggguccggaaucauuaucagcgacaccccuguccacgauugcaacacaacgugucagacccccgagggcgccaucaauacaucucucccguuccagaacauucacccuaucaccauuggcaagugccccaaauaugugaaguccacaaagcugagacuugcuaccgggcugcggaauguuccuagcauccagucucgcggacucuuuggcgccauugcuggguucaucgaaggaggcuggacggggaugguggacggaugguacggcuaucaucaccaaaacgagcagggcagcggguacgccgccgaccugaaauccacacagaaugcuaucgauaagauuaccaacaaagucaauucugugaucgagaagaugaacacccaguuuacagcgguuggaaaagaguucaaucaccuugagaagagaauugaaaaccugaauaagaaaguggacgauggcuuccucgacaucuggaccuacaacgccgagcugcugguccuccuggaaaaugagcggacacuugauuaucaugacagcaacgugaagaaccuguacgagaaaguccgcaaucaacucaagaacaaugcuaaagaaauugggaacggauguuuugaguucuaucacaagugcgauaauacguguauggaauccgugaagaacggcaccuacgacuaucccaaauacagcgaggaagccaagcuggauagagagaaaaucgacgggguucggcuugagucuacacgcaucuaucagauucuggccaucuacuccaccguggcuagcucucucguccuggugguuucccugggcgccauuagcuuuuggaugugcuccaauggaucucuccagugcagaaucuguauuuga

SEQ ID NO: 195402 - RNA, 1701 nt, Artificial Sequence
  derived and/or modified sequence opt5 from hemagglutinin__InfluenzaA__AIC73741
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccauugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcagaacggcaccucuuccgccugcauuagaggcagcaauucuuccuuuuucagccggcugaacuggcucacacaccugaauuuuaaguauccugcgcuuaacgucaccaugcccaacaaugagcaauucgacaagcuguacaucuggggagugcaucacccugggacagauaaagaccagauuuuucucuaugcccagucuuccggccgcaucaccguuagcacgaagagaucccagcaagcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcagacgcgcggcaucuucggggccauugcuggauuuaucgaaaauggcugggaggggaugauggauggaugguauggcuucagacaccaaaacagcgagggccgggggcaggccgcugaccugaaauccacccaggccgccauugaucaaaucaauggaaagcucaacagacugauuggcaaaacaaaugaaaaguuccaucagaucgagaaggaauuuagcgagguugaagggcgcauucaggaccuugagaaauacguggaggauaccaagaucgaccuguggucuuauaacgcugaacuccugguggcgcuggagaaccagcacacaaucgaucucaccgacuccgaaaugaauaaacuguucgagaagacgaaaaagcaacuucgggaaaacgccgaggauaugggaaauggcugcuuuaagauuuaccauagaugugacaacgcuugcaucgggagcauucgcaauggcacauaugaucacaacgucuaccgggacgaggcccugaauaacagauuccagauccgcggaguggaacucaaaucuggcuacaaggacuggauucuguggaucuccuuugccaucagcugcuuccuucuguguguugcucuccugggguuuauuaugugggccugccagaaaggaaauauccgguguaacauuugcaucuga

SEQ ID NO: 195403 - RNA, 1701 nt, Artificial Sequence
  derived and/or modified sequence opt5 from hemagglutinin__InfluenzaA__AIC73742
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugagacaauccuauauuaacgauaaggggaaggaagugcuuguccuguggggaauccaccaccccagcaccacaaccgaccagcagucccucuaccagaaugccgaugcuuacguguucgugggcacgucucgguauagcaaaaaguuuaaaccugagauugccauccgcccgaaggucagagaccaagaggggcggaugaacuacuauuggacacugguugaacccggagauaaaauuaccuucgaggcuacaggcaaccugguggugccucgcuacgccuuuaccauggaaagaaaugcgggguccggaaucauuaucagcgacacccccguccaugauugcaacacaacgugucagaccccugagggcgccaucaauacaucucuccccuuccagaacauucacccgaucaccauuggcaagugcccuaaauaugugaaguccacaaagcugcggcuugcuaccgggcugcgcaauguucccagcauccagucuagaggacucuuuggcgccauugcuggguucaucgaaggaggcuggacggggaugguggacggaugguacggcuaucaucaccaaaacgagcagggcagcggguacgccgccgaccugaaauccacacagaaugcuaucgauaagauuaccaacaaagucaauucugugaucgagaagaugaacacccaguuuacagcgguuggaaaagaguucaaucaccuugagaagcggauugaaaaccugaaucgcaagguggacgauggcuuccucgacaucuggaccuacaacgccgagcugcugguccuccuggaaaaugagagaacacuugauuaucaugacagcaacgugaaaaaccuguacgagaagguccggaaucaacucaaaaacaaugcuaaggaaauugggaacggauguuuugaguucuaucacaaaugcgauaauacguguauggaauccgugaagaacggcaccuacgacuauccuaaguacagcgaggaagccaaacugaaucgcgagaagaucgaugggguuaaacuugagucuacaagaaucuaucagauucuggccaucuacuccaccguggcuagcucucucguccuggugguuucccugggcgccauuagcuuuuggaugugcuccaacggaucucuccagugccggaucuguauuuga

SEQ ID NO: 195404 - RNA, 1701 nt, Artificial Sequence; identical to SEQ ID NO: 195403
  derived and/or modified sequence opt5 from hemagglutinin__InfluenzaA__AIC73743

SEQ ID NO: 195405 - RNA, 1701 nt, Artificial Sequence
  derived and/or modified sequence opt5 from hemagglutinin__InfluenzaA__AIC73744
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugaaccaauccuauauuaaugauaaggggaaggaagugcuuguccuguggggaauccaccaccccagcaccacagccgaccagcagucccucuaccagaacgcugaugccuacguguucgugggcaccucuagauauagcaaaaaguuuaaaccugagauugcuauccggccgaagguccgcgaccaagaggggagaaugaacuacuauuggacgcugguugaacccggagauaaaauuacauucgaggccaccggcaaucugguggugccucgguacgcguuuacaauggaacgcaacgccggguccggaaucauuaucagcgacacccccgcucaugauugcaauaccacaugucagacgccugagggcgccaucaacaccucucuccccuuccagaauauucacccgaucacaauuggcaagugcccuaaauaugucaaguccaccaagcugagacuugcuacagggcugcggaacgugcccagcauccagucucgcggacucuuuggcgccauugccggguucaucgaaggaggcuggaccgggaugguugacggaugguacggcuaucaucaccaaaaugagcagggcagcggguacgcugcggaccugaaauccacgcagaacgccaucgauaagauuacaaauaaagugaacucugucaucgagaagaugaauacccaguuuaccgcugugggaaaagaguucaaccaccuugagaagagaauugaaaaucugaacaagaaaguugacgauggcuuccucgacaucuggacauacaaugccgagcugcuggugcuccuggaaaacgagcggacccuugauuaucaugacagcaacgucaagaaucuguacgagaaagugcgcaaccaacucaagaauaacgccaaagaaauugggaauggauguuuugaguucuaucacaagugcgauaacacauguauggaauccgucaagaauggcacguacgacuauccuaaauacagcgaggaagcuaagcugaacagagagaaaaucgauggggugaaacuugagucuacccggaucuaucagauucuggccaucuacuccacaguugcgagcucucucgugcuggucgugucccugggcgcuauuagcuuuuggaugugcuccaauggaucucuccagugccgcaucuguauuuga

SEQ ID NO: 195406 - RNA, 1701 nt, Artificial Sequence
  derived and/or modified sequence opt5 from hemagglutinin__InfluenzaA__AIC73745
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauugggcccugguugaacccggagauaaaauuacguucgaggcgacaggcaaccugguggugccucgguacgccuuuaccauggaacgcaaugcugggagcggaaucauuaucucugacacacccguccaugauugcaacaccaccugucagacaccugagggcgccaucaauacgucccuccccuuccagaacauucacccgaucaccauuggcaagugcccuaaauauguuaagagcacaaagcugagacuugcuaccgggcugcggaauauccccucuauucagagccgcggacucuuuggcgccaucgccggguucaucgaaggaggcuggacagggaugguggacggaugguacggcuaucaucaccaaaacgagcagggcuccggguacgcugcggaccugaaaucuacccagaaugccauugauaagaucacgaacaaagugaauagcgucauugagaagaugaacacacaguuuaccgcugugggaaaagaguucaaucaccuugagaagagaaucgaaaaccugaauaagaaaguugacgauggcuuccucgacauuuggaccuacaacgccgagcugcuggugcuccuggaaaaugagcggacacuugauuaucaugacuccaacgucaagaaccuguacgagaaagugcgcaaucaacucaagaacaaugccaaagaaaucgggaacggauguuuugaguucuaucacaagugcgauaauaccuguauggaaagcgucaagaacggcacauacgacuauccuaaauacucugaggaagcuaagcugaauagagagaaaaucgauggggugaaacuugaguccacgcggauuuaucagauccuggccauuuacagcaccguugcgucuucccucgugcuggucgugagccugggcgcuaucuccuuuuggaugugcucuaacggaagccuccagugccgcauuuguaucuga

SEQ ID NO: 195407 - RNA, 1701 nt, Artificial Sequence
  derived and/or modified sequence opt5 from hemagglutinin__InfluenzaA__AIC73746
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguuacaccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauuaauuacgaagaacugcgggagcagcuuuccagcgucucuuccuucgaacgcuuugagaucuuccccaagacaagcucuuggccuaaccacgacuccaauaagggagugaccgcugccuguccccaugcuggcgccaagagcuuuuauaagaaccugaucuggcucguuaaaaagggcaauucuuacccuaaacugucccaaagcuauauuaacgauaaggggaaggaagugcuuguccuguggggaauccaccaccccuccacaaccacggaccagcagucucucuaccagaaugcggaugccuacguguucgugggcacaagcagauauuccaaaaaguuuaaaccugagauugcuauccggccgaagguccgcgaccaagaggggagaaugaacuacuauuggacccugguugaacccggagauaaaauuacauucgaggccaccggcaaccugguggugccucgguacgcuuuuaccauggaacgcaaugccgggagcggaaucauuaucucugacacacccguccaugauugcaacacgaccugucagacaccugagggcgcgaucaauaccucccuccccuuccagaacauucacccgaucacaauuggcaagugcccuaaauauguuaagagcaccaagcugagacuugccacggggcugcggaaugugcccucuauccagagccgcggacucuuuggcgcuauugccggguucaucgaaggaggcuggacagggaugguggacggaugguacggcuaucaucaccaaaacgagcagggcuccggguacgcugccgaccugaaaucuacccagaaugccaucgauaagauuaccaacaaagucaauagcgugaucgagaagaugaacacacaguuuaccgcuguuggaaaagaguucaaucaccuugagaagagaauugaaaaccugaauaagaaaguggacgauggcuuccucgacaucuggacauacaacgcggagcugcugguccuccuggaaaaugagcggacgcuugauuaucaugacuccaacgugaagaaccuguacgagaaaguccgcaaucaacucaagaacaaugccaaagaaauugggaacggauguuuugaguucuaucacaagugcgauaauaccuguauggaaagcgugaagaacggcacauacgacuauccuaaauacucugaggaagcuaagcugaauagagagaaaaucgaugggguuaaacuugaguccacccggaucuaucagauucuggccaucuacagcacaguggccucuucccucguccuggugguuagccugggcgcuauuuccuuuuggaugugcucuaacggaagccuccagugccgcaucuguauuuga

SEQ ID NO: 195408 - RNA, 1701 nt, Artificial Sequence
  derived and/or modified sequence opt5 from hemagglutinin__InfluenzaA__AIC73747
augaaggccauccuggugguccuccuguacacccuugcuacagccaacgcggacacgcugugcauuggcuaucacgcuaauaacagcaccgauacaguugacaccgugcucgagaaaaaugugacagucacccauuccgugaaccugcuugaagauaagcacaaugggaaacuguguaagcucagaggaguugcuccccugcaucugggcaaaugcaacaucgccggguggauucucggaaauccugagugugaaucucugagcacagccuccucuuggagcuacaucguggagaccuccucuagcgacaacggcacgugcuauccgggggauuucauuaauuacgaggaacuucgggagcagcuguccagcgucucuuccuuugaacgcuucgagaucuuucccaagaccagcucuuggccuaaccacgacuccaauaagggagugacagccgcuuguccccaugccggcgcgaaaucuuucuauaagaaccucaucuggcugguuaaaaagggcaauagcuacccuaaacuuucccaaagcuauauuaacgauaaggggaaggaagugcugguccucuggggaauccaccaccccuccaccacagccgaccagcagucucuguaccagaaugcugaugccuacguguuugugggcaccagcagauauuccaaaaaguucaaaccugagauugcuauccggccgaagguccgcgaccaagaggggagaaugaacuacuauuggacgcugguugaacccggagauaaaauuacauuugaggccaccggcaaccucguggugccucgguacgcguucacaauggaacgcaauaccgggagcggaaucauuaucucugacacccccguccaugauugcaacacaacgugucagaccccugagggcgccaucaauacaucccugcccuuucagaacauucacccgaucaccauuggcaagugcccuaaauauguuaagagcacaaaacuuagacuggcuaccgggcuccggaaugugcccucuauccagagccgcggacuguucggcgccauugcuggguuuaucgaaggaggcuggacggggaugguggacggaugguacggcuaucaucaccaaaacgagcagggcuccggguacgccgccgaccuuaagucuacacagaaugcuaucgauaagauuaccaacaaagucaauagcgugaucgagaagaugaacacccaguucacagcgguuggaaaagaauuuaaucaccuggagaagagaauugaaaaccucaauaagaaaguggacgauggcuuccuggacaucuggaccuacaacgccgagcugcucguccugcuugaaaaugagcggacacuggauuaucaugacuccaacgugaagaaccucuacgagaaaguccgcaaucaacugaagaacaaugcuaaagaaauugggaacggauguuucgaguuuuaucacaagugcgauaauacguguauggaaagcgugaagaacggcaccuacgacuauccuaaauacucugaggaagccaaacuuaauagagagaagaucgaugggguuaagcuggaguccacacggaucuaucagauucucgccaucuacagcaccguggcuucuucccugguccuggugguuagccucggcgccauuuccuucuggaugugcucuaacggaagccugcagugccgcaucuguauuuga

SEQ ID NO: 195409 - RNA, 1701 nt, Artificial Sequence; identical to SEQ ID NO: 193064
  derived and/or modified sequence opt5 from hemagglutinin__InfluenzaA__AIC73748

SEQ ID NO: 195410 - RNA, 1701 nt, Artificial Sequence
  derived and/or modified sequence opt5 from hemagglutinin__InfluenzaA__AIC73749
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugaugggaaaaacuguacacugaucgacgcccuccugggagauccccagugcgacggcuuucagaauaagcggugggaucuguucgucgaacgcucuaaagccuauagcaacuguuacccuuaugacgugcccgauuacgcuucccucagaucucugguugccagcuccgggacccuugaguuuaaugacgaauccuucaacugggcuggagugacgcaaaauggcaccucuuccgccugcauucggggcagcaacucuuccuuuuucagccgccugaauuggcucacacauucuaacuuuaaguauccugcgcugaaugucaccaugcccaacaacgagcaguucgauaaacuuuacaucuggggagugcaccauccugggacagacaaagaucagauuuuucuguaugcccacuccagcggcagaaucaccguuuccacgaagcggucucagcaagcugugauuccgaauaucgggagccgccccagaauccggaacauuccuucccgcaucagcauuuacuggacaaucgucaaacccggagacauucuccugaucaauucuaccggcaaccugaucgccccuagaggguacuucaagauucaguccggaaaaagcucuaucaugcggagcgacgcucccauuggcaaguguaaguccgagugcaucacaccgaauggcucuauuaccaacgauaaaccuuuucagaaugugaaccgcaucaccuauggggccugucccagauacgugaagcagagcacacucaaacuggcgacgggaaugcggaaugucccugaaaagcaaacccgcggcaucuucggggccauugcuggauuuaucgagaacggcugggaagggaugaaagacggaugguauggcuucagacaccagaauagcgagggccgggggcaggccgcugaucuuaagagcacacaagccgccauugaccagaucaacggaaaacugaauagacucauuggcaagaccaacgagaaguuccaucagaucgaaaaagaguuuucugaaguugaggggcgcauucaggaucuggaaaaguacguggaggacacaaaaaucgaucuuugguccuauaaugcugagcugcucguggcgcuggaaaaccaacacaccaucgaccugacggauagcgagaugaacaaacucuucgaaaagacaaagaagcagcugcgggagaaugccgaagacaugggaaacggcugcuuuaagauuuaccauaagugugauaaugcuugcaucgggucuauuagaaacggcaccuaugaccacgacgucuaccgcgaugaggcccuuaauaaccgguuccagaucaaaggaguggagcugaaguccggcuacaaagacuggauucucuggaucagcuuugccaucuccugcuuccugcuuuguguugcucugcucggguuuauuaugugggccugccagaagggaaauaucagauguaacauuugcaucuga

SEQ ID NO: 195411 - RNA, 1701 nt, Artificial Sequence; identical to SEQ ID NO: 193064
  derived and/or modified sequence opt5 from hemagglutinin__InfluenzaA__AIC73750

SEQ ID NO: 195412 - RNA, 1701 nt, Artificial Sequence
  derived and/or modified sequence opt5 from hemagglutinin__InfluenzaA__AIC73754
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauucccggaaauuuaagccugagauugcuauccgcccgaaagucagagaccaagaggggcggaugaacuacuauuggacgcugguugaacccggagauaagauuacauucgaggccaccggcaaccugguggugccucgcuacgcguuuacaauggaaagaaaugccgggagcggaaucauuaucucugacacccccguccaugauugcaacaccacaugucagacgccugagggcgcuaucaauaccucccuccccuuccagaacauucacccgaucacaauuggcaaaugcccuaaguaugugaaaagcaccaagcugcggcuugccacagggcugcgcaauguucccucuauccagagcagaggacucuuuggcgcuauugccggguucaucgaaggaggcuggaccgggaugguggacggaugguacggcuaucaucaccaaaacgagcagggcuccggguacgccgcugaccugaagucuacgcagaaugcgaucgauaaaauuacaaacaaggucaauagcgugaucgagaaaaugaacacccaguuuaccgccguuggaaaggaguucaaucaccuugagaaacggauugaaaaccugaauaagaagguggacgauggcuuccucgacaucuggacauacaacgcugagcugcugguccuccuggaaaaugagcgcacccuugauuaucaugacuccaacgugaaaaaccuguacgagaaggucagaaaucaacucaaaaacaaugccaaggaaauugggaacggauguuuugaguucuaucacaaaugcgauaauacauguauggaaagcgugaagaacggcacguacgacuauccuaaguacucugaggaagccaaacugaaucgggagaagaucgaugggguuaaacuugaguccacccgcaucuaucagauucuggcuaucuacagcacaguggccucuucccucguccuggugguuagccugggcgcgauuuccuuuuggaugugcucuaacggaagccuccagugcagaaucuguauuuga

SEQ ID NO: 195413 - RNA, 1701 nt, Artificial Sequence; identical to SEQ ID NO: 193064
  derived and/or modified sequence opt5 from hemagglutinin__InfluenzaA__AIC73755

SEQ ID NO: 195414 - RNA, 1701 nt, Artificial Sequence; identical to SEQ ID NO: 193064
  derived and/or modified sequence opt5 from hemagglutinin__InfluenzaA__AIC73756

SEQ ID NO: 195415 - RNA, 1701 nt, Artificial Sequence; identical to SEQ ID NO: 193064
  derived and/or modified sequence opt5 from hemagglutinin__InfluenzaA__AIC73757

SEQ ID NO: 195416 - RNA, 1701 nt, Artificial Sequence
  derived and/or modified sequence opt5 from hemagglutinin__InfluenzaA__AIC73758
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaaucgcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucaauuacgaagaacugcgggagcagcuuuccagcgugucuuccuucgaacgcuuugagaucuuccccaagaccagcucuuggccuaaccacgacuccaauaagggagucacagccgcuuguccccaugccggcgcgaaaucuuuuuauaagaaccugauuuggcucgugaaaaagggcaauagcuacccuaaacugucccaaagcuauaucaacgauaaggggaaggaaguucuugugcuguggggcauucaccaccccuccaccacagccgaccagcagucucucuaccagaaugcugaugccuacgucuucgugggaaccagcagauauuccaaaaaguuuaaaccugagaucgcuauucggccgaaggugcgcgaccaagaggggagaaugaacuacuauuggacgcuggucgaacccggagauaaaaucacauucgaggccaccggcaaccugguugugccucgguacgcguuuacaauggaacgcaaugccgggagcggaauuaucaucucugacacccccgugcaugauugcaacaccacaugucagacgccugagggcgcuauuaauaccucccuccccuuccagaacauccacccgauuacaaucggcaagugcccuaaauaugucaagagcaccaagcugagacuugccacagggcugcggaaugugcccucuauucagagccgcggacucuuuggcgcuaucgccggguucaucgaaggaggcuggaccgggaugguugacggaugguacggcuaucaucaccaaaacgagcagggcuccggguacgccgcugaccugaaaucuacgcagaaugcgauugauaagaucacaaacaaagugaauagcgucauugagaagaugaacacccaguuuaccgccgugggaaaagaguucaaucaccuugagaagagaaucgaaaaccugaauaagaaaguugacgauggcuuccucgacauuuggacauacaacgcugagcugcuggugcuccuggaaaaugagcggacccuugauuaucaugacuccaacgucaagaaccuguacgagaaagugcgcaaucaacucaagaacaaugccaaagaaaucgggaacggauguuuugaguucuaucacaagugcgauaauacauguauggaaagcgucaagaacggcacguacgacuauccuaaauacucugaggaagccaagcugaauagagagaaaaucgauggggugaaacuugaguccacccggauuuaucagauccuggcuauuuacagcacaguugccucuucccucgugcuggucgugagccugggcgcgaucuccuuuuggaugugcucuaacggaagccuccagugccgcauuuguaucuga

SEQ ID NO: 195417 - RNA, 1701 nt, Artificial Sequence
  derived and/or modified sequence opt5 from hemagglutinin__InfluenzaA__AIC73760
augaaggccauccugauugugcuccuguacaccuucgcuacagccaacgcggacacgcuuugcaucggcuaucacgcuaauaacagcaccgauacagucgacaccguucuggagaagaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucaauuacgaagaacugcgggagcagcuuuccagcgugucuuccuucgaacgcuuugagaucuuccccaagaccagcucuuggccuaaccacgacuccaauaagggagucacagccgcuuguccccaugccggcgcgaaaucuuuuuauaagaaccugauuuggcucgugaaaaagggcaauagcuacccuaaacugucccaaagcuauaucaacgauaaggggaaggaaguucuugugcuguggggcauucaccaccccuccaccacagccgaccagcagucucucuaccagaaugcugaugccuacgucuucgugggaaccagcagauauuccaaaaaguuuaaaccugagaucgcuauucggccgaaggugcgcgaccaagaggggagaaugaacuacuauuggacgcuggucgaacccggagauaaaaucacauucgaggccaccggcaaccugguugugccucgguacgcguuuacaauggaacgcaaugccgggagcggaauuaucaucucugacacccccgugcaugauugcaacaccacaugucagacgccugagggcgcuauuaauaccucccuccccuuccagaacauccacccgauuacaaucggcaagugcccuaaauaugucaagagcaccaagcugagacuugccacagggcugcggaaugugcccucuauucagagccgcggacucuuuggcgcuaucgccggguucaucgaaggaggcuggaccgggaugguugacggaugguacggcuaucaucaccaaaacgagcagggcuccggguacgccgcugaccugaaaucuacgcagaaugcgauugauaagaucacaaacaaagugaauagcgucauugagaagaugaacacccaguuuaccgccgugggaaaagaguucaaucaccuugagaagagaaucgaaaaccugaauaagaaaguugacgauggcuuccucgacauuuggacauacaacgcugagcugcuggugcuccuggaaaaugagcggacccuugauuaucaugacuccaacgucaagaaccuguacgagaaagugcgcaaucaacucaagaacaaugccaaagaaaucgggaacggauguuuugaguucuaucacaagugcgauaauacauguauggaaagcgucaagaacggcacguacgacuauccuaaauacucugaggaagccaagcugaauagagagaaaaucgauggggugaaacuugaguccacccggauuuaucagauccuggcuauuuacagcacaguugccucuucccucgugcuggucgugagccugggcgcgaucuccuuuuggaugugcucuaacggaagccuccagugccgcauuuguaucuga

SEQ ID NO: 195418 - RNA, 1701 nt, Artificial Sequence; identical to SEQ ID NO: 195417
  derived and/or modified sequence opt5 from hemagglutinin__InfluenzaA__AIC73761

SEQ ID NO: 195419 - RNA, 1701 nt, Artificial Sequence; identical to SEQ ID NO: 194944
  derived and/or modified sequence opt5 from hemagglutinin__InfluenzaA__AIC73762

SEQ ID NO: 195420 - RNA, 1701 nt, Artificial Sequence
  derived and/or modified sequence opt5 from hemagglutinin__InfluenzaA__AIC73763
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaaauuucccaaagcuauaucaacgauaaggggaaggaagugcugguccuuuggggcauucaccaccccuccaccacagccgaccagcagucucuguaccagaaugcugaugccuacguguucgugggaaccagcagauauuccaaaaaguuuaaaccugagaucgcuauucggccgaagguccgcgaccaagaggggagaaugaacuacuauuggacgcucguugaacccggagauaaaaucacauucgaggccaccggcaaccugguggugccucgguacgcguuuacaauggaacgcaaugccgggagcggaauuaucaucucugacacccccguccaugauugcaacaccacaugucagacgccugagggcgcuauuaauaccucccugcccuuccagaacauccacccgauuacaaucggcaagugcccuaaauauguuaagagcaccaagcucagacuggccacagggcuucggaaugugcccucuauucagagccgcggacuguuuggcgcuaucgccggguucaucgaaggaggcuggaccgggaugguggacggaugguacggcuaucaucaccaaaacgagcagggcuccggguacgccgcugaccucaaaucuacgcagaaugcgauugauaagaucacaaacaaagucaauagcgugauugagaagaugaacacccaguuuaccgccguuggaaaagaguucaaucaccuggagaagagaaucgaaaaccuuaauaagaaaguggacgauggcuuccuggacauuuggacauacaacgcugagcuccugguccugcucgaaaaugagcggacccuggauuaucaugacuccaacgugaagaaccuuuacgagaaaguccgcaaucaacugaagaacaaugccaaagaaaucgggaacggauguuuugaguucuaucacaagugcgauaauacauguauggaaagcgugaagaacggcacguacgacuauccuaaauacucugaggaagccaagcucaauagagagaaaaucgaugggguuaagcuggaguccacccggauuuaucagauccuugcuauuuacagcacaguggccucuucccugguccucgugguuagccugggcgcgaucuccuuuuggaugugcucuaacggaagccugcagugccgcauuuguaucuga

SEQ ID NO: 195421 - RNA, 1701 nt, Artificial Sequence; identical to SEQ ID NO: 193064
  derived and/or modified sequence opt5 from hemagglutinin__InfluenzaA__AIC73765

SEQ ID NO: 195422 - RNA, 1701 nt, Artificial Sequence; identical to SEQ ID NO: 193064
  derived and/or modified sequence opt5 from hemagglutinin__InfluenzaA__AIC73766

SEQ ID NO: 195423 - RNA, 1701 nt, Artificial Sequence
  derived and/or modified sequence opt5 from hemagglutinin__InfluenzaA__AIC73767
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucauuaaaaagggcaauagcuacccuaaacugucccaaagcuauaucaacgauaaggggaaggaaguucuugugcuguggggcauucaccaccccuccaccacagccgaccagcagucucucuaccagaaugcugaugccuacgucuucgugggaaccagcagauauuccaaaaaguuuaaaccugagaucgcuauucggccgaaggugcgcgaccaagaggggagaaugaacuacuauuggacgcuggucgaacccggagauaaaaucacauucgaggccaccggcaaccugguugugccucgguacgcguuuacaauggaacgcaaugccgggagcggaauuaucaucucugacacccccgugcaugauugcaacaccacaugucagacgccugagggcgcuauuaauaccucccuccccuuccagaacauccacccgauuacaaucggcaagugcccuaaauaugucaagagcaccaagcugagacuugccacagggcugcggaauauucccucuauccagagccgcggacucuuuggcgcuaucgccggguucauugaaggaggcuggaccgggaugguggacggaugguacggcuaucaucaccaaaacgagcagggcuccggguacgccgcugaccugaaaucuacgcagaaugcgaucgauaagauuacaaacaaaguuaauagcgugaucgagaagaugaacacccaguuuaccgccgucggaaaagaguucaaucaccuugagaagagaauugaaaaccugaauaagaaaguggacgauggcuuccucgacaucuggacauacaacgcugagcugcugguucuccuggaaaaugagcggacccuugauuaucaugacuccaacgugaagaaccuguacgagaaaauccgcaaucaacucaagaacaaugccaaagaaauugggaacggauguuuugaguucuaucacaagugcgauaauauguguauggaaagcgucaagaacggcacauacgacuauccuaaauacucugaggaagccaagcugaauagagagaaaaucgauggggugaaacuugaguccacgcggauuuaucagauccuggcuauuuacagcaccgucgccucuucccucgugcugguugugagccugggcgcgaucuccuuuuggaugugcucuaacggaagccuccagugccgcauuuguaucuga

SEQ ID NO: 195424 - RNA, 1701 nt, Artificial Sequence; identical to SEQ ID NO: 193064
  derived and/or modified sequence opt5 from hemagglutinin__InfluenzaA__AIC73768

SEQ ID NO: 195425 - RNA, 1701 nt, Artificial Sequence; identical to SEQ ID NO: 193064
  derived and/or modified sequence opt5 from hemagglutinin__InfluenzaA__AIC73769

SEQ ID NO: 195426 - RNA, 1701 nt, Artificial Sequence; identical to SEQ ID NO: 193064
  derived and/or modified sequence opt5 from hemagglutinin__InfluenzaA__AIC73770

SEQ ID NO: 195427 - RNA, 1701 nt, Artificial Sequence; identical to SEQ ID NO: 193064
  derived and/or modified sequence opt5 from hemagglutinin__InfluenzaA__AIC73771

SEQ ID NO: 195428 - RNA, 1701 nt, Artificial Sequence
  derived and/or modified sequence opt5 from hemagglutinin__InfluenzaA__AIC73772
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauauguuaagagcaccaagcugagacuugccacagggcugcggaaugugcccucuauccagagccgcggacucuuuggcgcuauugccggguucaucgaaggaggcuggaccgggaugguggacggaugguacggcuaucaucaccaaaacgagcagggcuccggguacgccgcugaccugaaaucuacgcagaaugcgaucgauaagauuacaaacaaagucaauagcgugaucgagaagaugaacacccaguuuaccgccguuggaaaagaguucaaucaccuugagaagagaauugaaaaccugaauaagaaaguggacgauggcuuccucgacaucuggacauacaacgcugagcugcugguccuccuggaaaaugagcggacccuugauuaucaugacuccaacgugaagaaccuguacgagaaaguccgcaaucaacucaagaacaaugccaaagaaauugggaacggauguuuugaguucuaucacaagugcgauaauacauguauggaaagcgugaagaacggcacguacgacuauccuaaauacucugaggaagccaagcugaauagagagaaaaucgaugggguuaaacuugaguccacccggguguaucagauccuggcuauuuacagcacagucgccucuucccucgugcugguugugagccugggcgcgaucuccuuuuggaugugcucuaacggaagccuccagugccgcauuuguaucuga

SEQ ID NO: 195429 - RNA, 1701 nt, Artificial Sequence; identical to SEQ ID NO: 193064
  derived and/or modified sequence opt5 from hemagglutinin__InfluenzaA__AIC73773

SEQ ID NO: 195430 - RNA, 1701 nt, Artificial Sequence; identical to SEQ ID NO: 193064
  derived and/or modified sequence opt5 from hemagglutinin__InfluenzaA__AIC73775

SEQ ID NO: 195431 - RNA, 1701 nt, Artificial Sequence; identical to SEQ ID NO: 193064
  derived and/or modified sequence opt5 from hemagglutinin__InfluenzaA__AIC73776

SEQ ID NO: 195432 - RNA, 1701 nt, Artificial Sequence; identical to SEQ ID NO: 195428
  derived and/or modified sequence opt5 from hemagglutinin__InfluenzaA__AIC73777

SEQ ID NO: 195433 - RNA, 1701 nt, Artificial Sequence
  derived and/or modified sequence opt5 from hemagglutinin__InfluenzaA__AIC73778
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagcccauagcaacuguuauccuuacgacgugcccgauuaugcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaccugaauuuuaaguacccugcccuuaacgucacaaugcccaacaaugagcaguucgacaagcuguauaucuggggcgugcaucacccugggaccgauaaagaccagauuuuucucuacgcgcagucuuccggaagaaucacgguuagcacaaagcggucccaacaggccgugauuccgaacaucggcucucgccccagaauccggaauauuccuagccgcaucuccauuuauuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuacggcgcuuguccucgguaugugaagcagucuacacugaaacuugccacggggaugcgcaacguccccgagaagcaaaccagaggaaucuucggcgcgauugccggguuuaucgaaaauggaugggagggcaugguugaugggugguacggauuccggcaccagaacagcgagggcagaggccaggcugccgaccugaaauccacacaagcugccauugaucagaucaaugggaagcucaaccgccugauuggaaaaaccaaugaaaaguuccaucagaucgagaaggaauuuagcgagguggaaggccggauucaggaccuugagaaauauguggaggauacaaagaucgaccuguggucuuacaacgccgaacuccuggucgcucuggagaaccaacacaccaucgaucucacggacuccgaaaugaauaaacuguucgagaagaccaaaaagcagcuuagagaaaacgcggaggauauggggaauggaugcuuuaagauuuaucauaaaugugacaacgccugcaucggcagcauucgcaaugggacauacgaucacaacguguaucgggacgaggcucugaauaacagauuccagaucaagggcguugaacucaaaucuggauacaaggacuggauucuguggaucuccuuugccaucagcugcuuccuucuguguguggcccuccugggcuuuauuaugugggcuugccagaaagggaauauccgcuguaacauuugcaucuga

SEQ ID NO: 195434 - RNA, 1701 nt, Artificial Sequence; identical to SEQ ID NO: 195433
  derived and/or modified sequence opt5 from hemagglutinin__InfluenzaA__AIC73779

SEQ ID NO: 195435 - RNA, 1701 nt, Artificial Sequence; identical to SEQ ID NO: 195433
  derived and/or modified sequence opt5 from hemagglutinin__InfluenzaA__AIC73780

SEQ ID NO: 195436 - RNA, 1701 nt, Artificial Sequence; identical to SEQ ID NO: 194022
  derived and/or modified sequence opt5 from hemagglutinin__InfluenzaA__AIC73781

SEQ ID NO: 195437 - RNA, 1701 nt, Artificial Sequence; identical to SEQ ID NO: 195433
  derived and/or modified sequence opt5 from hemagglutinin__InfluenzaA__AIC73782

SEQ ID NO: 195438 - RNA, 1701 nt, Artificial Sequence; identical to SEQ ID NO: 195433
  derived and/or modified sequence opt5 from hemagglutinin__InfluenzaA__AIC73783

SEQ ID NO: 195439 - RNA, 1701 nt, Artificial Sequence; identical to SEQ ID NO: 195433
  derived and/or modified sequence opt5 from hemagglutinin__InfluenzaA__AIC73784

SEQ ID NO: 195440 - RNA, 1701 nt, Artificial Sequence; identical to SEQ ID NO: 193064
  derived and/or modified sequence opt5 from hemagglutinin__InfluenzaA__AIC73785

SEQ ID NO: 195441 - RNA, 1701 nt, Artificial Sequence; identical to SEQ ID NO: 195433
  derived and/or modified sequence opt5 from hemagglutinin__InfluenzaA__AIC73786

SEQ ID NO: 195442 - RNA, 1701 nt, Artificial Sequence; identical to SEQ ID NO: 193064
  derived and/or modified sequence opt5 from hemagglutinin__InfluenzaA__AIC73787

SEQ ID NO: 195443 - RNA, 1701 nt, Artificial Sequence; identical to SEQ ID NO: 193064
  derived and/or modified sequence opt5 from hemagglutinin__InfluenzaA__AIC73788

SEQ ID NO: 195444 - RNA, 1701 nt, Artificial Sequence
  derived and/or modified sequence opt5 from hemagglutinin__InfluenzaA__AIC73789
augaagaccaucauugcccugagcuacauccucugccugguguucgcucagaaacccccuggcaacgacaauuccacagccacgcuuugucuggggcaccaugcggucccgaacggaaccauuguuaagacaaucaccaaugauagaauugaggugacaaacgcuaccgaacucgugcaaaauucuagcaucggcgagaucugcgacucuccccaccagauucuggauggggaaaacuguacacuuaucgacgcccugcucggagauccucagugcgacggcuuucagaauaaaaagugggaucuguucgucgagcgguccaaagccuauagcaacuguuaccccuaugacgugccugauuacgcuucccugcgcucucucguugccagcuccgggacccuggaauuuaauaacgagagcuucaauugggcuggagugacgcaaaacggcaccucuuccgccugcauuagaggcagcaauucuuccuuuuucagccggcuuaacuggcugacacaucucaauuuuaaguaucccgcgcugaacgucaccaugccuaacaaugagcaguucgacaaacuuuacaucuggggagugcaccauccggggacagauaaggaccagauuuuucuguaugcccagucuuccggccgcaucaccguuagcacgaagagaucccaacaggcugugauucccaacaucgggucucggccucgcaucagaaauauucccagccggaucuccauuuacuggacaaucgucaaaccuggagauauucuccugaucaacagcaccggcaaucugaucgcuccccgcggguacuucaagauuagaucuggaaaauccagcaucaugcggucugacgccccgauuggcaaguguaagagcgaaugcaucacaccuaacggcuccauucccaaugacaaaccuuuucagaacgugaaucgcaucaccuauggggccugucccagauacgugaagcagucuacccucaaacuggcgacaggaaugcggaacguccccgagaagcaaacgcgcggcaucuucggggccauugcuggauuuaucgaaaauggcugggaggggaugguugauggaugguauggcuucagacaccagaacagcgagggccgggggcaggccgcugaccuuaaauccacccaagccgccauugaucagaucaauggaaagcugaacagacucauuggcaaaacaaaugaaaaguuccaccagaucgagaaggaauuuagcgagguggaagggcgcauucaggaccuggagaaauacguggaggauaccaagaucgaccuuuggucuuauaacgcugaacugcucgucgcgcuggagaaccaacauacaaucgaucugaccgacuccgaaaugaauaaacucuucgagaagacgaaaaagcagcugcgggaaaacgccgaggauaugggaaauggcugcuuuaagauuuaccacaaaugugacaacgcuugcaucgggagcauuagaaauggcacauaugaucaugacguguaccgcgacgaggcccuuaacaaucgguuccagaucaagggaguugaacugaaaucuggcuacaaggauuggauucucuggaucuccuuugccaucagcugcuuccugcuuugugugguccugcucggguuuauuaugugggcuugccagaaaggaaacaucagauguaauauuugcaucuga

SEQ ID NO: 195445 - RNA, 1701 nt, Artificial Sequence
  derived and/or modified sequence opt5 from hemagglutinin__InfluenzaA__AIC73790
augaaggccauccuggugguccuccuguacaccuucgcuacaacgaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauuaauuacgaagaacugcgggagcagcuuuccagcgucucuuccuucgaacgcuuugagaucuuccccaagacaagcucuuggccuaaccacgacuccaauaagggagugaccgcugccuguccccaugcuggcgccaagagcuuuuauaagaaccugaucuggcucguuaaaaagggcaauucuuacccuaaacugagacaauccuauauuaacgauaaggggaaggaagugcuuguccuguggggaauccaccaccccagcacaaccacggaccagcagucccucuaccagaaugcggaugccuacguguucgugggcacaucucgguauagcaaaaaguuuaaaccugagauugcuauccgcccgaaggucagagaccaagaggggcggaugaacuacuauuggacccugguugaacccggagauaaaauuacauucgaggccaccggcaaccugguggugccucgcuacgcuuuuaccauggaaagaaaugccggguccggaaucauuaucagcgacacacccguccaugauugcaacacgaccugucagacaccugagggcgcgaucaauaccucucuccccuuccagaacauucacccgaucacaauuggcaagugcccuaaauaugugaaguccaccaagcugcggcuugccacggggcugcgcaauguucccagcauccagucuagaggacucuuuggcgcuauugccggguucaucgaaggaggcuggacagggaugguggacggaugguacggcuaucaucaccaaaacgagcagggcagcggguacgcugccgaccugaaauccacccagaaugccaucgauaagauuaccaacaaagucaauucugugaucgagaagaugaacacacaguuuaccgcuguuggaaaagaguucaaucaccuugagaagcggauugaaaaccugaauaagaaaguggacgauggcuuccucgacaucuggacauacaacgcggagcugcugguccuccuggaaaaugagcgcacgcuugauuaucaugacagcaacgugaagaaccuguacgagaaagucagaaaucaacucaagaacaaugccaaagaaauugggaacggauguuuugaguucuaucacaagugcgauaauaccuguauggaauccgugaagaacggcacauacgacuauccuaaauacagcgaggaagcuaagcugaaucgggagaaaaucgaugggguuaaacuugagucuacccgcaucuaucagauucuggccaucuacuccacaguggccagcucucucguccuggugguuucccugggcgcuauuagcuuuuggaugugcuccaacggaucucuccagugcagaaucuguauuuga

SEQ ID NO: 195446 - RNA, 1701 nt, Artificial Sequence
  derived and/or modified sequence opt5 from hemagglutinin__InfluenzaA__AIC73791
augaaggccauccuggugguccuccuguacaccuucgcuacagccaacgcggacacgcuuugcauuggcuaucacgcuaauaacagcaccgauacaaucgacaccguucuggagaagaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucaauuacgaagaacugcgggagcagcuuuccagcgugucuuccuucgaacgcuuugagaucuuccccaagaccagcucuuggccuaaccacgacuccaauaagggagucacagccgcuuguccccaugccggcgcgaaaucuuuuuauaagaaccugauuuggcucgugaaaaagggcaauagcuacccuaaacugucccaaagcuauaucaacgauaaggggaaggaaguucuugugcuguggggcauucaccaccccuccaccacagccgaccagcagucucucuaccagaaugcugaugccuacgucuucgugggaaccagcagauauuccaaaaaguuuaaaccugagaucgcuauucggccgaaggugcgcgaccaagaggggagaaugaacuacuauuggacgcuggucgaacccggagauaaaaucacauucgaggccaccggcaaccugguugugccucgguacgcguuuacaauggaacgcaaugccgggagcggaauuaucaucucugacacccccgugcaugauugcaacaccacaugucagacgccugagggcgcuauuaauaccucccuccccuuccagaacauccacccgauuacaaucggcaagugcccuaaauaugucaagagcaccaagcugagacuugccacagggcugcggaaugugcccucuauucagagccgcggacucuuuggcgcuaucgccggguucaucgaaggaggcuggaccgggaugguugacggaugguacggcuaucaucaccaaaacgagcagggcuccggguacgccgcugaccugaaaucuacgcagaaugcgauugauaagaucacaaacaaagugaauagcgucauugagaagaugaacacccaguuuaccgccgugggaaaagaguucaaucaccuugagaagagaaucgaaaaccugaauaagaaaguugacgauggcuuccucgacauuuggacauacaacgcugagcugcuggugcuccuggaaaaugagcggacccuugauuaucaugacuccaacgucaagaaccuguacgagaaagugcgcaaucaacucaagaacaaugccaaagaaaucgggaacggauguuuugaguucuaucacaagugcgauaauacauguauggaaagcgucaagaacggcacguacgacuauccuaaauacucugaggaagccaagcugaauagagagaaaaucgauggggugaaacuugaguccacccggauuuaucagauccuggcuauuuacagcacaguugccucuucccucgugcuggucgugagccugggcgcgaucuccuuuuggaugugcucuaacggaagccuccagugccgcauuuguaucuga

SEQ ID NO: 195447 - RNA, 1701 nt, Artificial Sequence; identical to SEQ ID NO: 193064
  derived and/or modified sequence opt5 from hemagglutinin__InfluenzaA__AIC73792

SEQ ID NO: 195448 - RNA, 1701 nt, Artificial Sequence; identical to SEQ ID NO: 195428
  derived and/or modified sequence opt5 from hemagglutinin__InfluenzaA__AIC73793

SEQ ID NO: 195449 - RNA, 1701 nt, Artificial Sequence
  derived and/or modified sequence opt5 from hemagglutinin__InfluenzaA__AIC73794
augaagaccaucauuggcgugagcuacauccugugccucgucuucgcccagaaacugcccgggaacgacaauuccacagcuacgcuuugucugggacaccaugccguuccuaacggcaccauugugaagacaaucaccaaugauagaauugaggugacaaacgcgaccgaacucguccaaaauucuagcaucggggagaucugcgacuccccgcaccagauucuggauggagaaaacuguacacuuaucgacgcucugcucggcgauccccagugcgacggguuucagaauaaaaagugggaucuguucguggagcggucuaaagccuauagcaacuguuacccuuaugacguucccgauuacgccucccugcgcucucucguggcuagcuccggaacccuggaauuuaauaacgagagcuucaauugggccggcgucacgcaaaacggcaccucuuccagcugcauuagagggucuaauuccagcuuuuucucucggcuuaacuggcugacacaucucaauuccaaguauccugcucugaacgugaccaugcccaacaaugagcaguuugacaagcuguacaucuggggaguucaccauccuggcacagauaaagaccagauuuuccuguaugcccagagcuccgggcgcaucaccgugucuacgaagagaagccaacaggcggucauuccgaacaucggaucccggccccgcaucagagauauuccuagccggaucucuauuuacuggacaaucgugaaacccggcgacauucuccugaucaauuccaccgggaaccugaucgccccucgcggauacuuuaagauuagaagcggcaaaucuagcaucaugcgguccgacgcucccauuggcaaguguaagucugaaugcaucacaccgaaugggagcauuccuaacgauaaacccuuccagaaugugaaccgcaucaccuauggagccuguccuagauacgucaagcaguccacccucaaacuggcuacaggcaugcggaauguucccgagcgccaaacgagagggaucuuuggagccauugcgggcuucaucgaaaacgggugggagggaaugguggacggcugguauggcuuucggcaccagaauagcgaggggagaggacaggccgcugaucuuaagucuacccaagccgcuauugaccagaucaacggcaaacugaaucgccucauugggaagacaaacgaaaaauuccaccagaucgagaaggaguucuccgaaguggaaggacggauucaggaucuggagaaguacgucgaggacaccaaaaucgaucuuuggagcuauaaugccgaacugcucguggcccuggagaaccaacauacaaucgaccugaccgauucugaaaugaacaagcucuuugagaaaacgaagaaacagcugagagaaaaugcugaggacaugggcaacgggugcuucaagauuuaccacaagugugauaaugcgugcaucggcuccauucgcaacggaacauaugaccaugacguuuaccgggaugaggcccuuaauaacagauuucagaucaaaggcguggaacuuaagagcggguacaaagacuggauucucuggaucuccuucgcuaucucuugcuuucugcuuugugucgcccugcucggauucauuaugugggccugccagaagggcaauauccgcuguaacauuugcaucuga

SEQ ID NO: 195450 - RNA, 1701 nt, Artificial Sequence; identical to SEQ ID NO: 193064
  derived and/or modified sequence opt5 from hemagglutinin__InfluenzaA__AIC73796

SEQ ID NO: 195451 - RNA, 1701 nt, Artificial Sequence
  derived and/or modified sequence opt5 from hemagglutinin__InfluenzaA__AIC73797
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccagcugcauuagaggcucuaauuccagcuuuuucucucggcugaacuggcucacacaucuuaauuccaaguauccugcccugaacgucaccaugcccaacaaugagcaguuugacaagcuguacaucuggggagugcaccauccugggacagauaaagaccagauuuuccucuaugcgcagagcuccggccgcaucaccguuucuacgaagagaagccaacaggccgugauuccgaacaucgggucccggccccgcaucagagauauuccuagccggaucucuauuuacuggacaaucgucaaacccggagacauucugcugaucaauuccaccggcaaccucaucgcuccucgcggguacuuuaagauuagaagcggaaaaucuagcaucaugcgguccgacgcccccauuggcaaguguaagucugaaugcaucacaccgaauggcagcauuccuaacgauaaacccuuccagaaugugaaccgcaucaccuauggggcuuguccuagauacgugaagcaguccacccugaaacuugccacaggaaugcggaauguccccgagcgccaaacgagaggcaucuuuggggcgauugccggauucaucgaaaacggcugggaggggaugguugacggaugguauggcuuucggcaccagaauagcgagggcagagggcaggcugccgaucugaagucuacccaagcugccauugaccagaucaacggaaaacucaaucgccugauuggcaagacaaacgaaaaauuccaccagaucgagaaggaguucuccgaaguggaagggcggauucaggaucuugagaaguacguggaggacaccaaaaucgaucuguggagcuauaaugccgaacuccuggucgcucuggagaaccaacauacaaucgaccucaccgauucugaaaugaacaagcuguuugagaaaacgaagaaacagcuuagagaaaaugcggaggacaugggaaacggcugcuucaagauuuaccacaagugugauaaugccugcaucggguccauucgcaacggcacauaugaccaugacguguaccgggaugaggcucugaauaacagauuucagaucaaaggaguugaacucaagagcggcuacaaagacuggauucuguggaucuccuucgccaucucuugcuuucuucuguguguggcccuccugggguucauuaugugggcuugccagaagggaaauauccgcuguaacauuugcaucuga

SEQ ID NO: 195452 - RNA, 1701 nt, Artificial Sequence; identical to SEQ ID NO: 195451
  derived and/or modified sequence opt5 from hemagglutinin__InfluenzaA__AIC73798

SEQ ID NO: 195453 - RNA, 1701 nt, Artificial Sequence; identical to SEQ ID NO: 195451
  derived and/or modified sequence opt5 from hemagglutinin__InfluenzaA__AIC73800

SEQ ID NO: 195454 - RNA, 1701 nt, Artificial Sequence; identical to SEQ ID NO: 195451
  derived and/or modified sequence opt5 from hemagglutinin__InfluenzaA__AIC73801

SEQ ID NO: 195455 - RNA, 1701 nt, Artificial Sequence; identical to SEQ ID NO: 195451
  derived and/or modified sequence opt5 from hemagglutinin__InfluenzaA__AIC73802

SEQ ID NO: 195456 - RNA, 1701 nt, Artificial Sequence; identical to SEQ ID NO: 195451
  derived and/or modified sequence opt5 from hemagglutinin__InfluenzaA__AIC73803

SEQ ID NO: 195457 - RNA, 1701 nt, Artificial Sequence; identical to SEQ ID NO: 195451
  derived and/or modified sequence opt5 from hemagglutinin__InfluenzaA__AIC73804

SEQ ID NO: 195458 - RNA, 1701 nt, Artificial Sequence; identical to SEQ ID NO: 195451
  derived and/or modified sequence opt5 from hemagglutinin__InfluenzaA__AIC73805

SEQ ID NO: 195459 - RNA, 1701 nt, Artificial Sequence; identical to SEQ ID NO: 195451
  derived and/or modified sequence opt5 from hemagglutinin__InfluenzaA__AIC73806

SEQ ID NO: 195460 - RNA, 1701 nt, Artificial Sequence
  derived and/or modified sequence opt5 from hemagglutinin__InfluenzaA__AIC73807
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacaauaaggggaaggaagugcuuguccuguggggaauccaccaccccuccaccacagccgaucagcagucucucuaccagaacgcugacgccuacguguucgugggcaccagcagauauuccaaaaaguuuaaaccugagauugcuauccggccgaagguccgcgaucaagaggggagaaugaacuacuauuggacgcugguugaacccggagacaaaauuacauucgaggccaccggcaaucugguggugccucgguacgcguuuacaauggaacgcaacgccgggagcggaaucauuaucucugauacccccguccaugacugcaauaccacaugucagacgccugagggcgcuaucaacaccucccuccccuuccagaauauucacccgaucacaauuggcaagugcccuaaauauguuaagagcaccaagcugagacuugccacagggcugcggaacgugcccucuauccagagccgcggacucuuuggcgcuauugccggguucaucgaaggaggcuggaccgggaugguggauggaugguacggcuaucaucaccaaaaugagcagggcuccggguacgccgcugaccugaaaucuacgcagaacgcgaucgacaagauuacaaauaaagucaacagcgugaucgagaagaugaauacccaguuuaccgccguuggaaaagaguucaaccaccuugagaagagaauugaaaaucugaacaagaaaguggaugacggcuuccucgauaucuggacauacaaugcugagcugcugguccuccuggaaaacgagcggacccuugacuaucaugauuccaacgugaagaaucuguacgagaaaguccgcaaccaacucaagaauaacgccaaagaaauugggaauggauguuuugaguucuaucacaagugcgacaacacauguauggaaagcgugaagaauggcacguacgauuauccuaaauacucugaggaagccaagcugaacagagagaaaaucgacgggguuaaacuugaguccacccggaucuaucagauucuggcuaucuacagcacaguggccucuucccucguccuggugguuagccugggcgcgauuuccuuuuggaugugcucuaauggaagccuccagugccgcaucuguauuuga

SEQ ID NO: 195461 - RNA, 1701 nt, Artificial Sequence; identical to SEQ ID NO: 195451
  derived and/or modified sequence opt5 from hemagglutinin__InfluenzaA__AIC73808

SEQ ID NO: 195462 - RNA, 1701 nt, Artificial Sequence
  derived and/or modified sequence opt5 from hemagglutinin__InfluenzaA__AIC73809
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugagacaauccuauauuaacgauaaggggaaggaagugcuuguccuguggggaauccaccaccccagcaccacaaccgaccagcagucccucuaccagaaugccgaugcuuacguguucgugggcacgucucgguauagcaaaaaguuuaaaccugagauugccauccgcccgaaggucagagaccaagaggggcggaugaacuacuauuggacacugguugaacccggagauaaaauuaccuucgaggcuacaggcaaccugguggugccucgcuacgccuuuaccauggaaagaaaugcgggguccggaaucauuaucagcgacacccccguccaugauugcaacacaacgugucagaccccugagggcgccaucaauacaucucuccccuuccagaacauucacccgaucaccauuggcaagugcccuaaauaugugaaguccacaaagcugcggcuugcuaccgggcugcgcaauguucccagcauccagucuagaggacucuuuggcgccauugcuggguucaucgaaggaggcuggacggggaugguggacggaugguacggcuaucaucaccaaaacgagcagggcagcggguacgccgccgaccugaaauccacacagaaugcuaucgauaagauuaccaacaaagucaauucugugaucgagaagaugaacacccaguuuacagcgguuggaaaagaguucaaucaccuugagaagcggauugaaaaccugaauaagaaaguggacgauggcuuccucgacaucuggaccuacaacgccgagcugcugguccuccuggaaaaugagcgcacacuugauuaucaugacagcaacgugaagaaccuguacgagaaagucagaaaucaacucaagaacaaugcuaaagaaauugggaacggauguuuugaguucuaucacaagugcgauaauacguguauggaauccgugaagaacggcaccuacgacuauccuaaauacagcgaggaagccaagcugaaucgggagaaaaucgaugagguuaaacuugaaucuacacgcaucuaucagauucuggccaucuacuccaccguggcuagcucucucguccuggugguuucccugggggccauuagcuuuuggaugugcuccaacggcucucuccagugcagaaucuguauuuga

SEQ ID NO: 195463 - RNA, 1701 nt, Artificial Sequence
  derived and/or modified sequence opt5 from hemagglutinin__InfluenzaA__AIC73810
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauauguuaagagcaccaagcugagacuugccacagggcugcggaaugugcccucuauccagagccgcggacucuuuggcgcuauugccggguucaucgaaggaggcuggaccgggaugguggacggaugguacggcuaucaucaccaaaacgagcagggcuccggguacgccgcugaccugaaaucuacgcagaaugcgaucgauaagauuacaaacaaagucaauagcgugaucgagaagaugaacacccaguuuaccgccguuggaaaagaguucaaucaccuugagaagagaauugaaaaccugaauaagaaaguggacgauggcuuccucgacaucuggacauacaacgcugagcugcugguccuccuggaaaaugagcggacccuugauuaucaugacuccaacgugaagaaccuguacgagaaaguccgcaaucaacucaagaacaaugccaaagaaauugggaacggauguuuugaguucuaucacagaugcgauaauacauguauggaaagcgugaagaacggcacguacgacuauccuaaguacucugaggaagccaaacugaaucgggagaagaucgaugggguuaaacuugaguccacccgcaucuaucagauucuggcuaucuacagcacaguggccucuucccucguccuggugguuagccugggcgcgauuuccuuuuggaugugcucuaacggaagccuccagugcagaaucuguauuuga

SEQ ID NO: 195464 - RNA, 1701 nt, Artificial Sequence
  derived and/or modified sequence opt5 from hemagglutinin__InfluenzaA__AIC73813
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauauguuaagagcaccaagcugagacuugccacagggcugcggaaugugcccucuauccagagccgcggacucuuuggcgcuauugccggguucaucgaaggaggcuggaccgggaugguggacggaugguacggcuaucaucaccaaaacgagcagggcuccggguacgccgcugaccugaaaucuacgcagaaugcgaucgauaagauuacaaacaaagucaauagcgugaucgagaagaugaacacccaguuuaccgccguuggaaaagaguucaaucaccuugagaagagaauugaaaaccugaauaagaaaguggacgauggcuuccucgacaucuggacauacaacgcugagcugcugguccuccuggaaaaugagcggacccuugauuaucaugacuccaacgugaagaaccuguacgagaaaguccgcaaucaacucaagaacaaugccaaagaaauugggaacggauguuuugaguucuaucacaagugcgauaauacauguauggaaagcgugaagaacggcacguacgacuauccuaaauacucugaggaagccaagcugaauagagagaaaaucgaugggguuaaacuugaguccacccggaucuaucagauucuggcuaucuacagcacagccgcgucuucccucgugcuggucauuagccugggcgcuaucuccuuuuggaugugcucuaacggaagccuccagugccgcauuuguaucuga

SEQ ID NO: 195465 - RNA, 1701 nt, Artificial Sequence
  derived and/or modified sequence opt5 from hemagglutinin__InfluenzaA__AIC73815
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgcccccaucggaaaauguaaguccgaaugcauuaccccgaacggcucuaucccuaaugauaagcccuuccagaacgugaauagaaucacauacggcgcuuguccucgguaugugaaacacagcacgcucaagcuggccaccgggaugcgcaacguccccgagaaacagacaagaggaauuuuuggcgcgaucgccggguucauugaaaauggaugggagggcaugguugacgggugguacggauuucggcaccaaaacuccgagggcagaggccaggcugccgaucuuaagagcacccaggcugccaucgaccaaauuaaugggaaacugaaccgccucaucggaaagacaaaugaaaaauuccaucagauugagaaggaguucucugaaguggaaggccggauccaggaucuggagaaguauguggaggacaccaaaaucgaucuuugguccuacaacgccgaacugcucgucgcucuggagaaucagcacacgauugaccugacagauagcgaaaugaacaagcucuuugagaaaaccaagaaacaacugagagaaaacgcggaggacauggggaauggaugcuucaagaucuaucauaagugugauaacgccugcauuggcucuauccgcaaugggaccuacgaccacaacguguaccgggacgaggcucuuaauaacagauuucagauuaaaggcguugaacugaaguccggauauaaagauuggauccucuggaucagcuucgccauuuccugcuuucugcuuuguguggcccugcucggcuucaucaugugggcuugccagaaggggaauauucgcuguaacaucugcauuuga

SEQ ID NO: 195466 - RNA, 1701 nt, Artificial Sequence; identical to SEQ ID NO: 194944
  derived and/or modified sequence opt5 from hemagglutinin__InfluenzaA__AIC73817

SEQ ID NO: 195467 - RNA, 1701 nt, Artificial Sequence; identical to SEQ ID NO: 193064
  derived and/or modified sequence opt5 from hemagglutinin__InfluenzaA__AIC73819

SEQ ID NO: 195468 - RNA, 1701 nt, Artificial Sequence
  derived and/or modified sequence opt5 from hemagglutinin__InfluenzaA__AIC73820
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgcccccaucggaaaauguaaguccgaaugcauuaccccgaacggcucuaucccuaaugauaagcccuuccagaacgugaauagaaucacauacggcgcuuguccucgguaugugaaacacagcacgcucaagcuggccaccgggaugcgcaacguccccgagaaacagacaagaggaauuuuuggcgcgaucgccggguucauugaaaauggaugggagggcaugguugacgggugguacggauuucggcaccaaaacuccgagggcagaggccaggcugccgaucuuaagagcacccaggcugccaucgaccaaauuaaugggaaacugaaccgccucaucggaaagacaaaugaaaaauuccaucagauugagaaggaguucucugaaguggaaggccggauccaggaucuggagaaguauaucgaggacaccaaaauugaucuuugguccuacaacgccgaacugcucguggcucuggagaaucagcacacgaucgaccugacagauagcgaaaugaacaagcucuuugagaaaaccaagaaacaacugagagaaaacgcggaggacauggggaauggaugcuucaagauuuaucauaagugugauaacgccugcaucggcucuauucgcaaugggaccuacgaccacaacgucuaccgggacgaggcucuuaauaacagauuucagaucaaaggcguggaacugaaguccggauauaaagauuggauccucuggauuagcuucgccaucuccugcuuucugcuuuguguugcccugcucggcuucauuaugugggcuugccagaaggggaauauccgcuguaacauuugcaucuga

SEQ ID NO: 195469 - RNA, 1701 nt, Artificial Sequence; identical to SEQ ID NO: 193064
  derived and/or modified sequence opt5 from hemagglutinin__InfluenzaA__AIC73821

SEQ ID NO: 195470 - RNA, 1701 nt, Artificial Sequence; identical to SEQ ID NO: 195428
  derived and/or modified sequence opt5 from hemagglutinin__InfluenzaA__AIC73824

SEQ ID NO: 195471 - RNA, 1701 nt, Artificial Sequence; identical to SEQ ID NO: 193064
  derived and/or modified sequence opt5 from hemagglutinin__InfluenzaA__AIC73825

SEQ ID NO: 195472 - RNA, 1701 nt, Artificial Sequence
  derived and/or modified sequence opt5 from hemagglutinin__InfluenzaA__AIC73827
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaccgcucucuacagccagcuccuggucuuacaucguggagaccagcuccucugacaacggcacgugcuaucccggggauuuuauuaauuacgaagaacugcgggagcagcuuagcuccgucagcucuuucgaacgcuuugagaucuucccuaagaccuccagcuggcccaaccacgacucuaauaagggagugacagccgcuuguccucaugccggcgcgaaauccuuuuauaagaaccugaucuggcucguuaaaaagggcaauagcuaccccaaacugucucaauccuauauuaacgauaaggggaaggaagugcuuguccuguggggaauccaccacccuagcaccacagccgaccagcagucccucuaccagaaugcugaugccuacguguucgugggcaccucuagauauagcaaaaaguuuaaaccggagauugcuauccggcccaagguccgcgaccaagaggggagaaugaacuacuauuggacgcugguugaaccuggagauaaaauuacauucgaggccaccggcaaccugguggugccccgguacgcguuuacaauggaacgcaaugccggguccggaaucauuaucagcgacaccccuguccaugauugcaacaccacaugucagacgcccgagggcgcuaucaauaccucucucccguuccagaacauucacccuaucacaauuggcaagugccccaaauaugugaaguccaccaagcugagacuugccacagggcugcggaauguuccuagcauccagucucgcggacucuuuggcgcuauugccggguucaucgaaggaggcuggaccgggaugguggacggaugguacggcuaucaucaccaaaacgagcagggcagcggguacgccgcugaccugaaauccacgcagaaugcgaucgauaagauuacaaacaaagucaauucugugaucgagaagaugaacacccaguuuaccgccguuggaaaagaguucaaucaccuugagaagagaauugaaaaccugaauaagaaaguggacgauggcuuccucgacaucuggacauacaacgcugagcugcugguccuccuggaaaaugagcggacccuugauuaucaugacagcaacgugaagaaccuguacgagaaaguccgcaaucaacucaagaacaaugccaaagaaauugggaacggauguuuugaguucuaucacaagugcgauaauacauguauggaauccgugaagaacggcacguacgacuaucccaaauacagcgaggaagccaagcugaauagagagaaaaucgaugggguuaaacuugagucuacccggaucuaucagauucuggcuaucuacuccacaguggccagcucucucauucuggucgugucccugggcgcgaucagcuuuuggaugugcuccaacggaucucuccagugccgcauuuguaucuga

SEQ ID NO: 195473 - RNA, 1701 nt, Artificial Sequence
  derived and/or modified sequence opt5 from hemagglutinin__InfluenzaA__AIC73828
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauauguuaagagcaccaagcugagacuugccacagggcugcggaaugugcccucuauccagagccgcggacucuuuggcgcuauugccggguucaucgaaggaggcuggaccgggaugguggacggaugguacggcuaucaucaccaaaacgagcagggcuccggguacgccgcugaccugaaaucuacgcagaaugcgaucgauaagauuacaaacaaagucaauagcgugaucgagaagaugaacacccaguuuaccgccguuggaaaagaguucaaucaccuugagaagagaauugaaaaccugaauaagaaaguggacgauggcuuccucgacaucuggacauacaacgcugagcugcugguccuccuggaaaaugagcggacccuugauuaucaugacuccaacgugaagaaccuguacgagaaaguccgcaaucaacucaagacaaacgccaaagaaauugggaauggauguuuugaguucuaucacaagugcgauaacacguguauggaaagcgugaagaauggcaccuacgacuauccuaaauacucugaggaagccaagcugaacagagagaaaaucgaugggguuaaacuugaguccacacggaucuaucagauucuggcuaucuacagcaccgccgcgucuucccucgugcuggucgugagccugggcgcuauuuccuuuuggaugugcucuaauggaagccuccagugccgcaucuguauuuga

SEQ ID NO: 195474 - RNA, 1701 nt, Artificial Sequence
  derived and/or modified sequence opt5 from hemagglutinin__InfluenzaA__AIC73830
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugaaaggaguugcgccccuccaucugggcaagugcaacaucgccggguggauucugggaaauccugagugugaaucucucagcacagcuuccucuuggagcuacaucguggagaccuccucuagcgacaacggcacgugcuauccgggggauuuuauuaauuacgaagaacugagagagcagcuuuccagcgucucuuccuucgaacgguuugagaucuuccccaagaccagcucuuggccuaaccacgacuccaauaaaggagugacagccgcuuguccccaugccggcgccaagagcuuuuauaaaaaccugaucuggcucguuaagaaaggcaauucuuacccuaagcugucccaaagcuauauuaacgauaaggggaaagaagugcuuguccuguggggaauccaccaccccuccaccacagccgaccagcagucucucuaccagaaugcugaugccuacguguucgugggcaccagccgcuauuccaagaaauuuaagccugagauugcuaucagaccgaaaguccgggaccaagaggggcgcaugaacuacuauuggacgcugguugaacccggagauaagauuacauucgaggccaccggcaaccugguggugccuagauacgcguuuacaauggaacggaaugccgggagcggaaucauuaucucugacacccccguccaugauugcaacaccacaugucagacgccugagggcgcuaucaauaccucccuccccuuccagaacauucacccgaucacaauuggcaaaugcccuaaguauguuaagagcaccaaacugcgccuugccacagggcugagaaaugugcccucuauccagagccggggacucuuuggcgcuauugccggguucaucgaaggaggcuggaccgggaugguggacggaugguacggcuaucaucaccaaaacgagcagggcuccggguacgccgcugaccugaagucuacgcagaaugcgaucgauaaaauuacaaacaaggucaauagcgugaucgagaaaaugaacacccaguuuaccgccguuggaaaggaguucaaucaccuugagaagcgcauugaaaaccugaauaaaaagguggacgauggcuuccucgacaucuggacauacaacgcugagcugcugguccuccuggaaaaugagagaacccuugauuaucaugacuccaacgugaaaaaccuguacgagaagguccggaaucaacucaaaaacaaugccaaggaaauugggaacggauguuuugaguucuaucacaagugcgauaauacauguauggaaagcgugaaaaacggcacguacgacuauccuaaguacucugaggaagccaaacugaaucgcgagaagaucgaugggguuaaacuugaguccaccagaaucuaucagauucuggcuaucuacagcacaguggccucuucccucguccuggugguuagccugggcgcgauuuccuuuuggaugugcucuaacggaagccuccagugccggaucuguauuuga

SEQ ID NO: 195475 - RNA, 1701 nt, Artificial Sequence
  derived and/or modified sequence opt5 from hemagglutinin__InfluenzaA__AIC73833
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauauguuaagagcaccaagcugagacuugccacagggcugcggaaugugcccucuauccagagccgcggacucuuuggcgcuauugccggguucaucgaaggaggcuggaccgggaugguggacggaugguacggcuaucaucaccaaaacgagcagggcuccggguacgccgcugaccugaaaucuacgcagaaugcgaucgauaagauuacaaacaaagucaauagcgugaucgagaagaugaacacccaguuuaccgccguuggaaaagaguucaaucaccuugagaagagaauugaaaaccugaauaagaaaguggacgauggcuuccucgacaucuggacauacaacgcugagcugcugguccuccuggaaaaugagcggacccuugauuaucaugacuccaacgugaagaaccuguacgagaaaguccgcaaucaacucaagaacaaugccaaagaaauugggaacggauguuuugaguucuaucacaagugcgauaauacauguauggaaagcgugaagaacggcacguacgacuauccuaaauacucugaggaagccaagcugaauagagagaaaaucgaugggguuaaacuugaguccacccggaucuaucagauucuggcuaucuacagcacagccgcgucuucccucgugcuggucgugagccugggcgcuauuuccuuuuggaugugcucuaacggaagccuccagugccgcaucuguauuuga

SEQ ID NO: 195476 - RNA, 1701 nt, Artificial Sequence
  derived and/or modified sequence opt5 from hemagglutinin__InfluenzaA__AIC73834
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugauggcgccaagagcuuuuauaagaaccugaucuggcucguuaaaaagggcaauucuuacccuaaacugucccaaagcuauauuaacgacaaggggaaggaagugcuuguccuguggggaauccaccaccccuccaccacagcgggccagcagucucucuaccagaaugccgaugcuuacguguucguggggaccagcagauauuccaaaaaguuuaaaccugagauugccauccggccgaagguccgcgaccaagagggaagaaugaacuacuauuggacgcugguugaacccggcgauaaaauuacauucgaggcuaccgggaaccugguggugccucgguacgccuuuacaauggaacgcaaugcgggaagcggcaucauuaucucugacacccccguccaugauugcaacaccacaugucagacgccugagggcgccaucaauaccucccuccccuuccagaacauucacccgaucacaauugggaagugcccuaaauauguuaagagcaccaagcugagacuugcuacaggacugcggaaugugcccucuauccagagccgcggccucuuuggggccauugcuggauucaucgaaggcggguggaccggaaugguggacggcugguacggcuaucaucaccaaaacgagcagggguccggauacgccgccgaccugaaaucuacgcagaaugcuaucgauaagauuacaaacaaagucaauagcgugaucgagaagaugaacacccaguuuaccgcgguuggcaaagaguucaaucaccuugagaagagaauugaaaaccugaauaagaaaguggacgauggguuccucgacaucuggacauacaacgccgagcugcugguccuccuggaaaaugagcggacccuugauuaucaugacuccaacgugaagaaccuguacgagaaaguccgcaaucaacucaagaacaaugcuaaagaaauuggaaacggcuguuuugaguucuaucacaagugcgauaauacauguauggaaagcgugaagaacgggacguacgacuauccuaaauacucugaggaagccaagcugaauagagagaaaaucgauggcguuaaacuugaguccacccggaucuaucagauucuggccaucuacagcacaguggcuucuucccucguccuggugguuagccugggagccauuuccuuuuggaugugcucuaacggcagccuccagugccgcaucuguauuuga

SEQ ID NO: 195477 - RNA, 1701 nt, Artificial Sequence
  derived and/or modified sequence opt5 from hemagglutinin__InfluenzaA__AIC73835
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugauugaacccggagauaaaaucacauucgaggccaccggcaaccugguugugccucgguacgcguuuacaauggaacgcaaugccgggagcggaauuaucaucucugacacccccgugcaugauugcaacaccacaugucagacgccugagggcgcuauuaauaccucccuccccuuccagaacauccacccgauuacaaucggcaagugcccuaaauaugucaagagcaccaagcugagacuugccacagggcugcggaaugugcccucuauucagagccgcggacucuuuggcgcuaucgccggguucaucgaaggaggcuggaccgggaugguugacggaugguacggcuaucaucaccaaaacgagcagggcuccggguacgccgcugaccugaaaucuacgcagaaugcgauugauaagaucacaaacaaagugaauagcgucauugagaagaugaacacccaguuuaccgccgugggaaaagaguucaaucaccuugagaagagaaucgaaaaccugaauaagaaaguugacgauggcuuccucgacauuuggacauacaacgcugagcugcuggugcuccuggaaaaugagcggacccuugauuaucaugacuccaacgucaagaaccuguacgagaaagugcgcaaucaacucaagaacaaugccaaagaaaucgggaacggauguuuugaguucuaucacaagugcgauaauacauguauggaaagcgucaagaacggcacguacgacuauccuaaauacucugaggaagccaagcugaauagagagaaaaucgauggggugaaacuugaguccacccggauuuaucagauccuggcuauuuacagcacaguugccucuucccucgugcuggucgugagccugggcgcgaucucccucuggaugugcucuaacggaagccugcagugccgcauuuguaucuga

SEQ ID NO: 195478 - RNA, 1701 nt, Artificial Sequence; identical to SEQ ID NO: 195420
  derived and/or modified sequence opt5 from hemagglutinin__InfluenzaA__AIC73836

SEQ ID NO: 195479 - RNA, 1701 nt, Artificial Sequence
  derived and/or modified sequence opt5 from hemagglutinin__InfluenzaA__AIC73837
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugaaagauggaugguauggcuucagacaccagaacagcgagggccgggggcaggccgcugaccugaaguccacccaagccgccauugaucagaucaauggaaaacucaacagacugauuggcaagacaaaugaaaaguuccaccagaucgagaaagaauuuagcgagguugaagggcgcauucaggaccuugagaaguacguggaggauaccaaaaucgaccuguggucuuauaacgcugaacuccugguggcgcuggagaaccaacauacaaucgaucucaccgacuccgaaaugaauaagcuguucgagaaaacgaagaagcagcuucgggaaaacgccgaggauaugggaaauggcugcuuuaaaauuuaccacaagugugacaacgcuugcaucgggagcauuagaaauggcacauaugaucaugacgucuaccgcgacgaggcccugaacaaucgguuccagaucaaaggaguggaacucaagucuggcuacaaagauuggauucuguggaucuccuuugccaucagcugcuuccuucuguguguugcucuccugggguuuauuaugugggccugccagaagggaaacaucagauguaauauuugcaucuga

SEQ ID NO: 195480 - RNA, 1701 nt, Artificial Sequence
  derived and/or modified sequence opt5 from hemagglutinin__InfluenzaA__AIC73838
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcaacuccccgcaccagauucuugacggggaaaauuguacacugaucgaugcccuccugggagacccccagugcgauggcuuucagaacaaaaagugggaccuguucgucgagcggucuaaagccuauagcaauuguuacccuuaugaugugcccgacuacgcuucccuccgcucucugguugccagcuccgggacccuugaauuuaacaaugagagcuucaacugggcuggagugacgcaaaauggcaccucuuccgccugcauuagaggcagcaacucuuccuuuuucagccggcugaauuggcucacacauucuaacuuuaaguauccugcgcugaacgucaccaugcccaauaacgagcaguucgauaaacuuuacaucuggggagugcaccauccugggacagacaaggaucagauuuuucuguaugcccaguccagcggccgcaucaccguuuccacgaagagaucucaacaggcugugauuccgaauaucgggagccggccccgcaucagaaacauuccuucccggaucagcauuuacuggacaaucgucaaacccggagacauucuccugaucaauucuaccggcaaccugaucgccccucgcggguacuucaagauuagauccggaaaaagcucuaucaugcggagcgaugcucccauuggcaaguguaaguccgaaugcaucacaccgaauggcucuauuccuaacgacaaacccuuucagaaugugaaccgcaucaccuauggggccuguccuagauacgugaagcagagcacccucaaacuggcgacaggaaugcggaauguccccgagaagcaaacgcgcggcaucuucggggccauugcuggauuuaucgaaaacggcugggaggggaugauggacggaugguauggcuucagacaccaaaauuccgagggccgggggcaggccgcugaucuuaaaagcacccaggccgccauugaccagaucaacggaaagcugaauagacucauuggcaaaacaaacgaaaaguuccaccagaucgagaaggaauuuucugagguugaagggcgcauucaggaucuggagaaauacguggaggacaccaagaucgaucuuugguccuauaacgcugaacugcucguggcgcuggagaaucaacauacaaucgaccugaccgauagcgaaaugaacaaacucuucgagaagacgaaaaagcagcugcgggaaaaugccgaggaccuuggaaacggcugcuuuaagauuuaccacaaaugugauaaugcuugcaucgggucuauuagaaacggcacauaugaccaugaugucuaccgcgacgaggcccugaauaaccgguuccagaucaagggaguggaacucaaauccggcuacaaggacuggauucuguggaucagcuuugccaucuccugcuuccuucuguguguugcucuccugggguuuauuaugugggccugccagaaaggaaauaucagauguaacauuugcaucuga

SEQ ID NO: 195481 - RNA, 1701 nt, Artificial Sequence
  derived and/or modified sequence opt5 from hemagglutinin__InfluenzaA__AIC73839
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccugaccacgauuccaacaagggagugacagccgcuuguccccaugccggcgcgaaaucuuuuuauaagaaucugaucuggcucguuaaaaagggcaacagcuacccuaaacugucccaaagcuauauuaaugacaaggggaaggaagugcuuguccuguggggaauccaccaccccuccaccacagccgaucagcagucucucuaccagaacgcugacgccuacguguucgugggcaccagcagauauuccaaaaaguuuaaaccugagauugcuauccggccgaagguccgcgaucaagaggggagaaugaauuacuauuggacgcugguugaacccggagacaaaauuacauucgaggccaccggcaaccugguggugccucgguacgcguuuacaauggaacgcaacgccgggagcggaaucauuaucucugauacccccguccaugacugcaauaccacaugucagacgccugagggcgcuaucaacaccucccuccccuuccagaauauucacccgaucacaauuggcaagugcccuaaauauguuaagagcaccaagcugagacuugccacagggcugcggaacgugcccucuauccagagccgcggacucuuuggcgcuauugccggguucaucgaaggaggcuggaccgggaugguggacggaugguacggcuaucaucaccaaaaugagcagggcuccggguacgccgcugaucugaaaucuacgcagaacgcgaucgacaagauuacaaauaaagucaacagcgugaucgagaagaugaauacccaguuuaccgccguuggaaaagaguucaaccaccuugagaagagaauugaaaaucugaacaagaaaguggaugacggcuuccucgauaucuggacauacaaugcugagcugcugguccuccuggaaaacgagcggacccuugacuaucaugauuccaaugugaagaaccuguacgagaaaguccgcaaccaacucaagaauaacgccaaagaaacagggaauggauguuuugaguucuaucacaagugcgacaacacguguauggaaagcgugaagaauggcaccuacgauuauccuaaauacucugaggaagccaagcugaacagagagaaaauugacgggguuaaacuugaguccacacggaucuaucagauccuggcuauuuacagcaccguggccucuucccucguccuggugguuagccugggcgcgaucuccuuuuggaugugcucuaauggaagccuccagugccgcauuuguaucuga

SEQ ID NO: 195482 - RNA, 1701 nt, Artificial Sequence; identical to SEQ ID NO: 193064
  derived and/or modified sequence opt5 from hemagglutinin__InfluenzaA__AIC73840

SEQ ID NO: 195483 - RNA, 1701 nt, Artificial Sequence
  derived and/or modified sequence opt5 from hemagglutinin__InfluenzaA__AIC73841
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccauugccgaccagcagucucucuaccagaaugcugaugccuacguguucgugggcacaagcagauauuccaaaaaguuuaaaccugagaucgcuauucggccgaagguccgcgaccaagaggggagaaugaacuacuauuggacccugguugaacccggagauaaaaucacguucgaggccacaggcaaccugguggugccucgguacgcguuuaccauggaacgcaaugccgggagcggaauuaucaucucugacacacccguccaugauugcaacaccaccugucagacaccugagggcgcuauuaauacgucccuccccuuccagaacauccacccgauuaccaucggcaagugcccuaaauauguuaagagcacaaagcugagacuugccaccgggcugcggaauauucccucuauccagagccgcggacucuuuggcgcuaucgccggguucauugaaggaggcuggacagggaugguggacggaugguacggcuaucaucaccaaaacgagcagggcuccggguacgccgcugaccugaaaucuacccagaaugcgaucgauaagauuacgaacaaagugaauagcgucaucgagaagaugaacacacaguuuaccgccgugggaaaagaguucaaucaccuugagaagagaauugaaaaccugaauaagaaaguugacgauggcuuccucgacaucuggaccuacaacgcugagcugcuggugcuccuggaaaaugagcggacacuugauuaucaugacuccaacgucaagaaccuguacgagaaagugcgcaaucaacucaagaacaaugccaaagaaaucgggaacggauguuuugaguucuaucacaagugcgauaauaccuguauggaaagcgucaagaacggcacauacgacuauccuaaauacucugaggaagccaagcugaauagagagaaaauugauggggugaaacuugaguccacgcggaucuaucagauucuggcuaucuacagcaccguugccucuucccucgugcuggucgugagccugggcgcgauuuccuuuuggaugugcucuaacggaagccuccagugccgcaucuguauuuga

SEQ ID NO: 195484 - RNA, 1701 nt, Artificial Sequence; identical to SEQ ID NO: 195479
  derived and/or modified sequence opt5 from hemagglutinin__InfluenzaA__AIC73842

SEQ ID NO: 195485 - RNA, 1707 nt, Artificial Sequence
  derived and/or modified sequence opt5 from hemagglutinin__InfluenzaA__AID48082
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugaaaagacacacaaugggaagcugugugaucucgacggagugaaaccccugauccuuagagauugcagcguugcgggcuggcugcucgggaacccuaugugugacgaguuuaucaaugugccggaaugguccuauauugucgagaaggcuaaccccgugaaugaucugugcuacccuggagacuucaacgauuaugaggaacugaagcaucuccugucucggaucaaucacuuugagaaaauucagaucauucccaagagcuccuggucuagccaugaagccucccuuggcguuagcucugccuguccuuaccaggggaaauccagcuucuuucgcaacguggucuggcugaucaagaaaaauucuaccuaucccacaauuaagagauccuacaacaauaccaaccaagaggaccuccuggugcuuuggggaauccaccacccuaaugaugcugccgagcagacaaagcuguaucagaacccgaccacguacaucagcgugggcaccucuacacucaaccagcggcuggucccccgcauugcuaccagauccaaaguuaauggccaaagcgggcggauggaguucuuuuggacaauccugaagccuaacgacgccauuaauuucgaauccaacggaaauuuuaucgcgcccgaauacgccuauaaaauugugaagaaaggcgauucuaccaucaugaaaagcgagcucgaauacgggaacugcaauacgaaaugucagacaccuaugggagcuaucaacuccagcaugcccuuccauaauauucacccgcugaccaucggcgagugcccuaaguaugugaagucuaaccgccuuguccuggccacagggcucagaaauagcccccagcgggagcgcagacggaaaaagcgcggacuguuuggcgcuauugccggcuucaucgaagggggauggcagggcaugguggacgggugguacggauaucaucacuccaacgagcaaggcucuggguacgcggccgacaaagaaagcacccagaaggcuauugauggaguuaccaauaaagugaacuccaucaucgacaagaugaauacacaguuugaggccgucggcagagaguucaaccaccuugaacggcgcauugagaaccugaauaagaaaauggaagauggcuuccucgacguguggacguauaacgcugagcugcugguucucauggaaaaugagagaacccuggauuuucaugacucuaacgugaagaaucuuuacgauaaaguccggcugcaacucagagacaacgccaaggaacuggggaauggauguuucgaguuuuaccacaaaugcgaugacgaguguauggaaagcgugcgcaacggcacauaugauuacccucaguauuccgaggaagcccggcuuaagagagaggagaucagcggggucaagcuggaaucuauuggaaucuaccagauucucuccaucuauagcaccguggcuucuucccuggcgcuggccauuaugguugcuggccucagccuguggaugugcuccaaugggucucuucagugccgcaucuguaucuga

SEQ ID NO: 195486 - RNA, 1701 nt, Artificial Sequence
  derived and/or modified sequence opt5 from hemagglutinin__InfluenzaA__AID70444
augaaggccgugcuggucguucuccuguacaccuucgcuacagccaacgcggacacgcuuugcaucggcuaucacgcuaauaacagcaccgauacaguggacaccgugcuggagaaaaaugucacagugacccauuccguuaaccuccuggaagauaagcacaaugggaaacuuuguaagcugagaggaguggcuccccuccaucugggcaaaugcaacauugccggguggauccugggaaauccugagugugaaucucucgccacagccagcuccuggucuuacauugucgagaccagcaacuccgacaauggcacgugcuauccgggggauuuuaucgacuacgaagaacugcgggagcagcuuucuagcguguccagcuucgaacgcuuugagauuuuccccaagaccucuuccuggccuaaccacgauagcaauaagggaguuacagcugccuguccccaugcgggcgccaaaucuuuuuauaagaaccugaucuggcucgugaaaaagggcaauuccuacccuaaacugagcaagucuuauaucaacgacaaggggagagaaguccuugugcuguggggcauucaccaccccuccaccagcgcugaucaacagucccucuaccagaaugccgacacauacguguucgucggaaccucucgguauagcaaaaaguuuaaaccugagaucgcuauucgcccgaagguuagagaucaggaggggcggaugaacuacuauuggacgcugguggaacccggagacaaaaucacauucgaggccaccggcaaccugguggucccucgcuacgcguuugccauggaaagaaaugcuggguccggaauuaucauuagcgauacacccgugcaugacugcaacaccaccugucaaacaccuaagggcgccaucaauacgucucuccccuuccagaacauccacccgauuaccaucggcaaaugcccuaaguauguuaaguccacaaaacugcggcuugcuaccgggcugcgcaaugugcccagcauucagucuagaggacucuuuggcgccaucgccggguucauugagggaggcuggacagggauggucgacggaugguacggcuaucaucaccagaacgaacaaggcagcggguacgcugcggaucugaaguccacccagaaugccaucgacgagaucacgaacaaaguuaauucugugauugagaagaugaacacacaguuuaccgcugugggaaaagaguucaaucaccuugagaagcggaucgaaaaccugaauaagaaagucgaugacggcuuccucgauauuuggaccuacaacgccgagcugcuggugguccucgaaaaugagcgcacacuggaguaucaugacagcaacgugaagaaccuuuacgaaaaaguuagaucccaggugaagaauaacgccaaagagaucgggaauggauguuuugaguucuaucacaagugcgauaacaccuguauggaaagcgucaagaauggcacauacgacuauccuaaauacucugaagaggcuaagcugaaccgggaggaaauugauggggugaaacucgaguccacgcgcaucuaucaaauccuggccauuuacagcaccguugcgucuucccuugugcuggucgugagccucggcgcuaucuccuuuuggaugugcuucaauggaucucugcagugcagaauuuacaucuga

SEQ ID NO: 195487 - RNA, 1701 nt, Artificial Sequence
  derived and/or modified sequence opt5 from hemagglutinin__InfluenzaA__AID70445
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccacagccgaucaacagucucucuaccagaacgcugacaccuacguguucgugggcacgagcagauauuccaagaaauuuaagccugagauugccauccggccgaaaguccgcgaucaggaggggagaaugaauuacuauuggacacugguugaacccggagacaagauuaccuucgaggcuacaggcaaccugguggugccucgguacgccuuugcgauggaacgcaacgccgggagcggaaucauuaucucugauacccccguccaugacugcaauaccacaugucaaacgccuaaaggcgcuaucaacaccucccuccccuuccagaauauucacccgaucacaauuggcaagugcccuaaguaugugaaaagcaccaagcugagacuugccacagggcugcggaacguucccucuauccagagccgcggacucuuuggcgcuauugccggguucaucgagggaggcuggaccgggaugguggacggaugguacggcuaucaucaccagaaugaacaaggcuccggguacgccgcugaucugaaaucuacgcagaacgcgaucgacaagauuacaaauaaagucaacagcgugaucgagaagaugaauacccaguuuaccgccguuggaaaggaguucaaccaccuugagaaaagaauugagaaucugaacaagaaaguggaugacggcuuccucgauaucuggacauacaaugcugaacugcuggucgugcucgagaacgaacggacccuggaguaucaugacuccaaugucaagaaccuuuacgagaaagugcgcaaccagcugaagaauaacgccaaggaaauugggaauggauguuuugaguucuaucacaaaugcgauaacacauguauggaaagcguuaagaauggcaucuacgacuauccuaaauacucugaggaagccaagcucaacagagaggagaucgauggggugaaacuggaauccacgcggauuuaucaaauccuugcuauuuacagcaccgucgccucuucccuggugcagguugugagccucggcgcgaucuccuuuuggaugugcuucaauggaucucugcagugccgcauuuguaucuga

SEQ ID NO: 195488 - RNA, 1701 nt, Artificial Sequence
  derived and/or modified sequence opt5 from hemagglutinin__InfluenzaA__AID70446
augaaggccgugcuggucguucuccuguacaccuucgcuacagccaacgcggacacgcuuugcaucggcuaucacgcuaauaacagcaccgauacaguggacaccgugcuggagaaaaaugucacagugacccauuccguuaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauugucgagaccuccucuagcgacaacggcacgugcuauccgggggauuuuaucgacuacgaagaacugcgggagcagcuuuccagcgugucuuccuucgaacgcuuugagauuuuccccaagaccagcucuuggccuaaucacgauuccaacaagggaguuacagccgcuuguccccaugccggcgcgaaaucuuuuuauaagaaucugaucuggcucgugaaaaagggcaacagcuacccuaaacuguccaagagcuauaucaaugacaaggggaaagaaauucuuguccuguggggaauccaccaccccuccaccacagccgaucaacagucucucuaccagaacgcugacaccuacguguucgugggcacgagcagauauuccaagaaauuuaagccugagauugccauccggccgaaaguccgcgaucaggaggggagaaugaauuacuauuggacacugguugaacccggagacaagauuaccuucgaggcuacaggcaaccugguggugccucgguacgccuuugcgauggaacgcaacgccgggagcggaaucauuaucucuggcacccccguccaugauugcaauaccacaugucaaacgccuaaaggcgcuaucaacaccucccuccccuuccagaauauucacccgaucacaauugggaagugcccuaaguaugugaaaagcaccaagcugagacuugccacaggacugcggaacguucccucuauccagagccgcggccucuuuggggcuauugccggauucaucgagggcggguggaccggaaugguggacggcugguacggcuaucaucaccagaaugaacaaggguccggauacgccgcugaccugaaaucuacgcagaacgcgaucgauaagauuacaaauaaagucaacagcgugaucgagaagaugaauacccaguuuaccgccguuggcaaggaguucaaccaccuugagaaaagaauugagaaucugaacaagaaaguggacgauggguuccucgacaucuggacauacaaugcugaacugcuggucgugcucgagaacgaacggacccuggaguaucaugauuccaaugucaagaaccuuuacgagaaagugcgcaaccagcugaagaauaacgccaaggaaauuggaaauggcuguuuugaguucuaucacaaaugcgacaacacauguauggaaagcguuaagaaugggaucuacgauuauccuaaauacucugaggaagccaagcucaacagagaggagaucgacggcgugaaacuggaauccacgcggauuuaucaaauccuugcuauuuacagcaccgucgccucuucccuggugcagguugugagccucggagcgaucuccuuuuggaugugcuucaauggcucucugcagugccgcauuuguaucuga

SEQ ID NO: 195489 - RNA, 1701 nt, Artificial Sequence
  derived and/or modified sequence opt5 from hemagglutinin__InfluenzaA__AID70447
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggaacugcgggagcagcuuuccagcgucucuuccuucgaacgcuuugagaucuuccccaagaccagcucuuggccuaaucacgauuccaacaagggagugacagccgcuuguccccaagccggcgcgaaaggcuuuuauaagaaucugcucuggcugguuaaaaaggggaacagcuacccuaaacuuucuaaguccuauaucaaugacaagggaaaagaagugcugguccucuggggcauucaucaccccagcaccacagccgaucagcagucccuguaccagaacgcugacaccuacguguucguggggacgucuagauauagcaagaaauuuaagccugagaucgccauucggccgaaaguccgcgaucaagagggaagaaugaauuacuauuggacacugguugaacccggcgacaagaucaccuucgaggcuacagggaaccucguggugccucgguacgccuuugcgauggaacgcaacgccggauccggcauuaucauuagcgauacccccguccacgacugcaauaccacaugucagacgccuaaaggcgcuaucaacaccucucugcccuuccagaauauccauccgauuacaaucgggaagugcccuaaguaugugaaauccaccaaacuuagacuggccacaggacuccggaacguucccagcauucagucucgcggccuguuuggggcuaucgccggauucauugagggcggguggaccggaaugguggacggcugguacggcuaucaccaucaaaaugaacaggggagcggauacgccgcugaucuuaaauccacgcagaacgcgaucgacaagaucacaaauaaagucaacucugugauugagaagaugaauacccaguuuaccagcguuggcaaggaguucaaccaccuggaaaagagaauggagaaucucaacaagaaaguggaugacggguuccuggauaucuggacauacaaugccgaacugcucgucgugcuggagaacgaacggacccuugaguaucacgacuccaaugucaagaaccuguacgagaaagugcgcaaccaacucaagaauaacgcuaaggaaauuggaaauggcuguuuugaguucuaucauaaaugcgauaacacauguauggaaagcguuaagaaugggaucuacgacuauccuaaauacucugaggaagccaagcugaacagagaggagauugauggcgugaaacuugaauccacgcggaucuaucagauccuggccauuuacagcaccgucgcuucuucccucgugcugguugugagccugggagccaucuccuuuuggaugugcuucaauggcucucuccagugccgcauuuguaucuga

SEQ ID NO: 195490 - RNA, 1701 nt, Artificial Sequence
  derived and/or modified sequence opt5 from hemagglutinin__InfluenzaA__AID70448
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccacagccgaucaacagucccucuaccagaacgcugacaccuacguguucguggggacgucuagauauagcaagaaauuuaagccugagauugccauccggccgaaaguccgcgaucaggagggaagaaugaauuacuauuggacacugguugaacccggcgacaagauuaccuucgaggcuacagggaaccugguggugccucgguacgccuuuaccauggaacgcgaugcgggauccggcaucauuaucagcgacacccccguccaugacugcaacacaacgugucaaaccccuaaaggcgccaucaauacaucucuccccuuccagaacauucacccgaucaccauugggaagugcccuaaguaugugaaauccacaaagcugagacuugcuaccggacugcggaauguucccagcauccagucucgcggccucuuuggggccauugcuggauucaucgagggcggguggacgggaaugguggauggcugguacggcuaucaucaccagaacgaacaagggagcggauacgccgccgaccugaaauccacacagaaugcuaucgauaagauuaccaacaaagucaauucugugaucgagaagaugaacacccaguuuacagcgguuggcaaggaguucaaucaccuugaaaagagaauugagaaccugaauaagaaaguggacgauggguuccucgacaucuggaccuacaacgccgaacugcuggucgugcucgagaaugaacggacacuggaguaucaggauagcaacgucaagaaucuuuacgagaaagugcgcaaccaacugaagaacaaugcuaaggaaauuggaaacggcugucucgaguuuuaucauaaauucgacaauacgugcauggaauccguuaagaacgggaccuacgauuauccuaaauacagcgaggaagccaagcugaauagagagaaaaucgacggcgugaaacuugagucuacacggaucuaucagauucuggccaucuacuccaccgucgcuagcucucucgugcugguugugucccugggaacaauuagcuuuuggauguguuucaacggcucccuccagugccgcaucugcauuuga

SEQ ID NO: 195491 - RNA, 1701 nt, Artificial Sequence
  derived and/or modified sequence opt5 from hemagglutinin__InfluenzaA__AID70449
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccacagccgaucaacagucucucuaccagaacgcugacaccuacguguucgugggcacgagcagauauuccaagaaauuuaagccugagauugccauccggccgaaaguccgcgaucaggaggggagaaugaauuacuauuggacacugguugaacccggagacaagauuaccuucgaggcuacaggcaaccugguggugccucgguacgccuuugcgauggaacgcaacgccgggagcggaaucauuaucucugauacccccguccaugacugcaauaccacaugucaaacgccuaaaggcgcuaucaacaccucccuccccuuccagaauauucacccgaucacaauuggcaagugcccuaaguaugugaaaagcaccaagcugagacuugccacagggcugcggaacguucccucuauccagagccgcggacucuuuggcgcuauugccggguucaucgagggaggcuggaccgggaugguggacggaugguacggcuaucaucaccagaaugaacaaggcuccggguacgccgcugaucugaaaucuacgcagaacgcgaucgacaagauuacaaauaaagucaacagcgugaucgagaagaugaauacccaguuuaccgccguuggaaaggaguucaaccaccuugagaaaagaauugagaaucugaacaagaaaguggaugacggcuuccucgauaucuggacauacaaugcugaacugcuggucgugcucgagaacgaacggacccuggaguaucaugacuccaaugucaagaaccuuuacgagaaagugcgcaaccagcugaagaauaacgccaaggaaauugggaauggauguuuugaguucuaucacaaaugcgauaacacauguauggaaagcguuaagaauggcacguacgacuauccuaaauacucugaggaagccaagcucaacagagaggagaucgauggggugaaacuggaauccacccggaucuaucaaauucuugcuaucuacagcacagucgccucuucccuggugcucguugugagccugggcgcgauuuccuuuuggaugugcuucaauggaucucugcagugccgcaucugugucuga

SEQ ID NO: 195492 - RNA, 1701 nt, Artificial Sequence
  derived and/or modified sequence opt5 from hemagglutinin__InfluenzaA__AID70450
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccacagccgaucaacagucccucuaccagaacgcugacaccuacguguucguggggacgucuagauauagcaagaaauuuaagccugagauugccauccggccgaaaguccgcgaucaggagggaagaaugaauuacuauuggacacugguugaacccggcgacaagauuaccuucgaggcuacagggaaccugguggugccucgguacgccuuugcgauggaacgcgaugccggauccggcaucauuaucagcgacacccccguccaugacugcaacaccacaugucaaacgucuaaaggcgcuaucaauaccucccucccuuuccagaacauucaccccaucacaauugggaagugcccgaaguaugugaaaagcaccaagcugagacuugccacaggacugcggaauguuccuucuauccagagccgcggccucuuuggggcuauugccggauucaucgagggcggguggaccggaaugguggauggcugguacggcuaucaucaccagaacgaacaaggguccggauacgccgcugaccugaaaucuacgcagaaugcgaucgauaagauuacaaacaaagucaauagcgugaucgagaagaugaacacccaguuuaccgccguuggcaaggaguucaaucaccuugagaaaagaauugagaaccugaauaagaaaguggacgauggguuccucgacaucuggacauacaacgcugaacugcuggucgugcucgagaaugaacggacccuggaguaucaugauuccaacgucaagaaucuuuacgagaaagugcgcaaccagcugaagaacaaugccaaggaaauuggaaacggcuguuuugaguucuaucacaaauuugacaauacaugcauggaaagcguuaagaacgggacguacgauuaucccaaauacucugaggaagccaagcucaauagagagaaaaucgacggcgugaagcuggaguccacccggaucuaucaaauucuugcuaucuacagcacagucgccucuucccuggugcagguugugagccucggagcgauuuccuucuggauguguuuuaacggcucucugcagugccgcaucugcauuuga

SEQ ID NO: 195493 - RNA, 1701 nt, Artificial Sequence
  derived and/or modified sequence opt5 from hemagglutinin__InfluenzaA__AID70451
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaaaugcaacaucgccggguggauucugggaaauccugagugugaaucucugagcacagccuccucuuggagcuacaucguggagaccuccucuagcgacaacggcacgugcuauccgggggauuuuauugacuacgaggaacuccgggagcagcuguccagcgucucuuccuucgaacgcuuugagaucuuccccaagaccagcucuuggccuaaucacgauuccaacaagggagugacagccgcuuguccccaugccggcgcgaaaggcuuuuauaagaaucuuaucuggcugguuaaaaaggggaacagcuacccuaaacucucuaaguccuauauuaaugacaagggaaaagaagugcugguccuuuggggcauccaccaccccagcaccacagccgaucaacagucccuguaccagaacgcugacaccuacguguucguggggacgucuagauauagcaagaaauuuaagccugagauugccauccggccgaaaguccgcgaucaggagggaagaaugaauuacuauuggacacucguugaacccggcgacaagauuaccuucgaggcuacagggaaccugguggugccucgguacgccuuugcgauggaacgcaacgccggauccggcaucauuaucagcgauacccccguccaugacugcaauaccacaugucaaacgccuaaaggcgcuaucaacaccucucugcccuuccagaauauucacccgaucacaauugggaagugcccuaaguaugugaaauccaccaagcucagacuggccacaggacuucggaacguucccagcauccagucucgcggccuguuuggggcuauugccggauucaucgagggcggguggaccggaaugguggacggcugguacggcuaucaucaccagaaugaacaagggagcggauacgccgcugaucucaaauccacgcagaacgcgaucgacaagauuacaaauaaagucaacucugugaucgagaagaugaauacccaguuuaccgccguuggcaaggaguucaaccaccuggaaaagagaauugagaaucuuaacaagaaaguggaugacggguuccuggauaucuggacauacaaugcugaacuccuggucgugcuggagaacgaacggacccucgaguaucaugacagcaaugucaagaaccuguacgagaaagugcgcaaccagcuuaagaauaacgccaaggaaauuggaaauggcuguuuugaguucuaucacaaauuugauaacacaugcauggaauccguuaagaaugggacguacgacuauccuaaauacagcgaggaagccaagcugaacagagaggagaucgauggcgugaaacucgaaucuacccggaucuaucaaauucuggcuaucuacuccacagucgccagcucucuugugcugguugugucccucggagcgauuagcuucuggauguguuuuaauggcucccugcagugccgcaucugcauuuga

SEQ ID NO: 195494 - RNA, 1701 nt, Artificial Sequence
  derived and/or modified sequence opt5 from hemagglutinin__InfluenzaA__AID70452
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuggauccgucagcucuuucaagcgcuuugaaaucuuccccaagaccuccagcuggccuaaucacgauucuaacaaaggcgugacagccgcuuguccccaugccggcgcgaagggguuuuauaaaaaucugaucuggcucguuaagaaaggaaacuccuacccuaagcugagcaagucuuauauuaaugacaaaggcaaggaggugcuuguccugugggggauccaccaccccuccaccacagccgaucaacagagccucuaccagaacgcugacaccuacguguucgugggaacguccagauauucuaaaaaguuuaaaccugaaauugccauccggccgaagguccgcgaucaggagggcagaaugaauuacuauuggacacugguugagcccggggacaaaauuaccuucgaagcuacaggaaaccugguggugccucgguacgccuuugcgauggagcgcgaugccggcagcggcaucauuaucuccgacacccccguccaugacugcaacaccacaugucaaacgccuaagggggcuaucaauaccagccuccccuuccagaacauucacccgaucacaauuggaaagugcccuaaauaugugaagucuaccaaacugagacuugccacaggccugcggaauguucccuccauccagagccgcgggcucuuuggagcuauugccggcuucaucgaagggggauggaccggcaugguggauggcugguacggguaucaucaccagaacgagcaaggaucuggcuacgccgcugaccuuaagagcacgcagaaugcgaucgauaaaauuacaaacaaggucaauuccgugaucgaaaagaugaacacccaguuuaccgccguugggaaagaguucaaucaccuggagaagagaauugaaaaccugaauaaaaagguggacgauggauuccucgacaucuggacauacaacgcugagcugcuggucgugcucgaaaaugagcggacccuggaauaucaugauucuaacgucaaaaaucuuuacgagaaggugcgcaaccagcugaagaacaaugccaaagagauuggcaacggguguuuugaguucuaucacaagugcgacaauacauguauggagagcguuaaaaacggcaucuacgauuauccuaaguacuccgaagaggccaaacucaauagagaaaagaucgacggagugaagcuggagagcacgcggauuuaucaaauccuugcuauuuacucuaccgucgccuccagccuggugcucguugugucucugggcgcgaucuccuuuuggaugcgcuucaacgggagccugcagugcuccauuugcaucuga

SEQ ID NO: 195495 - RNA, 1701 nt, Artificial Sequence
  derived and/or modified sequence opt5 from hemagglutinin__InfluenzaA__AID70453
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccacagccgaucaacagucccucuaccagaacgcugacaccuacguguucguggggacgucuagauauagcaagaaauuuaagccugagauugccauccggccgaaaguccgcgaucaggagggaagaaugaauuacuauuggacacugguugaacccggcgacaagauuaccuucgaggcuacagggaaccugguggugccucgguacgccuuugcgauggaacgcgaugccggauccggcaucauuaucagcgacacccccguccaagacugcaacaccacaugucagacgccuaaaggcgcuaucaauaccucucuccccuuccagaacauucauccgaucacaauugggaagugcccuaaguaugugaaauccaccaagcugagacuuguuacaggacugcggaaugugcccagcauccagucucgcggccucuuuggggccauugcuggauucaucgagggcggguggaccggaauggucgauggcugguacggcuaucaccaucaaaacgaacaggggagcggauacgccgccgaccugaaauccacgcagaaugcuaucgauaagauuacaaacaaaguuaauucugugaucgagaagaugaacacccaguuuaccgcggugggcaaggaguucaaucaccuugagaaaagaauugagaaccugaauaagaaagucgacgauggguuccucgacaucuggacauacaacgccgaacugcuggugguccucgagaaugaacggacccuggaguaucacgauagcaaccuuaagaaucuguacgagaaagugcgcaaccaacucaagaacaaugcuaaggaaauuggaaacggcuguuuugaguucuaucauaaauuugacaauacaugcauggaauccguuaagaacgggacguacgauuauccuaaauacagcgaggaagccaagcugaauagagaggagaucgacggcgugaaacuugaaucuacccggaucuaucagauucuggccaucuacuccacagucgcuagcucucucgugcagguugugucccugggagccauuagcuucuggaugcgcuuuaacggcucccugcacuguagaaucugcauuuga

SEQ ID NO: 195496 - RNA, 1701 nt, Artificial Sequence
  derived and/or modified sequence opt5 from hemagglutinin__InfluenzaA__AID70454
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacagccgaccaacagucucucuaccagaaugcugaugccuacguguucgugggcaccagcagauauuccaagaaauuuaagccugagauugcuauccggccgaaaguccgcgaccaggaggggagaaugaacuacuauuggacgcugguugaacccggagauaagauuacauucgaggccaccggcaaccugguggugccucgguacgcguuugccauggaacgcaaugcugggagcggaaucauuaucucugacacacccguccaugauugcaacaccaccugucaaacaccuaaaggcgccaucaauacgucccuccccuuccagaacauucacccgaucaccauuggcaagugcccuaaguaugugaaaagcacaaagaugagacuggcuaccgggcuucggaauguucccuguauccagucucgcggacuguuuggcgccauugccggguucaucgagggaggcuggacagggaugguggacggaugguacggcuaucaucaccagaacgaacaaggcagcggguacgcugcggaccucaaauccacccagaaugccaucgauaagauuacgaacaaagucaauucugugaucgagaagaugaacacacaguuuaccgcuguuggaaaggaguucaaucaccuggagaaaagaauugagaaccuuaauaagaaaguggacgauggcuuccuggacaucuggaccuacaacgccgaacuccuggucgugcuggagaaugaacggacacucgauuaucaugacagcaacgucaagaaccuguacgagaaagugcgcaaucagcuuaagaacaaugccaaggagauugggaacggaugcuuugaguucuaucacaaaugugauaauaccugcauggaauccguuaagaacggcacauacgacuauccuaaauacagcgaagaggcuaagcugaauagagaagagaucgauggggugaaacucgagucuacgcggaucuaucaaauucuggccaucuacuccaccgucgcgagcucucuugugcugguugugucccucggcgcuauuagcuuuuggaugugcuccaacggaucucugcagugucgcaucugcauuuga

SEQ ID NO: 195497 - RNA, 1701 nt, Artificial Sequence
  derived and/or modified sequence opt5 from hemagglutinin__InfluenzaA__AID70455
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugggaggcguugcuccccuccaucuggggaaaugcaacaucgccggauggauucugggcaauccugagugugaaucucucagcacagccuccucuuggagcuacaucguggagaccuccucuagcgacaacgggacgugcuauccgggagauuuuauugacuacgaggagcugagagagcagcuuuccagcgucucuuccuucgaacgguuugagaucuuccccaagaccagcucuuggccuaaucacgauuccaacaagggcgugacagccgcuuguccccaugccggcgcgaaaggguuuuauaagaaucugaucuggcucguuaaaaagggaaacagcuacccuaaaauuucuaaguccuauaucaaugacaagggcaaagaagugcugguccuuugggggauucaccaccccagcaccacagccgaucaacagucccuguaccagaacgcugacaccuacaucuucgugggaacgucucgcuauagcaagaaauuuaagccugagauugccaucagaccgaaagugcgggaucaggagggccgcaugaauuacuauuggacacucgucgaacccggggacaagauuaccuucgaggcuacaggaaaccugguugugccuagauacgccuuugcgauggaacgggaugccggcuccggcaucaucauuagcgacacccccgugcaugacugcaacaccacaugucaaacgccuaaaggggcuaucaauaccucucugcccuuccagaacauucacccgaucacaauuggaaagugcccuaaguaugucaaauccaccaagcuccgccuggccacaggccuuagaaaugugcccagcauccagucucgggggcuguuuggagcuaucgccggcuucauugaagggggauggaccggcaugguugauggcugguacggguaucaucaccagaacgaacaaggaagcggcuacgccgcugaccucaaauccacgcagaaugcgaucgauaagauuacaaacaaagucaauucugugaucaagaagaugaacacccaguuuaccgccguggggaaagaguucaaucaccuggagaagcgcauugaaaaccuuaauaaaaagguugacgauggauuccuggacaucuggacauacaacgcugagcuccuggugguccuggaaaaugagagaacccucgaauaucaugauagcaacgugaaaaaucuguacgagaagguccggaaccagcuuaagaacaaugccaaagagaucggcaacggguguuuugaguucuaucacaaguuugacaauacaugcauggaauccgugaaaaacggcacguacgauuauccuaaguacagcgaagaggccaaacugaaucgcgaagagauugacggaguuaagcucgagucuaccagaaucuaucaaauucuggcuaucuacuccacaguggccagcucucuuguccuggugguuucccucggcgcgauuagcuucuggauguguuuuaacgggucccugcagugccggaucugcauuuga

SEQ ID NO: 195498 - RNA, 1701 nt, Artificial Sequence
  derived and/or modified sequence opt5 from hemagglutinin__InfluenzaA__AID70456
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccacagccgaucaacagucucucuaccagaacgcugacaccuacguguucgugggcacgagcagauauuccaagaaauuuaagccugagauugccauccggccgaaaguccgcgaucaggaggggagaaugaauuacuauuggacacugguugaacccggagacaagauuaccuucgaggcuacaggcaaccugguggugccucgguacgccuuugcgauggaacgcaacgccgggagcggaaucauuaucucugauacccccguccaugacugcaauaccacaugucaaacgccuaaaggcgcuaucaacaccucccuccccuuccagaauauucacccgaucacaauuggcaagugcccuaaguaugugaaaagcaccaagcugagacuugccacagggcugcggaacguucccucuauccagagccgcggacucuuuggcgcuauugccggguucaucgagggaggcuggaccgggaugguggacggaugguacggcuaucaucaccagaaugaacaaggcuccggguacgccgcugaucugaaaucuacgcagaacgcgaucgacaagauuacaaauaaagucaacagcgugaucgagaagaugaauacccaguuuaccgccguugugaaggaguucaaccaccuugagaaaagaauugagaaucugaacaagaaagucgaugacggauuccucgauaucuggacauacaaugcugaacugcuggugguccucgagaacgaacggacccuggaguaucaugacuccaaucuuaagaaccuguacgagaaagugcgcaaccagcucaagaauaacgccaaggaaauuggcaauggguguuuugaguucuaucacaaauuugauaacacaugcauggaaagcguuaagaauggaacguacgacuauccuaaauacucugaggaagccaagcugaacagagaggagaucgauggcgugaaacuugaauccacccggaucuaucaaauucuggcuaucuacagcacagucgccucuucccucgugcagguugugagccugggggcgauuuccuucuggauguguuuuaauggcucucugcagugccgcaucugcauuuga

SEQ ID NO: 195499 - RNA, 1701 nt, Artificial Sequence
  derived and/or modified sequence opt5 from hemagglutinin__InfluenzaA__AID70457
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccacagccgaucaacagucccucuaccagaacgcugacaccuacguguucguggggacgucuagauauagcaagaaauuuaagccugagauugccauccggccgaaaguccgcgaucaggagggaagaaugaauuacuauuggacacugguugaacccggcgacaagauuaccuucgaggcuacagggaaccugguggugccucgguacgccuuugcgauggaacgcgaugccggauccggcaucauuaucagcgacacccccguccaugacugcaacaccacaugucaaacgccuaaaggcgcuaucaauaccucucuccccuuccagaacauucacccgaucacaauugggaagugcccuaaguaugugaaauccaccaagcugagacuugccacaggacugcggaauguucccagcauccagucucgcggccucuuuggggcuauugccggauucaucgagggcggguggaccggaaugguggauggcugguacggcuaucaucaccagaacgaacaagggagcggauacgccgcugaccugaaauccacgcagaaugcgaucgauaagauuacaaacaaagucaauucugugaucgagaagaugaacacccaguuuaccgccguuggcaaggaguucaaucaccuugagaaaagaauugagaaccugaauaagaaaguggacgauggguuccucgacaucuggacauacaacgcugaacugcuggucgugcucgagaaugaacggacccuggaguaucaugauagcaacgucaagaaucuuuacgagaaagugcgcaaccagcugaagaacaaugccaaggaaauuggaaacggcuguuuugaguucuaucacaaauuugacaauacaugcauggaauccguuaagaacgggacguacgauuauccuaaauacagcgaggaagccaagcucaauagagagaaaaucgacggcgugaagcuggagucuacccggaucuaucaaauucuugcuaucuacuccacagucgccagcucucuggugcagguugugucccucggagcgauuagcuucuggaaguguuuuaacggcucccugcagugccgcaucugcucuuga

SEQ ID NO: 195500 - RNA, 1701 nt, Artificial Sequence
  derived and/or modified sequence opt5 from hemagglutinin__InfluenzaA__AID70458
augaagaccaucauugcccugagcuacauccucugccugguguucgcucagaaauuucccggcaacgacaauuccauggccacacuuugucuggggcaccaugcggucccuaacggaacgaugguuaagaccauuacaaaugaucaaaucgaggugaccaacgcuacagaacucgugcagucuagcuccaccggcgggauuugcaauucuccgcaccagauccuggacggaggcaacuguacacuuaucgaugcccugcucggggacccccagugcgauggauuccaaaauaaaaagugggaccuguuugucgagagaagcaaagccuauuccaacuguuacccuuaugaugugcccgacuacgcuucucugcggagcauuguugccuccagcggcacccucgaguucaauaacgaaucuuuuaauuggacgggcgugacccagaacgggaaguccgcuagcugcaagcgcggaucugauaauuccuucuuuagcagacugaacuggcuuacacaucugaauuauaaauacccugcccucaaggucaccaugcccaacaacgaaaaauucgacaagcuguauaucuggggcgugcaccauccugggacauacaaugaucagauuucucuuuacgcgcaggccuccggaaucauuaccguuagcacgaaacggaaccaacagacagugaucccgaauauuggcucccgccccagaguccgggacaucccuucucgcaucagcauuuauuggaccaucgugaagcccggggauauucugcucaucaacuccacaggaaaucugauugcuccuagaggcuacuuuaagauccagagcggcaaaucuuccaucaugcggagcgacgcccccauugggaaguguaacucugagugcaucaccccgaauggaagcauuccuaacgacaaacccuuccagaaugugaaccgcaucaccuauggcgcuuguccuagauacgucaagcaaaauacacugaaacucgccacggggaugcggaacguucccgagaagcagacccgcggaauuuuuggcgcgaucgccggguucaucgaaaauggaugggagggcaugguggauggcugguauggguuuagacaccagaacuccgaaggaaugggccaagcugccgaccugaaaucuacacaggcugccauuaaucagaucaacgggaaacuuaaccggcugauuggaaagaccaucgagaaguuccaccagauugagaaggaguucagcgaaguggaaggccgcauccaagaucucgagaaauacgucgaagacacaaagauugaucugugguccuauaaugccgagcuucugguggcucucgagaaccagcauaccaucgaccugacggauagcgaaauggacaaacuguuugagagaacaaagaagcagaugcgggaaaaugcggaggauauggggaacggcugcuucaaaaucuaccacaagugugacaaugccugcauuggaucuaucagaaacggcauuuacgaucgcgacaucuaucgggacgaagcucucuccaauagauuucagauuaaagggguugagcugaaggccggauacaaagauuggauccuuuggaucagcuucgccauuucuugcuuucugcucugugugguccugcuuggcuucaucaugugggcuugccaaaaggggaaccugcgcuguaauauuugcaucuga

SEQ ID NO: 195501 - RNA, 1701 nt, Artificial Sequence
  derived and/or modified sequence opt5 from hemagglutinin__InfluenzaA__AID70459
augaagaccaucauugcccugagcuacauccucugccugguguucgcucagaaaguccccggcaacgacaauuccacagccacgcuuugucuggggcaccaugcgguuccuaacggaaccauugugaagacaaucaccaaugaucaaauugaggugacaaacgcuaccgaacucguccagucuagcuccacaggcgagaucugcaauucuccgcaccagauccuggacggggaaaacuguacccuuauugaugcccugcucggagacccccagugcgauggcuuucaaaauaaaaagugggaccuguucguggagagaagcaaagcccauuccaacuguuauccuuacgauguucccgacuaugcuucucugcggagccucguggccuccagcgggacgcuggaauuuaauaacgagucuuucaauuggaccggagucacacagaacggcaccuccagcgcuugcauccgcagaucuaauaacuccuuuuucagccggcuuaauuggcugacacaccucaacuuuaaguacccugcccugaacgugaccaugcccaauaacgagcaguucgauaaacuuuauauuuggggcguucaucacccugggacggacaaagaucagaucuuucuguacgcgcaagccucuggacgcauuacaguguccaccaagaaaagccagcaggcugucaucccgaauauuggcuccagaccccgggugcgcaacaucccuucuagagugagcaucuauuggacaauugucaagcccggggacauccuccugauuaauuccaccggaaaccugaucgccccucggggcuacuucaaaauucgcagcgggaagucuuccaucaugagaagcgaugcucccaucggaaaguguaauucugccugcauuaccccgaacggcagcaucccuaaugacaaacccuuucagaacguuaaucggauuacauacggcgcguguccucgcuaugugaagcaaaacacgcucaaacuggcccccgggaugagaaaugugcccgaaaagcagacccggggaaucuucggcgcuauugccggguuuaucgagaacggaugggaaggcauggucgacgggugguacggauuccgccaccaaaauuccgagggcagaggccaggcugccgaucuuaaaucuacacaggccgcuaucgaccagauuaacgggaagcugaaccggcucaucggaaaaaccauugagaaguuccaucagaucgaaaaugaguuuagcgaaguggagggccgcauucaagaucuggaaaaguauguugaggacacaaaaaucgaucuuugguccuacauugcggagcugcucguggcccuggaaaaccagcacaccaucgaccugacggauagcgagaugaauaaacucuucgaaaagacaaagaagcagcugagagagaacgcugaagacauggggaauggaugcuuuaagaucuaucauaagugugauaacgccugcauuggcucuauccggaaugggauuuacgaccacgaugucuauagagacgaggcccuuaacaaucgcuuccagaucaaaggcguggagcugaaguccggauacaaagacuggauucucuggaucagcuuugcuaucucuugcuuccugcuuuguguugcccugcucggcuuuauuaugugggcgugccaaaaggggaacauccgguguaauauuugcaucuga

SEQ ID NO: 195502 - RNA, 1701 nt, Artificial Sequence
  derived and/or modified sequence opt5 from hemagglutinin__InfluenzaA__AID70460
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccaccaagaaaagccagcaggcugugaucccgaauauuggcuccagaccccggguccgcaacaucccuucuagagugagcaucuauuggacaauugugaagcccggggacauccugcugauuaauuccaccggaaaccucaucgccccucggggcuacuucaaaauucgcagcgggaagucuuccaucaugagaagcgaugcucccaucggaaaguguaauucugccugcauuaccccgaacggcagcaucccuaaugacaaacccuuucagaacgucaaucggauuacauacggcgcguguccucgcuauguuaagcaaaacacgcugaaacuugccaccgggaugagaaaugugcccgaaaagcagacacggggaaucuucggcgcuauugccggguuuaucgagaacggaugggaaggcaugguggacgggugguacggauuccgccaccaaaauuccgagggcagaggccaggcugccgaucugaaaucuacccaggccgcuaucgaccagauuaacgggaagcucaaccggcugaucggaaaaacaauugagaaguuccaucagaucgaaaaggaguuuagcgaagucgagggccgcauucaagaucuugaaaaauauguggaggacaccaagaucgaucugugguccuacaaugcggagcuccugguugcccuggaaaaccagcacacgauugaccucacagauagcgagaugaauaaacuguucgaaaagaccaaaaagcagcuuagagagaacgcugaagacauggggaauggaugcuuuaagaucuaucauaaaugugauaacgccugcaucggcucuauucggaaugggaucuacgaccacgauguguauagagacgaggcccugaacaaucgcuuccagauuaagggcgucgagcucaaauccggauacaaggacuggauccuguggauuagcuuugcuaucucuugcuuccuucuguguguggcccuccugggcuuuaucaugugggcgugccaaaaagggaacauucgguguaauaucugcauuuga

SEQ ID NO: 195503 - RNA, 1701 nt, Artificial Sequence
  derived and/or modified sequence opt5 from hemagglutinin__InfluenzaA__AID70461
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccaccaagaaaagccagcaggcugugaucccgaauauuggcuccagaccccggguccgcaacaucccuucuagagugagcaucuauuggacaauugugaagcccggggacauccugcugauuaauuccaccggaaaccucaucgccccucggggcuacuucaaaauucgcagcgggaagucuuccaucaugagaagcgaugcucccaucggaaaguguaauucugaaugcauuaccccgaacggcagcaucccuaaugacaaacccuuucagaacgucaaucggauuacauacggcgccuguccucgcuauguuaagcaaaacacgcugaaacuugcgaccgggaugagaaaugugcccgagaagcagacacggggaaucuucggcgccauugcuggguuuaucgaaaacggaugggagggcaugguggacgggugguacggauuccgccaccaaaauuccgagggcagaggccaggccgcugaucugaaaucuacccaggccgccaucgaccagauuaacgggaagcucaaccggcugaucggaaaaacaauugaaaaguuccaucagaucgagaaggaauuuagcgaggucgaaggccgcauucaagaucuugagaaauauaucgaggacaccaagauugaucugugguccuacaaugcugaacuccugguggcgcuggagaaccagcacacgaucgaccucacagauagcgaaaugaauaaacuguucgagaagaccaaaaagcagcuuagagaaaacgccgaggacauggggaauggaugcuuuaagaucuaucauaaaugugauaacgcuugcauuggcucuauccggaaugggauuuacgaccacgauguuuauagagacgaggcccugaacaaucgcuuccagaucaagggcguggaacucaaauccggauacaaggacuggauucuguggaucagcuuugccaucucuugcuuccuucugugugucgcucuccugggcuuuauuaugugggccugccaaaaagggaacauccgguguauuaccugcaucuga

SEQ ID NO: 195504 - RNA, 1701 nt, Artificial Sequence
  derived and/or modified sequence opt5 from hemagglutinin__InfluenzaA__AID70463
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugaucaaaucgaggugacaaacgcuaccgaacucgugcagucuagcuccacaggcgagaucugcaauucuccgcaccagauucuggacggggaaaacuguacccuuaucgaugcccugcucggagacccccagugcgauggcuuucaaaauaaaaagugggaccuguucgucgagagaagcaaagcccauuccaacuguuauccuuacgaugugcccgacuaugcuucucugcggagccucguugccuccagcgggacgcuggaauuuaauaacgagucuuucaauuggaccggagugacacagaacggcaccuccagcgcuugcauucgcagaucuaauaacuccuuuuucagccggcuuaauuggcugacacaccucaacuuuaaguacccugcccugaacgucaccaugcccaauaacgagcaguucgauaaacuuuauaucuggggcgugcaucacccugggacggacaaggaucagauuuuucuguacgcgcaagccucuggacgcaucacaguuuccaccaagaaaagccagcaggcugugauuccgaauaucggcuccagaccccggguccgcaacaucccuucuagagugagcauuuauuggacaaucgugaagcccggggacauucuccugaucaauuccaccggaaaccugauugccccucggggcuacuucaaaauccgcagcgggaagucuuccaucaugagaagcgaugcucccauuggaaaguguaauucugccugcaucaccccgaacggcagcauuccuaaugacaaacccuuucagaacgucaaucggaucacauacggcgcguguccucgcuauguuaagcaaaacacgcucaaacuggccaccgggaugagaaaugugcccgaaaagcagacacggggaauuuucggcgcuaucgccggguuuaucgagaacggaugggaaggcaugguggacgggugguacggauuccgccaccaaaauuccgagggcagaggccaggcugccgaucuuaaaucuacccaggccgcuauugaccagaucaacgggaagcugaaccggcucauuggaaaaacaaucgagaaguuccaucagauugaaaaggaguuuagcgaagucgagggcagaauccaagaucuggaaaaauauguggaggacaccaagauugaucuuugguccuacaaugcggagcugcucguugcccuggaaaaccagcacacgaucgaccugacagauagcgagaugaauaaacucuucgaaaagaccaaaaagcagcugcgcgagaacgcugaagacauggggaauggaugcuuuaagaucuaucauaaaugugauaacgccugcauuggcucuauccggaaugggauuuacgaccacgauguguauagagacgaggcccuuaacaaucgcuuccagaucaagggcgucgagcugaaauccggauacaaggacuggauucucuggaucagcuuugcuaucucuugcuuccugcuuuguguggcccugcucggcuuuauuaugugggcgugccaaaaagggaacauccgguguaauauuugcaucuga

SEQ ID NO: 195505 - RNA, 1701 nt, Artificial Sequence
  derived and/or modified sequence opt5 from hemagglutinin__InfluenzaA__AID70464
augaagaccaucauugcccugagcuacauccucugccugguguucgcucagaaacuucccggcgacgauaacuccacagccacgcugugucucgggcaccaugcggucccuaauggaaccauuguuaagacaaucaccaacgaccaaauugaggugacaaaugcuaccgaacuggugcagucuagcuccacaggcgagaucugcaacucuccgcaccagauccuugauggggaaaauuguacccugauugacgcccuccugggagauccccagugcgacggcuuucaaaacaaaaagugggaucuguucgucgagagaagcaaagcccauuccaauuguuauccuuacgacgugcccgauuaugcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaccugaauuuuaaguacccugcccuuaacgucaccaugcccaacaaugagcaguucgacaagcuguauauuuggggcgugcaucacccugggacggauaaagaccagaucuuucucuacgcgcaagccucuggacgcauuacaguuuccaccaagaaaagccagcaggcugugaucccgaacauuggcuccagaccccggguccgcaauaucccuucuagagugagcaucuauuggacaauugugaagcccggggauauccugcugauuaacuccaccggaaaucucaucgccccucggggcuacuucaaaauucgcagcgggaagucuuccaucaugagaagcgacgcucccaucggaaaguguaacucugccugcauuaccccgaauggcagcaucccuaacgacaaacccuuucagaaugucaaccggauuacauacggcgcguguccucgcuauguuaagcaaaauacgcugaaacuugccaccgggaugagaaacgugcccgaaaagcagacacggggaaucuucggcgcuauugccggguuuaucgagaauggaugggaaggcaugguggaugggugguacggauuccgccaccagaacuccgagggcagaggccaagcugccgaccugaaaucuacccaggccgcuaucgaucagauuaaugggaagcucaaccggcugaucggaaaaacaauugagaaguuccaucagaucgaaaaggaguuuagcgaagucgagggccgcauucaagaccuugaaaaauauguggaggauaccaagaucgaccugugguccuacaacgcggagcuccugguugcccuggaaaaucagcacacgauugaucucacagacagcgagaugaacaaacuguucgaaaagaccaaaaagcagcuuagagagaaugcugaagauauggggaacggaugcuuuaagaucuaucauaaaugugacaaugccugcaucggcucuauucggaacgggaccuacgaucacgacguguauagagacgaggcccugaauaaccgcuuccagaucaagggcgucgagcucaaauccggauacaaggauuggauucuguggaucagcuuugcuauuucuugcuuccuucuguguguggcccuccugggcuuuaucaugugggcgugccaaaaagggaauauccgguguaacauuugcaucuga

SEQ ID NO: 195506 - RNA, 1701 nt, Artificial Sequence
  derived and/or modified sequence opt5 from hemagglutinin__InfluenzaA__AID70465
augaagaccaucauugcccugagcuacauccucugccugguguucgcucagaaacuucccggcgacgauaacuccacagccacgcugugucucgggcaccaugcggucccuaauggaaccauuguuaagacaaucaccaacgaccaaauugaggugacaaaugcuaccgaacuggugcagucuagcuccacaggcgagaucugcaacucuccgcaccagauccuugauggggaaaauuguacccugauugacgcccuccugggagauccccagugcgacggcuuucaaaacaaaaagugggaucuguucgucgagagaagcaaagcccauuccaauuguuauccuuacgacgugcccgauuaugcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaccugaauuuuaaguacccugcccuuaacgucaccaugcccaacaaugagcaguucgacaagcuguauauuuggggcgugcaucacccugggacggauaaagaccagaucuuucucuacgcgcaagccucuggacgcauuacaguuuccaccaagaaaagccagcaggcugugaucccgaacauuggcuccagaccccggguccgcaauaucccuucuagagugagcaucuauuggacaauugugaagcccggggauauccugcugauuaacuccaccggaaaucucaucgccccucggggcuacuucaaaauucgcagcgggaagucuuccaucaugagaagcgacgcucccaucggaaaguguaacucugccugcauuaccccgaauggcagcaucccuaacgacaaacccuuucagaaugucaaccggauuacauacggcgcguguccucgcuauguuaagcaaaauacgcugaaacuugccaccgggaugagaaacgugcccgaaaagcagacacggggaaucuucggcgcuauugccggguuuaucgagaauggaugggaaggcaugguggaugggugguacggauuccgccaccagaacuccgagggcagaggccaagcugccgaccugaaaucuacccaggccgcuaucgaucagauuaaugggaagcucaaccggcugaucggaaaaacaauugagaaguuccaucagaucgaaaaggaguuuagcgaagucgagggccgcauucaagaccuugaaaaauauguggaggauaccaagaucgaccugugguccuacaacgcggagcuccugguugcccuggaaaaucaccaugcuauugaucucacggacagcgagaugaacaaacuguucgaaaagaccaaaaagcagaugagagagaaugccgaagauauggggaacggaugcuuuaagaucuaucuuaaaugugacaaugccugcaucggcucuauucggaacgggaucuacgaucacgacguguauagagacgaggcucugaauaaccgcuuccagauuaagggcgucgagcucaaauccggauacaaggauuggauccuguggauuagcuuuacagaaucuugcuuccuucuguguguggcccuccugggcuuuaucaugugggcgugccagaaagggaauauccgguguaacauuugcaucuga

SEQ ID NO: 195507 - RNA, 1701 nt, Artificial Sequence
  derived and/or modified sequence opt5 from hemagglutinin__InfluenzaA__AID70466
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccaccaagaaaagccagcaggcugugaucccgaauauuggcuccagaccccggguccgcaacaucccuucuagagugagcaucuauuggacaauugugaagcccggggacauccugcugauuaauuccaccggaaaccucaucgccccucggggcuacuucaaaauucgcagcgggaagucuuccaucaugagaagcgaugcucccaucggaaaguguaauucugccugcauuaccccgaacggcagcaucccuaaugacaaacccuuucagaacgucaaucggauuacauacggcgcguguccucgcuauguuaagcaaaacacgcugaaacuugccaccgggaugagaaaugugcccgaaaagcagacacggggaaucuucggcgcuauugccggguuuaucgagaacggaugggaaggcaugguggacgggugguacggauuccgccaccaaaauuccgagggcagaggccaggcugccgaucugaaaucuacccaggccgcuaucgaccagauuaacgggaagcucaaccggcugaucggaaaaacaauugagaaguuccaucagaucgaaaaugaguuuagcgaagucgagggccgcauucaagaucuugaaaaguauguggaggacaccaaaaucgaucugugguccuacauuggggagcuccugguugcgcuggaaaaccagcacacgaucgaccucacagauagcgagaugaauaagcuguucgagaaaaccaagaaacagcuuagagaaaacgccgaagacaugggaaauggcugcuuuaagaucuaucauaagugugauaacgcuugcauugggucuauccggaauggcauuuacgaccacgauguguauagagacgaggcccugaacaaucgcuuccagaucaaaggagucgagcucaaguccggcuacaaagacuggauucuguggaucagcuuugccaucucuugcuuccuucuguguguggcucuccugggguuuauuaugugggccugccaaaagggaaacauccgguguaauauuugcaucuga

SEQ ID NO: 195508 - RNA, 1701 nt, Artificial Sequence
  derived and/or modified sequence opt5 from hemagglutinin__InfluenzaA__AID70467
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccaccaagaaaagccagcaggcugugaucccgaauauuggcuccagaccccggguccgcaacaucccuucuagagugagcaucuauuggacaauugugaagcccggggacauccugcugauuaauuccaccggaaaccucaucgccccucggggcuacuucaaaauucgcagcgggaagucuuccaucaugagaagcgaugcucccaucggaaaguguaauucugccugcauuaccccgaacggcagcaucccuaaugacaaacccuuucagaacgucaaucggauuacauacggcgcguguccucgcuauguuaagcaaaacacgcugaaacuugccaccgggaugagaaaugugcccgaaaagcagacacggggaaucuucggcgcuauugccggguuuaucgagaacggaugggaaggcaugguggacgggugguacggauuccgccaccagaauugcgagggcagaggccaagcugccgaucugaaauccacccaggccgcuaucgaccagauuaacgggaagcucaaccggcugaucggaaaaacaauugagaaguuccaucagaucgaaaaugaguuuucugaagucgagggccgcauucaagggcuugaaaaguauguggaggauaccaaaaucgaccuguggagcuacauugcggagcucaucguugcccuggaaaaccagcacacgaucgaucugacagacuccgagaugaauaaacucuucgaaaagaccaagaaacagaugagagagaacgcugaagauaugggaaauggcuguuuuaagauuuaucauaagugcgacaacgccugcaucgggagcauucggaauggcaucuacgaucacgacguguauagagaugaggcccugaacaaucgcuuccagauuaaaggagucgagcuuaagucuggcuacaaagacuggauccuguggaucuccuuugcuauuagcuguuuccuccugugcguggcccuucugggguuuaucaugugggcgugucaaaagggaaacauucggugcaauaucuguauuuga

SEQ ID NO: 195509 - RNA, 1701 nt, Artificial Sequence
  derived and/or modified sequence opt5 from hemagglutinin__InfluenzaA__AID70468
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccaccaagagaagccagcaggcugugaucccgaauauuggcucccggccccgcgucagaaacaucccuucucgggugagcaucuauuggacaauugugaaacccggggacauccugcugauuaauuccaccggaaaccucaucgccccucgcggcuacuucaagauuagaagcgggaaaucuuccaucaugcggagcgaugcucccaucggaaaguguaauucugccugcauuaccccgaacggcagcaucccuaaugacaagcccuuucagaacgucaaucgcauuacauacggcgcguguccuagauauguuaaacaaaacacgcugaaacuugccaccgggaugcggaaugugcccgaaaagcagacacgcggaaucuucggcgcuauugccggguuuaucgagaacggaugggaaggcaugguggacgggugguacggauucagacaccagaauugcgagggccggggccaagcugccgaucugaaguccacccaggccgcuaucgaccagauuaacgggaaacucaacagacugaugggaaagucuaucgagaaauuccaucagauugaaaaugaguuuagcgaagucgagggccgcauccaagggcuugaaaaguauguggaggauacaaagauugaccugugguccuacaacggagagcucaucguugcgcuggaaaaucagcacgccauugaucugaccgacagcgagaugaacaaacucuucgaaaagacgaaaaagcagaugcgggagaaugcugaagauaugggcaacggguguuuuaaaaucuaucugaagugcgacaaugccugcaucggcucuauuagaaacggaaucuacgaucaugacguguaucgcgaugaggcccuuaauaaccgguuccagauuaagggcgucgagcugaaauccggguacaaggacuggauccucuggauuagcuuuacaaucucuuguuuccugcuuugcguggcucugcucggauuuaucaugugggccagacaaaaaggcaauauucgcuguaacaucugcauuuga

SEQ ID NO: 195510 - RNA, 1701 nt, Artificial Sequence
  derived and/or modified sequence opt5 from hemagglutinin__InfluenzaA__AID70469
augaagaccaucauugcccugagcuacauccucugccugguguucgcucagaaaguccccggcaacgaaaauuccacagccacgcuuugucuggggcaccaugcgguuccuaacggaaccauugugaagacaaucaccaaugaccaaauugaggugacaaacgcuaccgagcucguccagucuagcuccacaggcgaaaucugcaauucuccgcaccagauccuggauggggagaacuguacccuuauugacgcccugcucggagauccccagugcgacggcuuucaaaauaaaaagugggaucuguucguggaaagaagcaaagcccauuccaacuguuauccuuacgacguucccgauuaugcuucucugcggagccucguggccuccagcgggacgcuggaguuuaauaacgagucuuucaauuggaccggagucacacagaacggcaccuccagcgcuugcauccgcagaucuaauaacuccuuuuucagccggcuuaauuggcugacacaccucaacuuuaaguacccugcccugaacgugaccaugcccaauaacgaacaguucgacaaacuuuauauuuggggcguucaucacccugggacggauaaggaccagaucuuucuguacgcgcaagccucuggacgcauuacaguguccaccaagagaagccagcaggcugucaucccgaauauuggcucccggccccgcgugagaaacaucccuucucgggugagcaucuauuggacaauugucaaacccggggauauccuccugauuaauuccaccggaaaccugaucgccccucgcggcuacuucaagauuagaagcgggaaaucuuccaucaugcggagcgacgcucccaucggaaaguguaauucugccugcauuaccccgaacggcagcaucccuaaugauaagcccuuucagaacguuaaucgcauuacauacggcgcguguccuagauaugugaaacaaaacacgcucaagcuggccaccgggaugcggaaugugcccgagaaacagacacgcggaaucuucggcgcuauugccggguuuaucgaaaacggaugggagggcauggucgacgggugguacggauucagacaccagaauugcgagggccggggccaagcugccgaccuuaaguccacccaggccgcuaucgaucagauuaacgggaaacugaacagacucaucggaaagacaauugaaaaauuccaucagaucgagaaggaauuuucugagguggaaggccgcauucaagggcuggagaaguauguugaggacaccaaaaucgaucuuuggagcuacaaugcggaacugcucguggcccuggagaaccagcacacgauugaccugacagauuccgaaaugaauaaacucuucgagaagaccaagaaacagaugcgggaaaacgcugaggacaugggaaauggcuguuuuaagaucuaucauaagugcgauaacgccugcaucgggagcauuagaaauggcaucuacgaccacgaugucuaucgcgacgaggcccugaacaaucgguuccagauuaaaggaguggaacuuaagucuggcuacaaagauuggauccuguggauuuccuuuaccaucagcuguuuccuccugugcguugcccuucugggguuuaucaugugggcuugucaaaagggaaacauuagaugcaauaucuguauuuga

SEQ ID NO: 195511 - RNA, 1701 nt, Artificial Sequence
  derived and/or modified sequence opt5 from hemagglutinin__InfluenzaA__AID70470
augaagaccaucauugcccugagcuacauccucugccugguguucgcucagaaaguccccggcaacgaaaauuccacagccacgcuuugucuggggcaccaugcgguuccuaacggaaccauugugaagacaaucaccaaugaccaaauugaggugacaaacgcuaccgagcucguccagucuagcuccacaggcgaaaucugcaauucuccgcaccagauccuggauggggagaacuguacccuuauugacgcccugcucggagauccccagugcgacggcuuucaaaauaaaaagugggaucuguucguggaaagaagcaaagcccauuccaacuguuauccuuacgacguucccgauuaugcuucucugcggagccucguggccuccagcgggacgcuggaguuuaauaacgagucuuucaauuggaccggagucacacagaacggcaccuccagcgcuugcauccgcagaucuaauaacuccuuuuucagccggcuuaauuggcugacacaccucaacuuuaaguacccugcccugaacgugaccaugcccaauaacgaacaguucgacaaacuuuauauuuggggcguucaucacccugggacggauaaggaccagaucuuucuguacgcgcaagccucuggacgcauuacaguguccaccaagagaagccagcaggcugucaucccgaauauuggcucccggccccgcgugagaaacaucccuucucgggugagcaucuauuggacaauugucaaacccggggauauccuccugauuaauuccaccggaaaccugaucgccccucgcggcuacuucaagauuagaagcgggaaaucuuccaucaugcggagcgacgcucccaucggaaaguguaauucugccugcauuaccccgaacggcagcaucccuaaugauaagcccuuucagaacguuaaucgcauuacauacggcgcguguccuagauaugugaaacaaaacacgcucaagcuggccaccgggaugcggaaugugcccgagaaacagacacgcggaaucuucggcgcuauugccggguuuaucgaaaacggaugggagggcauggucgacgggugguacggauucagacaccagaauugcgagggccggggccaagcugccgaccuuaaguccacccaggccgcuaucgaucagauuaacgggaaacugaacagacucaucggaaagacaauugaaaaauuccaucagaucgagaaggaauuuucugagguggaaggccgcauucaagggcuggagaaguauguugaggacaccaaaaucgaucuuuggagcuacaauggagaacugcucguggcgcuggagaaccaccauacgauugaccugacagauuccgaaaugaauaaacucuucgagaagaccaagaaacagaugcgggaaaacgccgaggacaugggcaauggguguuuuaagaucuaucacaagugcgauaacgcuugcaucggcagcauuagaaauggaaucuacgaccacgaugucuaucgcgacgaggcccugaacaaucgguuccagauuaaaggcguggaacuuaagucuggguacaaagauuggauccuguggauuuccuuuaccaucagcuguuuccuccugugcguugcccuucugggauuuaucaugugggcuugucagaagggcaacauuagaugcaauaucuguauuuga

SEQ ID NO: 195512 - RNA, 1701 nt, Artificial Sequence
  derived and/or modified sequence opt5 from hemagglutinin__InfluenzaA__AID70471
augaagaccaucauugcccugagcuacauccucugccugguguucacacagaaacuucccggcaacgacaauuccacggcuacccugugucucgggcaccaugccgucccuaacggaacaauuguuaagaccaucacaaaugaucaaauugaggugaccaacgcgacagaacuggugcagucuagcuccaccggcgagaucugcaauucuccgcaccagauccuugacggggaaaacuguacgcugauugaugcucuccugggagacccccagugcgauggcuuucaaaauaaaaagugggaccuguucgucgagagaagcaaagcccauuccaacuguuauccuuacgaugugcccgacuaugccucucuccggagccugguugcuuccagcgggacccuugaauuuaauaacgagucuuucaauuggacaggagugacccagaacggcacauccagcgccugcauccgcagaucuaauaacuccuuuuucagccggcugaauuggcucacccaccugaacuuuaaguacccugcucuuaacgucacgaugcccaauaacgagcaguucgauaagcuguauauuuggggcgugcaucacccugggacagacaaagaucagaucuuucucuacgcccaagcgucuggacgcauuaccguuuccacaaagaaaagccagcaggccgugaucccgaauauuggcuccagaccccggguccgcaacaucccuucuagagugagcaucuauuggaccauugugaagcccggggacauccugcugauuaauuccaccggaaaccucaucgcuccucggggcuacuucaaaauucgcagcgggaagucuuccaucaugagaagcgaugcccccaucggaaaguguaauucugcuugcauuacaccgaacggcagcaucccuaaugacaaacccuuucagaacgucaaucggauuacguacggcgccuguccucgcuauguuaagcaaaacacccugaaacuugcgacagggaugagaaaugugcccgaaaagcagacccggggaaucuucggcgccauugcuggguuuaucgagaacggaugggaaggcaugguggacgggugguacggauuccgccaccaaaauuccgagggcagaggccaggccgcugaucugaaaucuacacaggccgccaucgaccagauuaacgggaagcucaaccggcugaucggaaaaaccauugagaaguuccaucagaucgaaaaugaguuuagcgaagucgagggccgcauucaagaucuugaaaaguauguggaggacacgaaaaucgaucugugguccuacaacgcugagcucauuguugcgcuggaaaaucaccauacaaucgaccugaccgauagcgagaugaacaaacucuucgaaaagaccaagaaacagaugagagagaaugccgaagacauggggaacggaugcuuuaagaucuaucacaagugugauaaugcuugcauuggcucuauccggaacgggauuuacgaccacgauguguauagagacgaggcccugaauaaccgcuuccagaucaaaggcgucgagcuuaaguccggauacaaagacuggauucuguggaucagcuuugccaucucuugcuuccucauuuguguggcucugcuuggcuuuaucaugugggccugccagaaggggaaucugcgguguaacauuugcaucuga

SEQ ID NO: 195513 - RNA, 1701 nt, Artificial Sequence
  derived and/or modified sequence opt5 from hemagglutinin__InfluenzaA__AID70472
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccaccaagaaaagccagcaggcugugaucccgaauauuggcuccagaccccggguccgcaacaucccuucuagagugagcaucuauuggacaauugugaagcccggggacauccugcugauuaauuccaccggaaaccucaucgccccucggggcuacuucaaaauucgcagcgggaagucuuccaucaugagaagcgaugcucccaucggaaaguguaauucugccugcauuaccccgaacggcagcaucccuaaugacaaacccuuucagaacgucaaucggauuacauacggcgcguguccucgcuauguuaagcaaaacacgcugaaacuugccaccgggaugagaaaugugcccgaaaagcagacacggggaaucuucggcgcuauugccggguuuaucgagaacggaugggaaggcaugguggacgggugguacggauuccgccaccaaaauuccgagggcagaggccaggcugccgaucugaaaucuacccaggccgcuaucgaccagauuaacgggaagcucaaccggcugaucggaaaaacaauugagaaguuccaucagaucgaaaaggaguuuagcgaagucgagggccgcauucaagaucuugaaaaauauguggaggacaccaagaucgaucugugguccuacaaugcggagcuccugguugcccuggaaaaccaccauacgauugaccucacagauagcgagaugaauaaacuguucgaaaagaccaaaaagcagaugagagagaacgcugaagacauggggaauggaugcuuuaagaucuaucacaaaugugauaacgccugcaucggcucuauucggaaugggaucuacgaccacgauguguauagagacgaggcccuuaacaaucgcuuccagauuaagggcgucgagcugaaauccggauacaaggacuggauccucuggauuagcuuugcuaucucuugcuuccugcuuuguguggcccugcucggcuuuaucaugugggcgugccagaaagggaacauucgguguaauaucugcauuuga

SEQ ID NO: 195514 - RNA, 1701 nt, Artificial Sequence
  derived and/or modified sequence opt5 from hemagglutinin__InfluenzaA__AID70473
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccaccaagaaaagccagcaggcugugaucccgaauauuggcuccagaccccggguccgcaacaucccuucuagagugagcaucuauuggacaauugugaagcccggggacauccugcugauuaauuccaccggaaaccucaucgccccucggggcuacuucaaaauucgcagcgggaagucuuccaucaugagaagcgaugcucccaucggaaaguguaauucugccugcauuaccccgaacggcagcaucccuaaugacaaacccuuucagaacgucaaucggauuacauacggcgcguguccucgcuauguuaagcaaaacacgcugaaacuugccaccgggaugagaaaugugcccgaaaagcagacacggggaaucuucggcgcuauugccggguuuaucgagaacggaugggaaggcaugguggacgggugguacggauuccgccaccagaauugcgagggcagaggccaagcugccgaucugaaauccacccaggccgcuaucgaccagauuaacgggaagcucaaccggcugaucggaaaaacaauugagaaguuccaucagaucgaaaaggaguuuucugaagucgagggccgcauucaagggcuugaaaaauauguggaggauaccaagaucgaccuguggagcuacaaugcggagcuccugguugcccuggaaaaccagcacacgauugaucucacagacuccgagaugaauaaacuguucgaaaagaccaaaaagcagaugagagagaacgcugaagauaugggaaauggcuguuuuaagaucuaucauaaaugcgacaacgccugcaucgggagcauucggaauggcaucuacgaucacgacguguauagagaugaggcccuuaacaaucgcuuccagauuaagggagucgagcugaaaucuggcuacaaggacuggauccucuggauuuccuuugcuaucagcuguuuccugcuuugcguggcccugcucggguuuaucaugugggcgugucaaaaaggaaacauucggugcaauaucuguauuuga

SEQ ID NO: 195515 - RNA, 1701 nt, Artificial Sequence
  derived and/or modified sequence opt5 from hemagglutinin__InfluenzaA__AID70474
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccaccaagaaaagccagcaggcugugaucccgaauauuggcuccagaccccggguccgcaacaucccuucuagagugagcaucuauuggacaauugugaagcccggggacauccugcugauuaauuccaccggaaaccucaucgccccucggggcuacuucaaaauucgcagcgggaagucuuccaucaugagaagcgaugcucccaucggaaaguguaauucugccugcauuaccccgaacggcagcaucccuaaugacaaacccuuucagaacgucaaucggauuacauacggcgcguguccucgcuauguuaagcaaaacacgcugaaacuugccaccgggaugagaaaugugcccgaaaagcagacacggggaaucuucggcgcuauugccggguuuaucgagaacgugugggaaggaauggucgacggcugguucggguuccgccaccagaucugcgagggaagaggccaagcugccggccuggaguccacccaggccgcuauugaucagaucaaugggaaaaugaaccggcucaugggaaagacaauuggcaaauuucaucagaucgugaacgaguucucugaaguugaagggcgcauucaagaccuggagaaguacguggaagauaccaagaucgaccuuuggagcuauauuggagagcugcucgucgcgcuggagaaucaccaugccaucgaucugacggacuccgaaaugaacaaacucuuugagaagaccaaaaagcagaugagagaaaaugcugaggauaugggcaacggguguuucaaaaucuaccacaagugcgacaaugccugcauuggcagcauccggaacggaauuuaugauagagacguguaccgcgaugaagcccugaauaaccgguuucacaucaagggcguugagcuuaaaucuggguauaaggacuggauuaucuggaucuccagcacagagucuuguuuccugcucugcguggcucugcuuggauuuauuaugugggccugucagaaaggcaauaucagauccaacauuugcaucuga

SEQ ID NO: 195516 - RNA, 1701 nt, Artificial Sequence
  derived and/or modified sequence opt5 from hemagglutinin__InfluenzaA__AID70475
augaagaccaucauugcccugagcuacaugcucugccugguguucgcucagaaacuucccggcaacgacaauuccacagccacgcugugucucgggcaccaugcggucccuaacggaaccaucguuaagacaauuaccaaugaucaaaucgaggugacaaacgcuaccgaacuggugcagucuagcuccacaggcgagauuugcaauucuccgcaccagauccuugacggggaaaacuguacccugaucgaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauucgcagaucuaauaacuccuuuuucagccggcugaauuggcucacacaccugaacuuuaaguacccugcccuuaacgucaccaugcccaauaacgagcaguucgauaagcuguauaucuggggcgugcaucacccugggacggacaaagaucagauuuuucucuacgcgcaagccucuggacgcaucacaguuuccaccaagaaaagccagcaggcugugauuccgaauaucggcuccagaccccggguccgcaacauuccuucuagagugagcaucuauuggacaaucgugaagcccggggacauucugcugaucaauuccaccggaaaccucauugccccucggggcuacuucaaaauccgcagcgggaagucuuccauuaugagaagcgaugcucccaucggaaaguguaauucugccugcaucaccccgaacggcagcauuccuaaugacaaacccuuucagaacgucaaucggaucacauacggcgcguguccucgcuauguuaagcaaaacacgcugaaacuugccaccgggaugagaaaugugcccgaaaagcagacacggggaauuuucggcgcuaucgccggguuuauugagaacgugugggaaggaauggucgacggcugguacggguuccgccaccagaauugcgagggaagaggccaagcugccgaucugaaauccgcccaggcugcgaucgaccccaucaacggcaagcucaaccggcugauggggaaaaccauuggaaaguuccaucagaucgagaaggaauuuucugagguggaaggccgcauucaggaucuugagaaauauguugaagacacaaagaucgaucuguggagcuacaauggggagcuccugguggcccuggagaaccaacacgcuauugaccucaccgauuccgaaaugaauaaagucuucgagaagacgaaaaagcagcugagagaaaacgccgaggacaugggaaauggcuguuuuaagaucuaucauaaaugcgauaacgccugcauugggagcauccggaauggcaucuacgaccacgauguguauagaaacgaagcucuuaauaaccgcuuccagauuaagggaguugagcugaaaucuggcuacaaggacuggauccucuggauuuccuuugccaucagcuguuuccugcuuucuguggcgucccugggguuuauuaugugggcuuaccagaaaggaaauauccggugcaacaucuguauuuga

SEQ ID NO: 195517 - RNA, 1701 nt, Artificial Sequence
  derived and/or modified sequence opt5 from hemagglutinin__InfluenzaA__AID70476
augaagacaaucauugcccugagcuacauccucugccugguguucgcucagaaacuucccggcaacgaaaauuccacagccacgcuggggcucggacaccaugcggucccuaacggcaccauuguuaagacaaucaccaaugaccaaauugaagugacaaacgcuaccgagcuggugcagucuagcuccacaggggaaaucuguaauucuccgcaccagauccuugauggagagaacugcacccugauugacgcccuccugggcgauccccagugugacgauuuucaaaauaaaaagugggaccuguucgucgaaagaagcaaagcccauuccaacugcuauccuuacgaugugcccgacuaugcuucucuccggagccugguugccuccagcgggacgcuugaguuuaauaacgagucuuucaauuggaccggagugacacagaacggcaccuccagcgcuuguauccgcagaucuaauaacuccuuuuucagccggcugaauuggcucacacaccugaacuuuaaguacccugcccuuaacgucaccaugcccaauaacgaacaguucgauaagcuguauauuuggggcgugcaucacccugggacggacaaagaucagaucuuucucuacgcgcaagccucuggacgcauuacaguuuccaccaagaaaagccagcaggcugugaucccgaauauuggcuccagaccccggguccgcaacaucccuucuagagugagcaucuauuggacaauugugaagcccggggacauccugcugauuaauuccaccggaaaccucaucgccccucggggcuacuucaaaauucgcagcgggaagucuuccaucaugagaagcgaugcucccaucggaaagugcaauucugccuguauuaccccgaacggcagcaucccuaaugacaaacccuuucagaacgucaaucggauuacauacggcgcgugcccucgcuauguuaagcaaaacaaucugaaacuugccacggggaugagaaacgugcccgagaagcagacccggggaaucuucggcgcuauugccggguuuaucgaaaauggaugggagggcaugguggacgggugguacggauuccgccaccagaacuccgagggcagaggccaagcugccgaucugaaaucuacacaggccgcuaucgaccagauuaacgggaagcucaaucggcugaucggaaaaaccauugaaaaguuccaucagaucgagaaggaauuuagcgaggucgaaggccgcauucaagggagagagaaauauguggaggauacaaagaucgaccuuugguccuacauuggagaguucaucguugcgcuggagaaccagcacaccaucgaucucacggacagcgaaaugaauaaacuguuugagaagaccaaaaagcagaugcgggaaaacgccgaggauaugggcaauggguguuucaagauuuaucauaaaugcgacaacgcuuguaucggcucuauuagaaauggaaucuacgaucacgacguguaucgcgaugaggcccugaacaaucgguuucagauuaagggcgucgaacucaaauccggguacaaggacuggauccuguggaucagcuucgccauuucuugcuuucuucugugcguggcucuccugggauucaucaugugggccugucaaaaaggcaacauuagaugcaauaucuguauuuga

SEQ ID NO: 195518 - RNA, 1701 nt, Artificial Sequence
  derived and/or modified sequence opt5 from hemagglutinin__InfluenzaA__AID70477
augaagaccaucauugcccugagcuacauccucugccugguguucgcucagaaacuucccggcaacgacuccucuacagggacgcugugucucggacaccaugccgucccuaauggcaccauuguuaagacaaucaccaacgaucaaauugaggugacaaaugcgaccgaacuggugcagagcuccucuacaggggagaucugcaacagaccgcaccagauccuugacggagaaaauuguacccugauugaugcucuccugggcgacccccagugcgauggguuucaaaacaaaaagugggaccuguucgucgagcggagcaaagcccauuccaauuguuauccuuacgaugugcccgacuaugccucucuccgcagccugguugcuuccagcggaacgcuugaauuuaacaaugagucuuucaacuggaccggcgugacacagaauggcaccuccagcgccugcaucagacggucuaacaauuccuuuuucagcauucugaacuggcucacacaccugaauuuuaaguacccugcucuuaacgucaccaugcccaacaaugagcaguucgauaagcuguauaucuggggagugcaucacccugggacggacaaagaucagauuuuucucuacgcccaagcgucuggccgcaucacaguuuccaccaagaaaagccagcaggccgugauuccgaacaucggguccagaccccggguccgcaauaucccuucuagagugagcauuuauuggacaaucgugaagcccggagaaauucugcugaucaacuccaccggcaaucucauugcuccucggggguacuucaaaauccgcagcggaaagucuuccaucaugagaagcgacgcccccauuggcaaguguuacucugcuugcaucaccccgaacggcagcauuccuaaugauaaacccuuucagaacgucaaucggaucacauauggggccuguccucgcuacguuaagcaacacccccugaaacuugcgacgggaaugagaaacgugcccgagaagcagacccggggcauuuucggggccaucgcuggauuuaucgaaaauggcugggaggggaugguggacggaugguauggcuuccgccaucagauuugcgagggcagagggcaagccgcugaccugaaauccacacaggccgccaucgaucagauuaacggaaagcucaaucggcugaucggcaaaaccauugaaaaguuccaccagaucgagaaggaauuuucugaggucgaauggcgcauucaagggcuugagaaauacguggaggacacaaagguugaucuguggagcuauaacggagaacucaucguggcucuggagaaucaucacaccaucgaccugacggauuccgaaaugaacaaacucuucgagaagaccaaaaagcagaugagagaaaacgcggaggacaugggcaauggguguuuuaagauuuaccugaaaugcgauaacgccugcaucggcagcauucggaauggaaucuaugaccacgaugucuacagagacgaggcucuuaacaaucgcuuccagauuaagggcguggaacugaaaucuggguacaaggauuggauccucuggaucuccuuuacagagagcuguuuccugcuuucuguugcccugcucggauuuauuaugugggccugccagaaaggcaacauccgguguaauauuugcaucuga

SEQ ID NO: 195519 - RNA, 1701 nt, Artificial Sequence
  derived and/or modified sequence opt5 from hemagglutinin__InfluenzaA__AID70478
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccaccaagaaaagccagcaggcugugaucccgaauauuggcuccagaccccggguccgcaacaucccuucuagagugagcaucuauuggacaauugugaagcccggggacauccugcugauuaauuccaccggaaaccucaucgccccucggggcuacuucaaaauucgcagcgggaagucuuccaucaugagaagcgaugcucccaucggaaaguguaauucugccugcauuaccccgaacggcagcaucccuaaugacaaacccuuucagaacgucaaucggauuacauacggcgcguguccucgcuauguuaagcaaaacacgcugaaacuugccaccgggaugagaaaugugcccgaaaagcagacacggggaaucuucggcgcuauugccggguuuaucgagaacggaugggaaggcaugguggacgggugguacggauuccgccaccagaauugcgagggcagaggccaagcugccgaucuggaguccacccaggccgcuaucgaccagauuaacgggaaaaugaaccggcucaugggaaagacaaucgaaaaauuccaucagauugagaaggaauuuucugaggucgaaggcagaauccaagggcgcgagaaguauguggaggauaccaaaauugaccuguggagcuacaauggagaacuucugguugaucucgagaaccagcacacgaucgaccugacagauuccgaaaugaauaagguguucgagaaaaccaagaaacagaugcgggaaaacgcggaggacaugggcaauggguguuuuaagauuuaucauaagugcgauaacgccugcaucggcagcaucagaaauggaauuuacgaccacgaugucuaucgcgacgaggcucugaacaaucgguuccagaucaaaggcguggaacucaagucuggguacaaagacuggauucaauggaucuccuuuaccauuagcuguuuccugcuuugcguuucucugcucggauuuaucaugugggccugucagaagggcaacaucagaugcaauauuuguaucuga

SEQ ID NO: 195520 - RNA, 1701 nt, Artificial Sequence; identical to SEQ ID NO: 193064
  derived and/or modified sequence opt5 from hemagglutinin__InfluenzaA__AID70632

SEQ ID NO: 195521 - RNA, 1683 nt, Artificial Sequence
  derived and/or modified sequence opt5 from hemagglutinin__InfluenzaA__AID70634
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccaauauuccucgcaucuguuccaagggcaaaagaacaguugaucuggggcaaugcggacuccugggcaccaucacggggccgccccagugugaccaguuucuugaguucucugccgaucugauuaucgaacggcgcgagggaagcgacgugugcuacccuggcaaguuugucaacgaggaagcccucagacagauucugcgggaguccggcgggaucgauaaagaagcuaugggauucaccuauucuggcauucgcacaaauggggccaccagcgcuuguagacgguccggaucuagcuuuuacgccgagaugaaguggcugcucuccaacacagacaaugcggccuucccccaaaugaccaagagcuauaaaaacacgcgcaagucuccugcucugaucguguggggcauucaccauuccguuagcacagccgagcagaccaaacuuuacgggucuggaaauaagcuggugacagucggcuccagcaacuaucagcagucuuuugugcccuccccuggcgcuagaccgcaagugaaugggcucagcggacggaucgauuuccacuggcugaugcuuaaccccaaugacaccgucaccuuuuccuucaacggcgccuuuaucgcgccugaucgcgccucuuuccugagagggaaaagcaugggcauucaguccggaguucagguggacgcuaacugcgaaggggauuguuaccauagcggaggcacaaucauuucuaaucuccccuuucagaacaucgacucccgggccgugggcaagugcccucgcuaugucaagcaaagaagccugcugcucgcuacggggaugaaaaaugugcccgagauuccgaagggacggggccuguucggggccaucgccggauucaucgaaaacggcugggaggggcuuauugauggcugguacggauuuagacaccagaaugcucagggcgaagggaccgcggccgacuacaaaucuacacaaagcgcuaucgaccagauuaccggaaagcugaaccgcaucauugagaaaacaaaucagcaguucgagcucaucgauaacgaauuuaaugagguugaaaagcaaaucuccaacgugauuaauuggacccgggacucuaucacggaggucuggagcuauaacgccgaacugcuuguggccauggagaaucagcacacaauugaucuggcugacuccgagauggauaaacucuacgaaagaguuaagcgccagcugcgggagaacgccgaagaggacggcaccggguguuucgaaaucuuucauaagugcgaugacgauuguauggcgagcauuagaaauaacaccuaugaccacucuaaauaccgcgaggaggcuaugcagaaccggauccaaauugauccugugaagcuguccagcggauauaaagacgucauccucugguucucuuuuggcgccuccugcuucauccugcuugccauugugauggggcuggucuuuaucugcgugaagaauggcaacaugagauguacaauuugcaucuga

SEQ ID NO: 195522 - RNA, 1701 nt, Artificial Sequence
  derived and/or modified sequence opt5 from hemagglutinin__InfluenzaA__AIF72902
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccgccggcgagaucugcgacucuccgcaccagauccuugauggggaaaauuguacacugauugacgcccuccugggagauccccagugcgacggcuuucaaaacaaaaagugggaucuguucgucgagagaagccgggcuuauuccaauuguuacccuuaugacgugcccgauuacgccucucuccgcagccugguugcuuccagcgggacccuugaauuuaacaaugagucuuucaacuggacgggagugacccagaauggcacauccagcgccugcaucagacggucuaacaauuccuuuuucagccgccugaacuggcucacccaucugaauuuuaaauauccugcgcuuaacgucacaaugcccaacaaugagcaguucgacaagcuguacauuuggggcgugcaccauccugggaccgauaaggaccagaucuuucucuaugcccaggcuucuggaagaauuacgguuuccacaaaacggagccagcaggccgugaucccgaacauuggcucccgccccagaguccggaauaucccuucucgcaucagcauuuacuggaccaucgugaagcccggggauauucugcugaucaacuccacaggaaaucucauugcuccuagaggcuacuucaaaauccggagcgggaagucuuccaucaugcgcagcgacgcccccauuggaaaauguaacucugaaugcaucaccccgaauggcagcauuccuaacgacaagcccuuucagaaugugaacagaaucaccuauggcgcguguccucgguacgucaagcaauccacacugaaacuugccacggggaugcgcaauguucccgagaagcagaccagaggaauuuucggcgcuaucgccggguuuaucgaaaacggaugggagggcaugguggaugggugguauggauuccggcaccaaaauucugagggcagaggccaagcugccgaccugaaaagcacacaggccgcuauugaucagaucaacgggaagcucaaucgccugauuggaaaaaccaacgaaaaguuccaccagaucgagaaagaauuuuccgagguggaaggccggauucaagaccuugagaaguacgucgaggauacaaagaucgaccuguggagcuauaacgcggaacuccugguggcccuggagaaucagcauaccauugaucucacggacucugaaaugaacaaacuguucgagaagaccaaaaagcagcuuagagaaaaugcugaggauauggggaacggaugcuuuaaaaucuaccacaagugugacaaugccugcaucggcuccauucgcaacgggacauaugaucaugacguuuaccgggacgaggcccugaauaacagauuccagaucaagggcguggaacucaaaagcggauacaaggauuggauucuguggaucucuuuugcuauuuccugcuuccuucugugugucgcccuccugggcuuuaucaugugggcgugccaaaaagggaauauccgcuguaacauuugcaucuga

SEQ ID NO: 195523 - RNA, 1701 nt, Artificial Sequence
  derived and/or modified sequence opt5 from hemagglutinin__InfluenzaA__AIF72903
augaagaccaucauugcccugagcuacauccucugccugguguucgcucaggagcuucccggcaacgacaauuccacagccacgcugugucucgggcaccaugcggucccuaacggaaccauuguuaaaacaaucaccaaugaucaaauugaagugacaaacgcuaccgagcuggugcagucuagcuccgccggcgaaaucugcgacucuccgcaccagauccuugauggggagaauuguacacugauugacgcccuccugggagauccccagugcgacggcuuucaaaacaagaaaugggaucuguucgucgaaagaagccgggcuuauuccaauuguuacccuuaugacgugcccgauuacgccucucuccgcagccugguugcuuccagcgggacccuugaguuuaacaaugagucuuucaacuggacgggagugacccagaauggcacauccagcgccugcaucagacggucuaacaauuccuuuuucagccgccugaacuggcucacccaucugaauuuuaaguauccugcgcuuaacgucacaaugcccaacaaugaacaguucgacaaacuguacauuuggggcgugcaccauccugggaccgauaaggaccagaucuuucucuaugcccaggcuucuggaagaauuacgguuuccacaaagcggagccagcaggccgugaucccgaacauuggcucccgccccagaguccggaauaucccuucucgcaucagcauuuacuggaccaucgugaaacccggggauauucugcugaucaacuccacaggaaaucucauugcuccuagaggcuacuucaagauccggagcgggaaaucuuccaucaugcgcagcgacgcccccauuggaaaguguaacucugagugcaucaccccgaauggcagcauuccuaacgacaaacccuuucagaaugugaacagaaucaccuauggcgcguguccucgguacgucaagcaauccacacugaaacuugccacggggaugcgcaauguucccgaaaaacagaccagaggaauuuucggcgcuaucgccggguuuaucgagaacggaugggagggcaugguggaugggugguauggauuccggcaccaaaauucugaaggcagaggccaagcugccgaccucaagagcacacaggccgcuauugaucagaucaacgggaaacugaaucgccugauuggaaagaccaacgagaaauuccaccagaucgaaaaggaguuuuccgaaguggagggccggauucaagaccuugagaaauacgucgaagauacaaagaucgaccuguggagcuauaacgcggagcuccugguggcccuggaaaaucagcauaccauugaucucacggacucugagaugaacaagcuguucgaaaagacaaagaaacagcuuagagagaaugcugaggauauggggaacggaugcuuuaagaucuaccacaaaugugacaaugccugcaucggcuccauucgcaacgggaccuaugaucaugacguuuaccgggacgaagcccugaauaacagauuccagaucaagggcguggagcucaagagcggauacaaagauuggguccuguggauuucuuuugcuaucuccugcuuccuucuguguguggcccuccugggcuuuauuaugugggcgugccaaaaggggaauauccgcuguaacaucugcauuuga

SEQ ID NO: 195524 - RNA, 1701 nt, Artificial Sequence
  derived and/or modified sequence opt5 from hemagglutinin__InfluenzaA__AIF72904
augaagaccaucauugcccugagcuacauccucugccugguguucgcucaggagcuucccggcaacgacaauuccacagccacgcugugucucgggcaccaugcggucccuaacggaaccauuguuaaaacaaucaccaaugaucaaauugaagugacaaacgcuaccgagcuggugcagucuagcuccgccggcgaaaucugcgacucuccgcaccagauccuugauggggagaauuguacacugauugacgcccuccugggagauccccagugcgacggcuuucaaaacaagaaaugggaucuguucgucgaaagaagccgggcuuauuccaauuguuacccuuaugacgugcccgauuacgccucucuccgcagccugguugcuuccagcgggacccuugaguuuaacaaugagucuuucaacuggacgggagugacccagaauggcacauccagcgccugcaucagacggucuaacaauuccuuuuucagccgccugaacuggcucacccaucugaauuuuaaguauccugcgcuuaacgucacaaugcccaacaaugaacaguucgacaaacuguacauuuggggcgugcaccauccugggaccgauaaggaccagaucuuucucuaugcccaggcuucuggaagaauuacgguuuccacaaagcggagccagcaggccgugaucccgaacauuggcucccgccccagaguccggaauaucccuucucgcaucagcauuuacuggaccaucgugaaacccggggauauucugcugaucaacuccacaggaaaucucauugcuccuagaggcuacuucaagauccggagcgggaaaucuuccaucaugcgcagcgacgcccccauuggaaaguguaacucugagugcaucaccccgaauggcagcauuccuaacgacaaacccuuucagaaugugaacagaaucaccuauggcgcguguccucgguacgucaagcaauccacacugaaacuugccacggggaugcgcaauguucccgaaaaacagaccagaggaauuuucggcgcuaucgccggguuuaucgagaacggaugggagggcaugauggaugggugguauggauuccggcaccaaaauucugaaggcagaggccaagcugccgaccucaagagcacacaggccgcuauugaucagaucaacgggaaacugaaucgccugauuggaaagaccaacgagaaauuccaccagaucgaaaaggaguuuuccgaaguggagggccggauucaagaccuugagaaauacguggaagauacaaagaucgaccuguggagcuauaacgcggagcuccuggucgcccuggaaaaucagcauaccauugaucucacggacucugagaugaacaagcuguucgaaaagacaaagaaacagcuuagagagaaugcugaggauauggggaacggaugcuuuaagaucuaccacaaaugugacaaugccugcaucggcuccauucgcaacgggaccuaugaucaugacguguaccgggacgaagcccugaauaacagauuccagaucaagggcguugagcucaagagcggauacaaagauugggugcuguggauuucuuuugcuaucuccugcuuccuucugugugucgcccuccugggcuuuauuaugugggcgugccaaaaggggaauauccgcuguaacaucugcauuuga

SEQ ID NO: 195525 - RNA, 1701 nt, Artificial Sequence
  derived and/or modified sequence opt5 from hemagglutinin__InfluenzaA__AIF72905
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccgccggcgagaucugcgacucuccgcaccagauccuugauggggaaaauuguacacugauugacgcccuccugggagauccccagugcgacggcuuucaaaacaaaaagugggaucuguucgucgagagaagccgggcuuauuccaauuguuacccuuaugacgugcccgauuacgccucucuccgcagccugguugcuuccagcgggacccuugaauuuaaaaacgagucuuucaauuggacgggagugacccagaacggcacauccagcgccugcaucagacggucuaauaacuccuuuuucagccgccugaauuggcucacccauucuaacuuuaaguauccugcgcugaaugucacaaugcccaacaacgagcaguucgacaaacuuuacauuuggggcgugcaccauccugggaccgauaaggaccagaucuuucuguaugcccaggcuuccggaagaauuacgguuagcacaaagcggucccaacaggccgugaucccgaauauuggcucucgccccagaguccggaacaucccuagccgcaucuccauuuacuggaccaucgugaaacccggggauauucuccugaucaauagcacaggaaaccugauugcuccuagaggcuacuucaagauccggucugggaaauccagcaucaugcgcucugacgcccccauuggaaaguguaauagcgaaugcaucaccccgaacggcuccauuccuaaugacaagcccuuucagaacgugaauagaaucaccuauggcgcguguccucgguacgucaaacaaucuacacucaagcuggccacggggaugcgcaacguucccgagaaacagaccagaggaauuuucggcgcuaucgccggguuuaucgaaaauggaugggagggcaugauggaugggugguauggauuccggcaccagaacagcgagggcagaggccaagcugccgaccuuaaguccacacaggccgcuauugaucagaucaaugggaaacugaaccgccucauuggaaagaccaaugaaaaauuccaccagaucgagaaggaauuuagcgagguggaaggccggauucaagaccuggagaaguacguggaggauacaaaaaucgaccuuuggucuuauaacgcggaacugcucgucgcccuggagaaccagcauaccauugaucugacggacuccgaaaugaauaaacucuucgagaagacaaagaaacagcugagagaaaacgcugaggauauggggaauggaugcuuuaagaucuaccacaagugugacaacgccugcaucggcagcauucgcaaugggaccuaugaucaugacguguaccgggacgaggcccuuaacaauagauuccagaucaaaggcguugaacugaagucuggauacaaagauuggauucucuggaucuccuuugcuauuagcugcuuccugcuuuguguggcccugcucggcuuuaucaugugggcgugccaaaaggggaacauccgcuguaauauuugcaucuga

SEQ ID NO: 195526 - RNA, 1701 nt, Artificial Sequence; identical to SEQ ID NO: 186435
  derived and/or modified sequence opt5 from hemagglutinin__InfluenzaA__AIF72906

SEQ ID NO: 195527 - RNA, 1701 nt, Artificial Sequence; identical to SEQ ID NO: 186435
  derived and/or modified sequence opt5 from hemagglutinin__InfluenzaA__AIF72907

SEQ ID NO: 195528 - RNA, 1701 nt, Artificial Sequence; identical to SEQ ID NO: 186435
  derived and/or modified sequence opt5 from hemagglutinin__InfluenzaA__AIF72908

SEQ ID NO: 195529 - RNA, 1701 nt, Artificial Sequence
  derived and/or modified sequence opt5 from hemagglutinin__InfluenzaA__AIF72909
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccgccggcgagaucugcgacgggccgcaccagauccuugauggagaaaauuguacacugauugacgcccuccugggcgauccccagugcgacggguuucaaaacaaaaagugggaucuguucgucgagagaucucgggcuuauagcaauuguuacccuuaugacgugcccgauuacgccucccuccgcucucugguugcuagcuccggaacccuugaauuuaacaaugagagcuucaacuggacgggcaccacacagaauggcaccucuuccgccugcaucagacggagcaacaauuccuuuuucucucgccugaacuggcucacacaucugaauuuuaaauauccugcgcuuaacgugaccaugcccaacaaugagcaguucgacaagcuguacauuuggggaguccaccauccugggacggauaaggaccagaucuuucucuaugcccaagcuagcggcagaauuacagugucuaccaaacggucccagcaggccguuaucccgaacauugggagccgccccagagugcggaauaucccuucccgcaucucuauuuacuggacaaucgucaagcccggagauauucugcugaucaacagcaccggcaaucucauugcuccuagaggguacuucaaaauccgguccggaaagagcucuaucaugcgcuccgacgcccccauuggcaaauguaacagcgaaugcaucaccccgaauggcucuauuccuaacgacaagcccuuucagaaugugaacagaaucacauauggggcguguccucgguacgugaagcaaagcacgcugaaacuugccaccggaaugcgcaauguccccgagaagcagacaagaggcauuuucggggcuaucgccggauuuaucgaaaacggcugggaggggaugguugauggaugguauggcuuccggcaccaaaauuccgagggcagagggcaggcugccgaccugaaaucuacccaggccgcuauugaucagaucaacggaaagcucaaucgccugauuggcaaaacaaacgaaaaguuccaccagaucgagaaagaauuuagcgagguggaagggcggauucaagaccuugagaaguacguggaggauaccaagaucgaccugugguccuauaacgcggaacuccuggucgcccuggagaaucagcauacgauugaucucacagacagcgaaaugaacaaacuguucgagaagaccaaaaagcagcuuagagaaaaugcugaggauaugggaaacggcugcuuuaaaaucuaccacaagugugacaaugccugcaucgggucuauucgcaacggcaccuaugaucaugacguguaccgggacgaggcccugaauaacagauuccagaucaagggaguugaacucaaauccggcuacaaggauuggauucuguggaucagcuuugcuauuucuugcuuccuucuguguguggcccuccugggguuuaucaugugggcgugccaaaaaggaaauauccgcuguaacauuugcaucuga

SEQ ID NO: 195530 - RNA, 1701 nt, Artificial Sequence; identical to SEQ ID NO: 186435
  derived and/or modified sequence opt5 from hemagglutinin__InfluenzaA__AIF72910

SEQ ID NO: 195531 - RNA, 1701 nt, Artificial Sequence; identical to SEQ ID NO: 186435
  derived and/or modified sequence opt5 from hemagglutinin__InfluenzaA__AIF72911

SEQ ID NO: 195532 - RNA, 1701 nt, Artificial Sequence; identical to SEQ ID NO: 195522
  derived and/or modified sequence opt5 from hemagglutinin__InfluenzaA__AIF72912

SEQ ID NO: 195533 - RNA, 1701 nt, Artificial Sequence; identical to SEQ ID NO: 186435
  derived and/or modified sequence opt5 from hemagglutinin__InfluenzaA__AIF72913

SEQ ID NO: 195534 - RNA, 1701 nt, Artificial Sequence
  derived and/or modified sequence opt5 from hemagglutinin__InfluenzaA__AIF72914
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaauuuuaaguauccugcccuuaacgucaccaugcccaacaaugagcaguucgacaagcuguacauuuggggcgugcaccauccugggacggauaaagaccagaucuuucucuaugcgcaagccucuggacgcauuacaguuuccaccaagagaagccagcaggcugugaucccgaacauuggcucccggccccgcgucagaaauaucccuucucggaucagcauuuacuggacaaucgugaaacccggggauauucugcugaucaacuccaccggaaaucucauugccccucgcggcuacuucaagaucagagggggaaaaagcucuaucaugcgguccgacgcucccauuggcaaguguaacagcgaaugcaucaccccgaauggcucuauuccuaacgacaagcccuuucagaaugugaaccgcaucacauauggggccuguccuagauacgucaaacaaaauacgcugaaacuugcgaccggaaugcggaacguucccgagaaacagacacgcggcauuuucggggccaucgcuggauuuaucgaaaauggcugggaggggaugguggauggaugguauggcuucagacaccagaacagcgagggccgggggcaagccgcugaccugaaguccacccaggccgccauugaucagaucaauggaaaacucaacagacugauuggcaagacaaacgaaaaauuccaccagaucgagaaggaauuuucugagguggaagggcgcauucaugaccuugagaaguacgucgaggauacccuguucgaccucuggguguauaauagcgaacugcugguugcucuccaaaaccagcacacgaucgaucugcccgacuccgagaugaauaaacuuuuugaaaagacaaagaagcagcugcgggagaacgcggaagauaugggaaauggcugcuucaaaauuuaccauaagugugacaacgccugcaucgggagcaucagaaauggcaccuaugaucacgacguguaccgcgacgaggcucucaacaaucgguuucagauuaagggagucgagcugaaaucuggcuacaaggauuggauccuuuggauuuccuucgccaucagcugcuuucugcucuguguggcccugcugggguucauuaugugggcuugccaaaaaggaaacaucagauguaauaucugcauuuga

SEQ ID NO: 195535 - RNA, 1701 nt, Artificial Sequence
  derived and/or modified sequence opt5 from hemagglutinin__InfluenzaA__AIF72915
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcuucagauccuggauggggaaaauuguacccucauugacgcccugcugggagauccccagugcgacggcuuucaaaacaaaaagugggaucucuucgucgagagaagcaaagccuauuccaauuguuacccuuaugacgugcccgauuacgcuucucugcggagccuuguugccuccagcgggacgcuggaauuuaacaaugagucuuucaacuggaccggagugacacagaauggcaccuccagcgcuugcauccgcagaucuaacaauuccuuuuucagccggcucaacuggcugacacaccuuaauuuuaaguauccugcccugaacgucaccaugcccaacaaugagcaguucgacaagcucuacauuuggggcgugcaucacccugggacggauaaagaccagaucuuucuguaugcgcaagccucuggacgcauuacaguuuccaccaagagaagccagcaggcugugaucccgaacauuggcucccggccccgcgucagaaauaucccuucucggaucagcauuuacuggacaaucgugaaacccggggauauucugcucaucaacuccaccggaaaucugauugccccucgcggcuacuucaagaucagaagcgggaaaucuuccaucaugcggagcaacgcucccauuggaaaguguaauucugaaugcaucaccccgaacggcagcauuccuaaugacaagcccuuucagaacgugaaucgcaucacauauggcgccuguccuagauacgucaaacaaaacacgcuuaagcuggcgaccgggaugcggaauguucccgagaaacagacacgcggaauuuucggcgccaucgcuggguuuaucgaaaacggaugggagggcaugguggacgggugguauggauucagacaucaaaauuccgagggccggggccaggccgcugaucucaagucuacccaggccgccauugaccagaucaacgggaaacugaacagacuuauuggaaagacaaaugaaaaauuccaccagaucgagaaggaauuuagcgagguggaaggccgcauucaagaucuggagaaguacgucgaggacaccaaaaucgaucucugguccuauaacgcugaacugcugguggcgcucgagaaucagcacacgauugaccugacagauagcgaaaugaacaaacuuuucgagaagaccaagaaacagcugcgggaaaaugccgaggacauggggaacggaugcuuuaagaucuaccauaagugugauaaugcuugcaucggcucuauuagaaacgggaccuaugaccacgauguuuaccgcgacgaggcccucaauaaccgguuccagaucaaaggcguggaacugaaguccggauacaaagacuggauucuuuggaucagcuuugccauuucuugcuuccugcucugugucgcucugcugggcuuuaucaugugggccugccaaaaggggaauaucagauguaacauuugcaucuga

SEQ ID NO: 195536 - RNA, 1701 nt, Artificial Sequence; identical to SEQ ID NO: 186435
  derived and/or modified sequence opt5 from hemagglutinin__InfluenzaA__AIF72916

SEQ ID NO: 195537 - RNA, 1701 nt, Artificial Sequence
  derived and/or modified sequence opt5 from hemagglutinin__InfluenzaA__AIF72917
augaagaccaucauugcccugagcuacauccucugccugguguucgcucagaaacuucccagaaacgacaauuccacagccacgcugugucucggccaccaugcggucccuaacgggaccauuguuaagacaaucaccaaugaucaaauugaggugacaaacgcuaccgaacuggugcagucuagcuccacaggagagaucugcgacucuccgcaccagauccuugauggcgaaaauuguacccugauugacgcccuccugggggauccccagugcgacggauuucaaaacaaaaagugggaucuguucgucgagcggagcaaagccuauuccaauuguuacccuuaugacgugcccgauuacgcuucucuccgcagccugguugccuccagcggcacgcuugaauuuaagaacgagucuuucaauuggaccggggugacacagaacggaaccuccagcgcuugcaucagacggucuaauaacuccuuuuucagccgccugaauuggcucacacaucugaacuuuaaguauccugcccuuaaugucaccaugcccaacaacgagcaguucgacaaacuguacauuuggggcgugcaccauccuggcacggauaaggaccagaucuuucucuaugcgcaagccucugggagaauuacaguuuccaccaaacggagccagcaggcugugaucccgaauauuggaucccgccccagaguccggaacaucccuucucgcaucagcauuuacuggacaaucgugaagcccggcgauauucugcugaucaauuccaccgggaaccucauugccccuagaggauacuucaaaauccggagcggcaagucuuccaucaugcgcagcgacgcucccauugggaaguguaauucugaaugcaucaccccgaacggaagcauuccuaaugacaaacccuuucagaacgugaauagaaucacauauggcgccuguccucgguacgucaagcaaaacacgcugaaacuugcgaccggcaugcgcaauguucccgagaagcagacaagagggauuuucggagccaucgcuggcuuuaucgaaaacgggugggagggaaugguggauggcugguauggguuccggcaccaaaauuccgagggaagaggccaggccgcugaccugaaaucuacccaggccgccauugaucagaucaacggcaagcucaaucgccugauugggaaaacaaacgaaaaguuccaccagaucgagaaggaauuuagcgagguggaaggacggauucaagaccuugagaaauacgucgaggauaccaagaucgaccugugguccuauaacgcugaacuccugguggcgcuggagaaucagcauacgauugaucucacagacagcgaaaugaacaaacuguucgagaagaccaaaaagcagcuuagagaaaaugccgaggauaugggcaacgggugcuuuaagaucuaccacaaaugugacaaugcuugcaucggaucuauucgcaacggcaccuaugaucaugacguuuaccgggacgaggcccugaauaacagauuccagaucaaggggguggaacucaaauccggcuacaaggauuggauucuguggaucagcuuugccauuucuugcuuccuucugugugucgcucuccugggauuuaucaugugggccugccaaaaaggcaauauccgcugugacauuugcaucuga

SEQ ID NO: 195538 - RNA, 1683 nt, Artificial Sequence
  derived and/or modified sequence opt5 from hemagglutinin__InfluenzaA__AIG44693
auggagaccgccagccugaucacaauucuccugguggucacgguuuccaacgcugacaagaucugcauuggcuaccagucuaccaauagcacagaaaccguggauacacuuaccgagaacaaugugcccgucacacacgccaaagaacugcuccauaccgagcacaacgggaugcugugugcgacgucccuuggacaaccucugauccucgauaccugcacaauugaaggccugaucuaugggaauccgucuugugaccugcuccugggaggcagagaguggagcuacaucguggagcggcccuccgcuguuaacgggcuuugcuauccuggaaauguggaaaaccuggaggaacuccgcucucuguucagcuccgccagaagcuaccagcggauucagaucuuucccgacaccauuuggaaugucucuuauuccggcacaagcaaggccuguucugauuccuucuaccgcagcaugagauggcuuacccagaaagacaacgcuuauccuauccaagaugcccaguacacgaauaaccaggagaagaauauucuguuuauguggggcaucaaccaucccccuacagacaccgcucagacaaaucucuacacccggaccgauacaacgaccucuguggccacagaggaaauuaaccgcaccuucaaaccgcugaucgggcccagaccucugguucacggacucaugggccggaucaacuauuacugguccgugcugaagcccgggcaaacacuucgcauuaagagcaauggaaaccugaucgcgccuugguauggccauauucucuccgggaaaucucacggaagaauccugaagaccgaccuuaaacggggcaauugcacgguccagugucagacagagaagggcgggcugaacaccacccuccccuuucagaaugugagcaaauacgccuucggaaacugcuccaaguauauuggcaucaagagccugaaacuggcuguggggcuccgcaaugucccgucuagauccagccggggacuguuuggcgccaucgcuggguucauugaaggaggcuggucuggccuuguugccgggugguacggauuucaacacagcaacgaucagggcguggggauggcggccgaccgcgauuccacacagaaggcuaucgacaaaauuaccucuaaggugaauaacaucgucgacaaaaugaauaagcaauaugagauuaucgaucaugaguucagcgaaguggagacaagacugaacaugaucaauaacaaaauugacgaucagauccaggacauuugggccuacaaugcugaacuccugguucuucuggagaaccagaagacgcucgaugaacacgacgccaacgugaauaaccuguacaauaaggucaaacgggcccugggauccaacgcuguggaggauggcaagggguguuuugaacucuaucauaaaugcgacgaucaauguauggagaccaucagaaauggcacauacaaccgccggaaguaucaggaggaaagcaaacuggagaagcagaagauugaaggaguuaaacuugagucugaaggcaccuacaagauccugacaauuuauuccaccguggcgagcucucucgucaucgccaugggguucgcugccuuucuguucugggccauguccaauggaagcugcagaugcaacaucuguauuuga

SEQ ID NO: 195539 - RNA, 1701 nt, Artificial Sequence; identical to SEQ ID NO: 190006
  derived and/or modified sequence opt5 from hemagglutinin__InfluenzaA__AIJ10728

SEQ ID NO: 195540 - RNA, 1701 nt, Artificial Sequence
  derived and/or modified sequence opt5 from hemagglutinin__InfluenzaA__AIJ10729
augaagaccaucauugcccugagcuacauccucugccugguguucgcucagaaacuucccggccacgacaacuccacagccacgcugugucucgggcaucacgcggucccuaauggaaccauuguuaagacaaucaccaacgaucaaauugaggugacaaaugcuaccgaacuggugcagucuagcuccacaggcgagaucugcaacucuccgcaucagauccuugacggggaaaauuguacccugauugaugcccuccugggagacccccagugcgauggcuuucaaaacaaaaagugggaccuguucgucgagagaagcaaagcccacuccaauuguuauccuuacgaugugcccgacuaugcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaauuuuaaguacccugcccuuaacgucaccaugcccaacaaugagcaguucgauaagcuguauauuuggggcgugcaccacccugggacggacaaagaucagaucuuucucuacgcgcaagccucuggacgcauuacaguuuccaccaagagaagccagcaggcugugaucccgaacauuggcucccggccccgcgucagaaauaucccuucucgggugagcaucuauuggacaauugugaaacccggggacauccugcugauuaacuccaccggaaaucucaucgccccucgcggcuacuucaagauuagaagcgggaaaucuuccaucaugcggagcgaugcucccaucggaaaguguaacucugccugcauuaccccgaauggcagcaucccuaacgacaagcccuuucagaaugucaaccgcauuacauacggcgcguguccuagauauguuaaacaaaauacgcugaaacuugccaccgggaugcggaacgugcccgaaaagcagacaaagggaaucuucggcgcuauugccggguuuaucgagaauggaugggaaggcaugguggacgggugguacggauuccgccaucagaacuccgagggcagaggccaagcugccgaucugaaaucuacccaggccgcuaucgaccagauuaaugggaagcucaaccggcugaucggaaaaacaaacgagaaguuccaccagauugaaaaggaguuuagcgaagucgagggcagaauccaagaucuugaaaaauauguggaggacaccaagauugaucugugguccuacaaugcggagcuccugguugcccuggaaaaccagcauacgaucgaccucacagauagcgagaugaauaaacuguucgaaaagaccaaaaagcagcuucgcgagaacgcugaagacauggggaauggaugcuuuaagauuuaucacaaaugugauaacgccugcaucggcucuauccggaaugggaccuacgaccacgauguguauagagacgaggcccugaacaaucgcuuccagauuaagggcgucgagcucaaauccggauacaaggacuggauccuguggauuagcuuugcuaucucuugcuuccuucuguguguggcccuccugggcuuuauuaugugggcgugccaaaaagggaacauccgguguaauaucugcauuuga

SEQ ID NO: 195541 - RNA, 1701 nt, Artificial Sequence; identical to SEQ ID NO: 190006
  derived and/or modified sequence opt5 from hemagglutinin__InfluenzaA__AIJ10730

SEQ ID NO: 195542 - RNA, 1701 nt, Artificial Sequence; identical to SEQ ID NO: 190006
  derived and/or modified sequence opt5 from hemagglutinin__InfluenzaA__AIJ10731

SEQ ID NO: 195543 - RNA, 1701 nt, Artificial Sequence
  derived and/or modified sequence opt5 from hemagglutinin__InfluenzaA__AIJ10732
augaagaccaucauugcccugagcuacauccucugccugguguucgcucaggagcuucccggcaacgacaauuccacagccacgcugugucucgggcaccaugcggucccuaacggaaccauuguuaaaacaaucaccaaugaucaaauugaagugacaaacgcuaccgagcuggugcagucuagcuccacaggcgaaaucugcaauucuccgcaccagauccuugacggggagaacuguacccugauugaugcccuccugggagacccccagugcgauggcuuucaaaauaagaaaugggaccuguucgucgaaagaagcaaggcccauuccaacuguuauccuuacgaugugcccgacuaugcuucucuccggagccugguugccuccagcgggacgcuugaguuuaauaacgagucuuucaauuggaccggagugacacagaacggcaccuccagcgcuugcauccgcagaucuaauaacuccuuuuucagccggcugaauuggcucacacaccugaacuuucgcuacccugcccuuaacgucaccaugcccaauaacgaacaguucgauaaacuguauauuuggggcgugcaucacccugggacggacaaggaucagaucuuucucuacgcgcaagccucuggaagaauuacaguuuccaccaagcggagccagcaggcugugaucccgaauauuggcucccgccccagaguccggaacaucccuucucgcgugagcaucuauuggacaauugugaaacccggggacauccugcugauuaauuccaccggaaaccucaucgccccuagaggcuacuucaagauucggagcgggaaaucuuccaucaugcgcagcgaugcucccaucggaaaguguaauucugccugcauuaccccgaacggcagcaucccuaaugacaaacccuuucagaacgucaauagaauuacauacggcgcguguccucgguauguuaagcaaaacacgcugaaacuugccaccgggaugcgcaaugugcccgagaagcagacaagaggaaucuucggcgcuauugccggguuuaucgaaaacggaugggagggcaugguggacgggugguacggauuccggcaccaaaauuccgagggcagaggccaggcugccgaucugaagucuacccaggccgcuaucgaccagauuaacgggaaacucaaccgccugaucggaaagacaaaugaaaaauuccaucagauugagaaggaauuuagcgaggucgaaggccggauccaagaucuugagaaauauguggaggacaccaagauugaucugugguccuacaacgcggaacuccugguugcccuggagaaucagcacacgaucgaccucacagauagcgaaaugaacaagcuguucgagaaaaccaagaaacagcuuagagaaaaugcugaggacauggggaacggaugcuuuaagauuuaucauaaaugugauaaugccugcaucggcucuauccgcaacgggaccuacgaccacgauguguaucgggacgaggcccugaauaacagauuccagauuaagggcgucgaacucaaguccggauacaaagacuggauccuguggauuagcuuugcuaucucuugcuuccuucuguguguggcccuccugggcuuuauuaugugggcgugccaaaaggggaauauccgcuguaacaucugcauuuga

SEQ ID NO: 195544 - RNA, 1701 nt, Artificial Sequence
  derived and/or modified sequence opt5 from hemagglutinin__InfluenzaA__AIJ10733
augaagaccaucauugcccugagcuacauccucugccugguguucgcucaggagcuucccggcaacgacaauuccacagccacgcugugucucgggcaccaugcggucccuaacggaaccauuguuaaaacaaucaccaaugaucaaauugaagugacaaacgcuaccgagcuggugcagucuagcuccacaggcgaaaucugcaauucuccgcaccagauccuugacggggagaacuguacccugauugaugcccuccugggagacccccagugcgauggcuuucaaaauaagaaaugggaccuguucgucgaaagaagcaaggcccauuccaacuguuauccuuacgaugugcccgacuaugcuucucuccggagccugguugccuccagcgggacgcuugaguuuaauaacgagucuuucaauuggaccggagugacacagaacggcaccuccagcgcuugcauccgcagaucuaauaacuccuuuuucagccggcugaauuggcucacacaccugaacuuucgcuacccugcccuuaacgucaccaugcccaauaacgaacaguucgauaaacuguauauuuggggcgugcaucacccugggacggacaaggaucagaucuuucucuacgcgcaagccucuggaagaauuacaguuuccaccaagcggagccagcaggcugugaucccgaauauuggcucccgccccagaguccggaacaucccuucucgcgugagcaucuauuggacaauugugaaacccggggacauccugcugauuaauuccaccggaaaccucaucgccccuagaggcuacuucaagauucggagcgggaaaucuuccaucaugcgcagcgaugcucccaucggaaaguguaaaucugccugcauuaccccgaauggcagcaucccuaacgacaagcccuuucagaaugucaacagaauuacauacggcgcguguccucgguauguuaagcaaaauacgcugaaacuugccaccgggaugcgcaacgugcccgagaagcagacaagaggaaucuucggcgcuauugccggguuuaucgaaaauggaugggagggcaugguggacgggugguacggauuccggcaccagaacuccgagggcagaggccaagcugccgaucugaaaucuacccaggccgcuaucgaccagauuaaugggaagcucaaccgccugaucggaaaaacaaacgaaaaguuccaucagauugagaaagaauuuagcgaggucgaaggccggauccaagaucuugagaaguauguggaggacaccaagauugaucugugguccuacaaugcggaacuccugguugcccuggagaaccagcacacgaucgaccucacagauagcgaaaugaauaaacuguucgagaagaccaaaaagcagcuuagagaaaacgcugaggacauggggaauggaugcuuuaaaauuuaucauaagugugauaacgccugcaucggcucuauccgcaaugggaccuacgaccacgauguguaucgggacgaggcccugaacaauagauuccagauuaagggcgucgaacucaaauccggauacaaggacuggauccuguggauuagcuuugcuaucucuugcuuccuucuguguguggcccuccugggcuuuauuaugugggcgugccaaaaagggaacauccgcuguaauaucugcauuuga

SEQ ID NO: 195545 - RNA, 1701 nt, Artificial Sequence
  derived and/or modified sequence opt5 from hemagglutinin__InfluenzaA__AIJ10734
augaagaccaucauugcccugagcuacauccucugccugguguucgcucagaaacuucccgagaacgacaauuccacagccacgcugugucucggccaccaugcggucccuaacgggaccauuguuaagacaaucaccaaugaucaaauugaagugacaaacgcuaccgagcuggugcagucuagcuccacaggagaaaucugcaauucuccgcaccagauccuugacggcgagaacuguacccugauugaugcccuccugggggacccccagugcgauggauuucaaaauaaaaagugggaccuguucgucgaaagaagcaaagcccauuccaacuguuauccuuacgaugugcccgacuaugcuucucuccggagccugguugccuccagcggcacgcuugaguuuaauaacgagucuuucaauuggaccggggugacacagaacggaaccuccagcgcuugcauccgcagaucuaauaacuccuuuuucagccggcugaauuggcucacacaccugaacuuuaaguacccugcccuuaacgucaccaugcccaauaacgaacaguucgauaagcuguauauuuggggcgugcaucacccuggcacggacaaagaucagaucuuucucuacgcgcaagccucugggcgcauuacaguuuccaccaagagaagccagcaggcugugaucccgaauauuggaucccggccccgcgucagaaacaucccuucucggaucagcauuuauuggacaaucgugaaacccggcgacauucugcugaucaauuccaccgggaaccucauugccccucgcggauacuucaagaucagaagcggcaaaucuuccaucaugcggagcgaugcucccauugggaaguguaauucuaccugcaucacaccgaacggaagcauuccuaaugacaagcccuuucagaacgugaaucgcaucacguacggcgccuguccuagauaugucaaacaaaacacccugaaacuugcgacaggcaugcggaauguucccgagaagcagacccgcgggauuuucggagccaucgcuggcuuuaucgaaaacgggugggagggaaugguggacggcugguacggguucagacaccaaaauuccgagggacggggccaggccgcugaucugaagucuacacaggccgccauugaccagaucaacggcaaacucaacagacugauugggaagaccaaugaaaaauuccaucagaucgagaaggaauuuagcgagguggaaggacgcauucaagaucuugagaaguaugucgaggacacgaaaaucgaucugugguccuacaacgcugaacuccugguggcgcuggagaaucagcacacaauugaccucaccgauagcgaaaugaacaagcuguucgagaaaaccaagaaacagcuucgggaaaaugccgaggacaugggcaacgggugcuuuaagaucuaucauaagugugauaaugcuugcaucggaucuauuagaaacggcacauacgaccacgauguuuaucgcgacgaggcccugaauaaccgguuccagaucaaagggguggaacucaaguccggcuacaaagacuggauucuguggaucagcuuugccauuucuugcuuccuucugugugucgcucuccugggauuuaucaugugggccugccaaaagggcaauaucagauguaacauuugcaucuga

SEQ ID NO: 195546 - RNA, 1701 nt, Artificial Sequence
  derived and/or modified sequence opt5 from hemagglutinin__InfluenzaA__AIJ10735
augaagaccaucauugcccugagcuacauccucugccugauuuucgcucagaaacuucccgagaacgacaauuccacagccacgcugugucucggccaccaugcggugccuaacgggaccaucgucaagacaauuaccaaugaucaaaucgaaguuacaaacgcuaccgagcuggugcagucuagcuccacaggagaaaucugcaauucuccgcaccagauucuugacggcgagaacuguacccugaucgaugcccuccugggggacccccagugcgauggauuucaaaauaaaaagugggaccuguucguggaaagaagcaaagcccauuccaacuguuauccuuacgauguccccgacuaugcuucucuccggagccugguggccuccagcggcacgcuugaguuuaauaacgagucuuucaauuggaccgggguuacacagaacggaaccuccagcgcuugcauucgcagaucuaauaacuccuuuuucagccggcugaauuggcucacacaccugaacuuuaaguacccugcccuuaacgugaccaugcccaauaacgaacaguucgauaagcuguauaucuggggcguccaucacccuggcacggacaaagaucagauuuuucucuacgcgcaagccucugggcgcaucacaguguccaccaagagaagccagcaggcuguuauuccgaauaucggaucccggccccgcgugagaaacaucccuucucgggucagcauuuauuggacaaucgugaaacccggcgacauucugcugaucaauuccaccgggaaccucauugccccucgcggauacuucaagaucagaagcggcaaaucuuccaucaugcggagcgaugcucccauugggaaguguaauucuaccugcaucacaccgaacggaagcauuccuaaugacaagcccuuucagaacgugaaucgcaucacguacggcgccuguccuagauaugucaaacaaaacacccugaaacuugcgacaggcaugcggaauguucccgagaagcagacccgcgggauuuucggagccaucgcuggcuuuaucgaaaacgggugggagggaaugguggacggcugguacggguucagacaccaaaauuccgagggaaagggccaggccgcugaucugaaaucuacacaggccgccauugaccagaucaacggcaagcucaaccggcugauugggaaaaccaaugaaaaguuccaucagaucgagaaggaauuuagcgagguggaaggacgcauucaagaucuugagaaauaugucgaggacacgaagaucgaucugugguccuacaacgcugaacuccugguggcgcuggagaaucagcacacaauugaccucaccgauagcgaaaugaacaaacuguucgagaagaccaaaaagcagcuuagagaaaaugccgaggacaugggcaacgggugcuuuaagaucuaucauaaaugugauaaugcuugcaucggaucuauucggaacggcacauacgaccacgauguuuauagagacgaggcccugaauaaccgcuuccagaucaaggggguggaacucaaauccggcuacaaggacuggauucuguggaucagcuuugccauuucuugcuuccuucugugugucgcucuccugggauuuaucaugugggccugccaaaaaggcaauauccgguguaacauuugcaucuga

SEQ ID NO: 195547 - RNA, 1701 nt, Artificial Sequence
  derived and/or modified sequence opt5 from hemagglutinin__InfluenzaA__AIJ10736
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuacaaucggcgagaucugcgacagcccgcaccagauucuugauggggaaaacuguacccugaucgacgcccuccugggagauccccagugcgacggcuuucagaauaaaaagugggaucuguucgucgagcgguccaaagccuauucuaacuguuacccuuaugacgugcccgauuacgcuagccuccgcucccugguugccucuagcgggacgcuugaauuuaauaacgaguccuucaauuggaccggagugacacaaaacggcaccagcucugcuugcauuagacgguccaauaacagcuuuuucucucgccugaauuggcucacacaucugaacuuuaaguauccugcccuuaacgucaccaugcccaauaacgagcaguucgacaagcuguacaucuggggcgugcaccauccugggacggauaaagaccagauuuuucucuaugcgcaguccagcggaagaaucacaguuucuaccaagcggucccaacaggccgugauuccgaauaucggcagccgccccagaauccggaacauuccuucccgcaucucuauuuacuggacaaucgucaaacccggggauauucugcugaucaauagcaccggaaaccucaucgcuccuagaggcuacuucaagauucgguccgggaaaagcucuaucaugcgcuccgacgcccccauuggaaaguguaagagcgaaugcaucaccccgaauggcucuauuccuaacgacaaacccuuucagaaugugaacagaaucacauauggcgcuuguccucgguacgugaagcagagcacgcugaaacuugccaccgggaugcgcaauguccccgagaagcaaacaagaggaaucuucggcgcgauugccggguuuaucgaaaacggaugggagggcaugguugaugggugguauggauuccggcaccaaaauuccgagggcagaggccaggcugccgaccugaaaucuacccaggcugccauugaucagaucaacgggaagcucaaucgccugauuggaaaaacaaacgaaaaguuccaccagaucgagaaggaauuuagcgagguggaaggccggauucaggaccuugagaaauacguggaggauaccaagaucgaccugugguccuauaacgccgaacuccuggucgcucuggagaaucaacauacgaucgaucucacagacagcgaaaugaacaaacuguucgagaagaccaaaaagcagcuuagagaaaaugcggaggauauggggaacggaugcuuuaagauuuaccacaaaugugacaaugccugcaucggcucuauucgcaacgggaccuaugaucaugacguguaccgggacgaggcucugaauaacagauuccagaucaagggcguugaacucaaauccggauacaaggauuggauucuguggaucagcuuugccaucucuugcuuccuucuguguguggcccuccugggcuuuauuaugugggcuugccagaaagggaauauccgcuguaacauuugcaucuga

SEQ ID NO: 195548 - RNA, 1701 nt, Artificial Sequence
  derived and/or modified sequence opt5 from hemagglutinin__InfluenzaA__AIJ10737
augaagaccaucauugcccugagcuacauccucugccugguggucgcucagaaacuucccggcaacgacaauuccacagccacgcugugucucgggcaccaugcgguuccuaacggaaccauugugaagacaaucaccaaugauagaauugaggugacaaacgcuaccgaacugguccaaaauucuagcaucggcgagaucugcgacuccccgcaccagauucuugauggggaaaacuguacacugaucgacgcccuccugggagauccccagugcgacggcuuccagaauaaaaagugggaucuguuuguggagcggucuaaagccuauagcaacuguuacccuuaugacguucccgauuacgcuucccuccgcucucugguggccagcuccgggacccuugaauuuaauaacgagagcuucaauuggacgggagucacccaaaacggcacaucuuccgcuugcauuagacggagcaauaacucuuucuuuucccgccugaauuggcucacccaucugaacuucaaguauccugcccuuaacgugacaaugcccaauaacgagcaguuugacaagcuguacaucuggggcguucaccauccugggaccgauaaagaccagauuuuccucuaugcgcagagcucuggaagaaucacgguguccacaaagcggagccaacaggccgucauuccgaauaucggcucccgccccagaauccggaacauuccuucucgcaucagcauuuacuggaccaucgugaaacccggggauauucugcugaucaauuccacaggaaaccucaucgcuccuagaggcuacuuuaagauucggagcgggaaaucuuccaucaugcgcagcgacgcccccauuggaaaguguaagucugaaugcaucaccccgaauggcagcauuccuaacgacaaacccuuccagaaugugaacagaaucaccuauggcgcuuguccucgguacgucaagcaguccacacugaaacuugccacggggaugcgcaauguucccgagaagcaaaccagaggaaucuuuggcgcgauugccggguucaucgaaaacggaugggagggcaugguggaugggugguauggauuucggcaccaaaauucugagggcagaggccaggcugccgaccugaaaagcacacaggcugccauugaucagaucaacgggaagcucaaucgccugauuggaaaaaccaacgaaaaguuccaccagaucgagaaggaguucuccgaaguggaaggccggauucaggaccuugagaaauacgucgaggauacaaagaucgaccuguggagcuauaacgccgaacuccugguggcucuggagaaucaacauaccaucgaucucacggacucugaaaugaacaaacuguuugagaagaccaaaaagcagcuuagagaaaaugcggaggauauggggaacggaugcuucaagauuuaccacaaaugugacaaugccugcaucggcuccauucgcaacgggacauaugaucaugacguuuaccgggacgaggcucugaauaacagauuucagaucaagggcguggaacucaaaagcggauacaaggauuggauucuguggaucucuuucgccaucuccugcuuucuucugugugucgcccuccugggcuucauuaugugggcuugccagaaagggaauauccgcuguaacauuugcaucuga

SEQ ID NO: 195549 - RNA, 1701 nt, Artificial Sequence
  derived and/or modified sequence opt5 from hemagglutinin__InfluenzaA__AIJ10738
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauaacuccuuuuucucucgccugaauuggcucacccaucugaacuuuaaguauccugcccuuaacgucacaaugcccaauaacgagcacuucgacaagcuguacaucuggggcgugcaucacccugggaccgauaaagaccagauuuuucucuaugcgcagagcucuggaagaaucacgguuuccacaaagcggagccagcaagccgugauuccgaauaucggcucccgccccagaauccggaacauuccuucucgcaucagcauuuacuggaccaucgucaaacccggggauauucugcugaucaauuccacaggaaaccucaucgcuccuagaggcuacuucaagauucggagcgggaaaucuuccaucaugcgcagcgacgcccccauuggaaaguguaagucugaaugcaucaccccgaauggcagcauuccuaacgacaaacccuuucagaaugugaacagaaucaccuauggcgcuuguccucgguacgugaagcaguccacacugaaacuugccacggggaugcgcaauguccccgagaagcagaccagaggaaucuucggcgcgauugccggguuuaucgaaaacggaugggagggcaugguugaugggugguauggauuccggcaccaaaauucugagggcagaggccaggcugccgaccugaaaagcacacaggcugccauugaucaaaucaacgggaagcucaaucgccugauuggaaaaaccaacgaaaaguuccaucagaucgagaaggaauuuuccgagguggaaggccggauucaggaccuugagaaauacguggaggauacaaagaucgaccuguggagcuauaacgccgaacuccuggucgcucuggagaaucagcacaccaucgaucucacggacucugaaaugaacaaacuguucgagaagaccaaaaagcaacuuagagaaaaugcggaggauauggggaacggaugcuuuaagauuuaccauaaaugugacaaugccugcaucggcuccauucgcaacgggacauaugaucacgacguguaccgggacgaggcucugaauaacagauuccagaucaagggcguugaacucaaaagcggauacaaggauuggauucuguggaucucuuuugccaucuccugcuuccuucuguguguggcccuccugggcuuuauuaugugggcuugccagaaagggaauauccgcuguaacauuugcaucuga

SEQ ID NO: 195550 - RNA, 1701 nt, Artificial Sequence; identical to SEQ ID NO: 192477
  derived and/or modified sequence opt5 from hemagglutinin__InfluenzaA__AIJ10740

SEQ ID NO: 195551 - RNA, 1701 nt, Artificial Sequence; identical to SEQ ID NO: 192477
  derived and/or modified sequence opt5 from hemagglutinin__InfluenzaA__AIJ10741

SEQ ID NO: 195552 - RNA, 1701 nt, Artificial Sequence
  derived and/or modified sequence opt5 from hemagglutinin__InfluenzaA__AIJ10742
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauaacuccuuuuucucucgccugaauuggcucacccaucugaacuuuaaguauccugcccuuaacgucacaaugcccaauaacgagcaguucgacaagcuguacaucuggggcgugcaccauccugggaccgauaaagaccagauuuuucucuaugcgcagagcucuggaagaaucacgguugccacaaagcggucccaacaggcugugauuccgaauaucggcagccgccccagaauccggaacauuccuucccgcaucucuauuuacuggaccaucgucaaacccggggauauucugcugaucaauagcacaggaaaccucaucgccccuagaggcuacuucaagauucgguccgggaaaagcucuaucaugcgcuccgacgcucccauuggaaaguguaagagcgaaugcaucaccccgaauggcucuauuccuaacgacaaacccuuucagaaugugaacagaaucaccuauggcgccuguccucgguacgugaagcagagcacacugaaacuugcgacggggaugcgcaauguccccgagaagcaaaccagaggaaucuucggcgccauugcuggguuuaucgaaaacggaugggagggcaugguugaugggugguauggauuccggcaccaaaauuccgagggcagaggccaggccgcugaccugaaaucuacacaggccgccauugaucagaucaacgggaagcucaaucgccugauuggaaaaaccaacgaaaaguuccaccagaucgagaaggaauuuagcgagguggaaggccggauucaggaccuugagaaauacguggaggauacaaagaucgaccugugguccuauaacgcugaacuccuggucgcgcuggagaaucaacauaccaucgaucucacggacagcgaaaugaacaaacuguucgagaagaccaaaaagcagcuuagagaaaaugccgaggauauggggaacggaugcuuuaagauuuaccacaaaugugacaaugcuugcaucggcucuauucgcaacgggacauaugaucaugacguguaccgggacgaggcccugaauaacagauuccagaucaagggcguugaacucaaauccggauacaaggauuggauucuguggaucagcuuugccaucucuugcuuccuucuguguguggcucuccugggcuuuauuaugugggccugccagaaagggaauauccgcuguaacauuugcaucuga

SEQ ID NO: 195553 - RNA, 1701 nt, Artificial Sequence
  derived and/or modified sequence opt5 from hemagglutinin__InfluenzaA__AIJ10743
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauaacuccuuuuucucucgccugaauuggcucacccaucugaacuuuaaguauccugcccuuaacgucacaaugcccaauaacgagcaguucgacaagcuguacaucuggggcgugcaccauccugggaccgauaaagaccagauuuuucucuaugcgcagagcucuggaagaaucacgguuuccacaaagcggagccaacaggccgugauuccgaauaucggcucccgccccagaauccggaacauuccuucucgcaucagcauuuacuggaccaucgucaaacccggggauauucugcugaucaauuccacaggaaaccucaucgcuccuagaggcuacuucaagauucggagcgggaaaucuuccaucaugcgcagcgacgcccccauuggaaaguguaagucugaaugcaucaccccgaauggcagcauuccuaacgacaaacccuuucagaaugugaacagaaucaccuauggcgcuuguccucgguacgugaagcaguccacacugaaacuugccacggggaugcgcaauguccccgagaagcaaaccagaggaaucuucggcgcgauugccggguuuaucgaaaacggaugggagggcaugguugaugggugguauggauuccggcaccaaaauucugagggcagaggccaggcugccgaccugaaaagcacacaggcugccauugaucagaucaacgggaagcucaaucgccugauuggaaaaaccaacgaaaaguuccaccagaucgagaaggaauuuuccgagguggaaggccggauucaggaccuugagaaauacguggaggauaucaagaucgaccuguggagcuauaacgccgaacuccuggucgcucuggagaaucaacauacaauugaucucaccgacucugaaaugaacaaacuguucgagaagacgaaaaagcagcuuagagaaaaugcggaggauauggggaacggaugcuuuaagaucuaccacaaaugugacaaugccugcauuggcuccauccgcaacgggacauaugaucaugacguguaccgggacgaggcucugaauaacagauuccagauuaagggcguugaacucaaaagcggauacaaggauuggauccuguggaucucuuuugccauuuccugcuuccuucuguguguggcccuccugggcuuuaucaugugggcuugccagaaagggaauauucgcuguaacaucugcauuuga

SEQ ID NO: 195554 - RNA, 1701 nt, Artificial Sequence
  derived and/or modified sequence opt5 from hemagglutinin__InfluenzaA__AIJ10744
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauaacuccuuuuucucucgccugaauuggcucacccaucugaacuuuaaguauccugcccuuaacgucacaaugcccaauaacgagcaguucgacaagcuguacaucuggggcgugcaccauccugggaccgauaaagaccagauuuuucucuaugcgcagagcucuggaagaaucacgguuuccacaaagcggagccaacaggccgugauuccgaauaucggcucccgccccagaauccggaacauuccuucucgcaucagcauuuacuggaccaucgucaaacccggggauauucugcugaucaauuccacaggaaaccucaucgcuccuagaggcuacuucaagauucggagcgggaaaucuuccaucaugcgcagcgacgcccccauuggaaaguguaagucugaaugcaucaccccgaauggcagcauuccuaacgacaaacccuuucagaaugugaacagaaucaccuauggcgcuuguccucgguacgugaagcagcgcacacugaaacuugccacggggaugagaaauguccccgagaagcaaacccggggaaucuucggcgcgauugccggguuuaucgaaaacggaugggagggcaugguugaugggugguauggauucagacaccaaaauuccgagggccgcggccaggcugccgaccugaaaucuacacaggcugccauugaucagaucaacgggaagcucaaucggcugauuggaaaaaccaacgaaaaguuccaccagaucgagaaggaauuuagcgagguggaaggccgcauucaggaccuugagaaauacguggaggauacaaagaucgaccugugguccuauaacgccgaacuccuggucgcucuggagaaucaacauaccaucgaucucacggacagcgaaaugaacaaacuguucgagaagaccaaaaagcagcuuagagaaaaugcggaggauauggggaacggaugcuuuaagauuuaccacaaaugugacaaugccugcaucggcucuauucggaacgggacauaugaucaugacguguacagagacgaggcucugaauaaccgcuuccagaucaagggcguugaacucaaauccggauacaaggauuggauucuguggaucagcuuugccaucucuugcuuccuucuguguguggcccuccugggcuuuauuaugugggcuugccagaaagggaauauccgguguaacauuugcaucuga

SEQ ID NO: 195555 - RNA, 1701 nt, Artificial Sequence; identical to SEQ ID NO: 193018
  derived and/or modified sequence opt5 from hemagglutinin__InfluenzaA__AIJ10745

SEQ ID NO: 195556 - RNA, 1701 nt, Artificial Sequence
  derived and/or modified sequence opt5 from hemagglutinin__InfluenzaA__AIJ10747
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacgauuuucagaauaaaaagugggaccuguucgucgagcggucuaaagccuauagcaacuguuacccuuaugaugugcccgacuacgcuucccuccgcucucugguugccagcuccggcacccuugaauuuaauaacgagaauuucaacuggacgggggugacccaaaauggaacaagcucugcuugcauuagacgguccaacaauagcuuuuucucucgccugaacuggcucacccaucugaacuuuaaguauccugcccuuaaugucacaaugcccaacaaugagcaguucgauaagcuguacaucuggggcgugcaccauccuggcaccgacaaagaucagauuuuucucuaugcgcaguccagcgggagaaucacgguuucuacaaagcggucccaacaggccgugauuccgaacaucggaagccgccccagaauccggaauauuccuucccgcaucucuauuuacuggaccaucgucaaacccggcgacauucugcugaucaacagcacagggaaucucaucgcuccuagaggauacuucaagauucgguccggcaaaagcucuaucaugcgcuccgacgcccccauugggaaguguaagagcgaaugcaucaccccgaacggaucuauuccuaaugauaaacccuuucagaacgugaauagaaucaccuauggcgcuuguccucgguacgugaagcagagcacacugaaacuugccacgggcaugcgcaacguccccgagaagcaaaccagagggaucuucggagcgauugccggcuuuaucgaaaaugggugggagggaaugguugacggcugguauggguuccggcaccagaacuccgagggaagaggccaggcugccgaucugaaaucuacacaagcugccauugaccagaucaauggcaagcucaaccgccugauugggaaaaccaacgaaaaguuccaccagaucgagaaggaauuuagcgagguggaaggacggauucaggaucuugagaaauacguggaggacacaaagaucgaucugugguccuauaaugccgaacuccuggucgcucuggagaaccaacauaccaucgaccucacggauagcgaaaugaauaaacuguucgagaagaccaaaaagcagcuuagagaaaacgcggaggacaugggcaaugggugcuuuaagauuuaccacaaaugugauaacgccugcaucggaucuauucgcaauggcacauaugaccaugacguguaccgggaugaggcucugaacaauagauuccagaucaaggggguugaacucaaauccggcuacaaggacuggauucuguggaucagcuuugccaucucuugcuuccuucuguguguggcccuccugggauuuauuaugugggcuugccagaaaggcaacauccgcuguaauauuugcaucuga

SEQ ID NO: 195557 - RNA, 1701 nt, Artificial Sequence; identical to SEQ ID NO: 195556
  derived and/or modified sequence opt5 from hemagglutinin__InfluenzaA__AIJ10748

SEQ ID NO: 195558 - RNA, 1701 nt, Artificial Sequence
  derived and/or modified sequence opt5 from hemagglutinin__InfluenzaA__AIJ10750
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucauucgcucugacgcccccaucggaaaguguaagagcgaaugcauuaccccgaacggcuccaucccuaaugacaaacccuuucagaacgugaauagaaucaccuauggcgcuuguccucgguacgugaagcagucuacacugaaacuugccacggggaugcgcaacguccccgagaagcaaaccagaggaauuuucggcgcgaucgccggguuuauugaaaauggaugggagggcaugguugaugggugguauggauuccggcaccagaacagcgagggcagaggccaggcugccgaccugaaauccacacaagcugccaucgaucagauuaaugggaagcucaaccgccugaucggaaaaaccaaugaaaaguuccaccagauugagaaggaauuuagcgagguggaaggccggauccaggaccuugagaaauacguggaggauacaaagaucgaccuguggucuuauaacgccgaacuccuggucgcucuggagaaccaacauaccauugaucucacggacuccgaaaugaauaaacuguucgagaagaccaaaaagcagcuuagagaaaacgcggaggauauggggaauggaugcuuuaagaucuaccacaaaugugacaacgccugcauuggcagcauccgcaaugggacauaugaucauaacguguaccgggacgaggcucugaauaacagauuccagauuaagggcguugaacucaaaucuggauacaaggacuggauccuguggaucuccuuugccauuagcugcuuccuucuguguguggcccuccugggcuuuaucaugugggcuugccagaaagggaauauucgcuguaacaucugcauuuga

SEQ ID NO: 195559 - RNA, 1701 nt, Artificial Sequence
  derived and/or modified sequence opt5 from hemagglutinin__InfluenzaA__AIJ10752
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagucuacacugaaacuugccacggggaugcgcaacguccccgagaagcaaaccagaggaaucuucggcgcgauugccggguuuaucgaaaauggaugggagggcaugguugaugggugguauggauuccggcaccagaacagcgagggcagaggccaggcugccgaccugaaauccacacaagcugccauugaucagaucaaugggaagcucaaccgccugauuggaaaaaccaaugaaaaguuccaccagaucgagaaggaauuuagcgagguggaaggccggauucaggaccuugagaaauacguggaggauacaaagaucgaccuguggucuuauaacgccgaacuccuggucgcucuggagaaccaacauaccaucgaucucacggacuccgaaaugaauaaacuguucgagaagaccaaaaagcagcuuagagaaaacgcggaggauauggggaauggaugcuuuaagauuuaccacaaaugugacaacgccugcaucggcagcauucgcaaugggacauaugaucaugacguguaccgggacgaggcucugaacaauagauuccagaucaagggcguugaacucaaaucuggauacaaggauuggauucuguggaucuccuuugccaugagcugcuuccuucuguguguggcccuccugggcuuuaucaugugggcuugccagaaagggaacauucgcuguaauaucugcauuuga

SEQ ID NO: 195560 - RNA, 1701 nt, Artificial Sequence
  derived and/or modified sequence opt5 from hemagglutinin__InfluenzaA__AIJ10753
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccagcugcauuagaggcucuaauaacuccuuuuucagccggcugaauuggcucacacaucugaacuuuaaguauccugcccuuaacgucaccaugcccaauaacgagcaguucgacaagcuguacaucuggggagugcaccauccugggacagauaaagaccagauuuuucucuaugcgcagucuuccggccgcaucaccguuagcacgaagagaucccaacaggccgugauuccgaauaucgggucucggccccgcaucagaaacauuccuagccggaucuccauuuacuggacaaucgucaaacccggagauauucugcugaucaauagcaccggcaaccucaucgcuccucgcggguacuucaagauuagaucuggaaaauccagcaucaugcggucugacgcccccauuggcaaguguaagagcgaaugcaucacaccgaauggcuccauuccuaacgacaaacccuuucagaaugugaaccgcaucaccuauggggcuuguccuagauacgugaagcagucuacccugaaacuugccacaggaaugcggaauguccccgagaagcaaacgcgcggcaucuucggggcgauugccggauuuaucgaaaacggcugggaggggaugauggauggaugguauggcuucagacaccagaauagcgagggccgggggcaggcugccgaccugaaauccacccaagcugccauugaucagaucaacggaaagcucaauagacugauuggcaaaacaaacgaaaaguuccaccagaucgagaaggaauuuagcgagguugaagggcgcauucaggaccuugagaaauacguggaggauaccaagaucgaccuguggucuuauaacgccgaacuccugguggcucuggagaaucaacauacaaucgaucucaccgacuccgaaaugaacaaacuguucgagaagacgaaaaagcagcuucgggaaaaugcggaggauaugggaaacggcugcuuuaagauuuaccacaaaugugacaaugccugcaucgggagcauuagaaacggcacauaugaucaugacgucuaccgcgacgaggcucugaauaaccgguuccagaucaagggaguggaacucaaaucuggcuacaaggauuggauucuguggaucuccuuugccaucagcugcuuccuucuguguguugcccuccugggguuuauuaugugggcuugccagaaaggaaauaucagauguaacauuugcaucuga

SEQ ID NO: 195561 - RNA, 1701 nt, Artificial Sequence; identical to SEQ ID NO: 193018
  derived and/or modified sequence opt5 from hemagglutinin__InfluenzaA__AIJ10754

SEQ ID NO: 195562 - RNA, 1701 nt, Artificial Sequence
  derived and/or modified sequence opt5 from hemagglutinin__InfluenzaA__AIJ10755
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugguugauggaugguauggcuucagacaccagaacagcgagggccgggggcaggccgcugaccugaaauccacccaaagcgccauugaucagaucaauggaaagcucaacagacugauuggcaaaacaaaugaaaaguuccaccagaucgagaaggaauuuucugagguggaagggcgcauucaggaccuugagaaauacguggaggauaccaagaucgaccugugguccuauaacgccgaacuccuggucgcucuggagaaccaacauacaaucgaucucaccgacagcgaaaugaauaaacuguucgagaagacgaaaaagcagcuucgggaaaacgcggaggauaugggaaauggcugcuuuaagauuuaccacaaaugugacaacgccugcaucgggucuauuagaaauggcacauaugaucaugacguguaccgcgacgaggcucugaacaaucgguuccagaucaagggaguugaacucaaauccggcuacaaggauuggauucuguggaucagcuuugccaucuccugcuuccuucuguguguggcccuccugggguuuauuaugugggcuugccagaaaggaaacaucagauguaauauuugcaucuga

SEQ ID NO: 195563 - RNA, 1701 nt, Artificial Sequence; identical to SEQ ID NO: 193018
  derived and/or modified sequence opt5 from hemagglutinin__InfluenzaA__AIJ10756

SEQ ID NO: 195564 - RNA, 1701 nt, Artificial Sequence
  derived and/or modified sequence opt5 from hemagglutinin__InfluenzaA__AIJ10757
augaagaccaucauugcccugagcuacauccucugccuggugauugcucagaaacuucccggcaacgacaauuccacagccacgcugugucucgggcaccaugcggucccuaacggaaccaucguuaagacaauuaccaaugauagaaucgaggugacaaacgcuaccgaacuggugcaaaauucuagcaucggcgagauuugcgacuccccgcaccagauccuugauggggaaaacuguacacugauugacgcccuccugggagauccccagugcgacggcuuccagaauaaaaagugggaucuguuugucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcaucagaggcagcaauucuuccuucuuuagccggcugaacuggcucacacaucugaauuucaaguauccugcgcuuaacgucaccaugcccaacaaugagcaguuugacaagcuguacauuuggggagugcaccauccugggacagauaaagaccagaucuuccucuaugcccagucuuccggccgcauuaccguuagcacgaagagaucccaacaggcugugaucccgaacaucgggucucggccccgcauuagaaauaucccuagccggauuuccaucuacuggacaauugucaaacccggagauauccugcugaucaacagcaccggcaaucucauugccccucgcggguacuuuaagaucagaucuggaaaauccagcauuaugcggucugacgcucccaucggcaaguguaagagcgaaugcauuacaccgaacggcuccaucccuaaugacaaacccuuccagaacgugaaucgcaucaccuauggggccuguccuagauacgugaagcagucuacccugaaacuugcgacaggaaugcggaacguccccgagaagcaaacgcgcggcauuuuuggggccaucgcuggauucauugaaaauggcugggaggggaugguugauggaugguauggcuuuagacaccagaacagcgagggccgggggcaggccgcugaccugaaauccacccaagccgccaucgaucagauuaauggaaagcucaacagacugaucggcaaaacaaaugaaaaguuccaccagauugagaaggaguucagcgaaguggaagggcgcauccaggaccuugagaaauacguggaggauaccaagaucgaccuguggucuuauaacgcugaacuccuggucgcgcuggagaaccaacauacaauugaucucaccgacuccgaaaugaauaaacuguuugagaagacgaaaaagcagcuucgggaaaacgccgaggauaugggaaauggcugcuucaagaucuaccacaaaugugacaacgcuugcauugggagcaucagaaauggcacauaugaucaugacguguaccgcgacgaggcccugaacaaucgguuucagauuaagggaguugaacucaaaucuggcuacaaggauuggauccuguggaucuccuucgccauuagcugcuuucuucugugugugguccuccugggguucaucaugugggcuugccagaaaggaaacauuagauguaauaucugcauuuga

SEQ ID NO: 195565 - RNA, 1701 nt, Artificial Sequence
  derived and/or modified sequence opt5 from hemagglutinin__InfluenzaA__AIJ10758
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacauucuaauuuuaaguauccugcgcugaacgucaccaugcccaacaaugagcaguucgacaaacuuuacaucuggggagugcaccauccugggacagauaaggaccagauuuuucuguaugcccaguccagcggccgcaucaccguuuccacgaagagaucucaacaggcugugauuccgaacaucgggagccggccccgcaucagaaauauuccuucccggaucagcauuuacuggacaaucgucaaacccggagauauucuccugaucaacucuaccggcaaucugaucgccccucgcggguacuucaagauuagauccggaaaaagcucuaucaugcggagcgacgcucccauuggcaaguguaaguccgaaugcaucacaccgaacggcucuauuccuaaugacaaacccuuucagaacgugaaucgcaucaccuauggggccuguccuagauacgugaagcagagcacccucaaacuggcgacaggaaugcggaacguccccgagaagcaaacgcgcggcaucuucggggccauugcuggauuuaucgaaaauggcugggaggggaugauggauggaugguauggcuucagacaccagaacuccgagggccgggggcaggccgcugaccuuaaaagcacccaagccgccauugaucagaucaauggaaagcugaacagacucauuggcaaaacaaaugaaaaguuccaccagaucgagaaggaauuuucugagguugaagggcgcauucaggaccuggagaaauacguggaggauaccaagaucgaccuuugguccuauaacgcugaacugcucguggcgcuggagaaccaacauacaaucgaucugaccgacagcgaaaugaauaaacucuucgagaagacgaaaaagcagcugcgggaaaacgccgaggauaugggaaauggcugcuuuaagauuuaccacaaaugugacaacgcuugcaucgggucuauuagaaauggcacauaugaucaugacgucuaccgcgacgaggcccuuaacaaucgguuccagaucaagggaguggaacugaaauccggcuacaaggauuggauucucuggaucagcuuugccaucuccugcuuccugcuuuguguugcucugcucggguuuauuaugugggccugccagaaaggaaacaucagauguaauauuugcaucuga

SEQ ID NO: 195566 - RNA, 1701 nt, Artificial Sequence; identical to SEQ ID NO: 193018
  derived and/or modified sequence opt5 from hemagglutinin__InfluenzaA__AIJ10759

SEQ ID NO: 195567 - RNA, 1701 nt, Artificial Sequence
  derived and/or modified sequence opt5 from hemagglutinin__InfluenzaA__AIJ10760
augaagaccaucauugcccugagcuacauccucugccuggugauugcucagaaacuucccggcaacgacaauuccacagccacgcugugucucgggcaccaugcggucccuaacggaaccaucguuaagacaauuaccaaugauagaaucgaggugacaaacgcuaccgaacuggugcaaaauucuagcaucggcgagauuugcgacuccccgcaccagauccuugauggggaaaacuguacacugauugacgcccuccugggagauccccagugcgacggcuuccagaauaaaaagugggaucuguuugucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcaucagaggcagcaauucuuccuucuuuagccggcugaacuggcucacacaucugaauuucaaguauccugcgcuuaacgucaccaugcccaacaaugagcaguuugacaagcuguacauuuggggagugcaccauccugggacagauaaagaccagaucuuccucuaugcccagucuuccggccgcauuaccguuagcacgaagagaucccaacaggcugugaucccgaacaucgggucucggccccgcauuagaaauaucccuagccggauuuccaucuacuggacaauugucaaacccggagauauccugcugaucaacagcaccggcaaucucauugccccucgcggguacuuuaagaucagaucuggaaaauccagcauuaugcggucugacgcucccaucggcaaguguaagagcgaaugcauuacaccgaacggcuccaucccuaaugacaaacccuuccagaacgugaaucgcaucaccuauggggccuguccuagauacgugaagcagucuacccugaaacuugcgacaggaaugcggaacguccccgagaagcaaacgcgcggcauuuuuggggccaucgcuggauucauugaaaauggcugggaggggaugguugauggaugguauggcuuuagacaccagaacagcgagggccgggggcaggccgcugaccugaaauccacccaagccgccaucgaucagauuaauggaaagcucaacagacugaucggcaaaacaaaugaaaaguuccaccagauugagaaggaguucagcgaaguggaagggcgcauccaggaccuugagaaauacguggaggauaccaagaucgaccuguggucuuauaacgcugaacuccuggucgcgcuggagaaccaacauacaauugaucucaccgacuccgaaaugaauaaacuguuugagaagacgaaaaagcagcuucgggaaaacgccgaggauaugggaaauggcugcuucaagaucuaccacaaaugugacaacgcuugcauugggagcaucagaaauggcacauaugaucaugacguguaccgcgacgaggcccugaacaaucgguuucagauuaagggaguugaacucaaaucuggcuacaaggauuggauccuguggaucuccuucgccauuagcugcuuucuucuguguguggcucuccugggguucaucaugugggccugccagaaaggaaacauuagauguaauaucugcauuuga

SEQ ID NO: 195568 - RNA, 1701 nt, Artificial Sequence
  derived and/or modified sequence opt5 from hemagglutinin__InfluenzaA__AIJ10761
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugguugauggaugguauggcuucagacaccagaacagcgagggccgggggcaggccgcugaccugaaauccacccaagccgccauugaucagaucaauggaaagcucaacagacugauuggcaaaacaaaugaaaaguuccaccagaucgagaaggaauuuagcgagguggaagggcgcauucaggaccuugagaaauacguggaggauaccaagaucgaccuguggucuuauaacgcugaacuccuggucgcgcuggagaaccaacauacaaucgaucucaccgacuccgaaaugaauaaacuguucgagaagacgaaaaagcagcuucgggaaaacgccgaggauaugggaaauggcugcuuuaagauuuaccacaaaugugacaacgcuugcaucgggagcauuagaaauggcacauaugaucaugacguguaccgcaacgaggcccugaauaagcgguuccagaucaaaggaguugaacucaagucuggcuacaaagacuggauucuguggaucuccuuugccaucagcugcuuccuucugugugugguccuccugggguuuauuaugugggcuugccagaagggaaacaucagauguaauauuugcaucuga

SEQ ID NO: 195569 - RNA, 1701 nt, Artificial Sequence; identical to SEQ ID NO: 194916
  derived and/or modified sequence opt5 from hemagglutinin__InfluenzaA__AIJ10762

SEQ ID NO: 195570 - RNA, 1701 nt, Artificial Sequence; identical to SEQ ID NO: 194916
  derived and/or modified sequence opt5 from hemagglutinin__InfluenzaA__AIJ10763

SEQ ID NO: 195571 - RNA, 1701 nt, Artificial Sequence; identical to SEQ ID NO: 194916
  derived and/or modified sequence opt5 from hemagglutinin__InfluenzaA__AIJ10764

SEQ ID NO: 195572 - RNA, 1701 nt, Artificial Sequence; identical to SEQ ID NO: 194916
  derived and/or modified sequence opt5 from hemagglutinin__InfluenzaA__AIJ10765

SEQ ID NO: 195573 - RNA, 1701 nt, Artificial Sequence; identical to SEQ ID NO: 194916
  derived and/or modified sequence opt5 from hemagglutinin__InfluenzaA__AIJ10766

SEQ ID NO: 195574 - RNA, 1701 nt, Artificial Sequence; identical to SEQ ID NO: 194916
  derived and/or modified sequence opt5 from hemagglutinin__InfluenzaA__AIJ10767

SEQ ID NO: 195575 - RNA, 1701 nt, Artificial Sequence
  derived and/or modified sequence opt5 from hemagglutinin__InfluenzaA__AIJ10768
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacauccccgagaagcaaacgcgcggcauuuucggggccaucgcuggauuuauugaaaauggcugggaggggauggucgauggaugguauggcuucagacaccagaacagcgagggccgggggcaggccgcugaccugaaauccacccaagccgccaucgaucagauuaauggaaagcucaacagacugaucggcaaaacaaaugaaaaguuccaccagauugagaaggaauuuagcgagguugaagggcgcauccaggaccuugagaaauacguggaggauaccaagaucgaccuguggucuuauaacgcugaacuccugguggcgcuggagaaccaacauacaauugaucucaccgacuccgaaaugaauaaacuguucgagaagacgaaaaagcagcuucgggaaaacgccgaggauaugggaaauggcugcuuuaagaucuaccacaaaugugacaacgcuugcauugggagcaucagaaauggcacauaugaucaugacgucuaccgcgacgaggcccugaacaaucgguuccagauuaagggaguggaacucaaaucuggcuacaaggauuggauccuguggaucuccuuugccauuagcugcuuccuucuguguguugugcuccugggguuuaucaugugggcuugccagaaaggaaacauuagauguaauaucugcauuuga

SEQ ID NO: 195576 - RNA, 1701 nt, Artificial Sequence
  derived and/or modified sequence opt5 from hemagglutinin__InfluenzaA__AIJ10769
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauucagucuggaaaauccagcaucaugagaucugacgcucccauuggcaaguguaagagcgaaugcaucacaccgaacggcuccauuccuaaugacaaacccuuucagaacgugaaucggaucaccuauggggccuguccucgcuacgugaagcaaucuacccugaaacuugcgacaggaaugagaaacguccccgagaagcagacgcggggcaucuucggggccauugcuggauuuaucgaaaauggcugggaggggaugguugauggaugguauggcuuccgccaccagaacagcgagggcagagggcaagccgcugaccugaaauccacccaggccgccauugaucagaucaauggaaagcucaaccggcugauuggcaaaacaaaugaaaaguuccaccagaucgagaaggaauuuagcgagguggaagggcgcauucaagaccuugagaaauacguggaggauaccaagaucgaccuguggucuuauaacgcugaacuccuggucgcgcuggagaaccagcauacaaucgaucucaccgacuccgaaaugaauaaacuguucgagaagacgaaaaagcagcuuagagaaaacgccgaggauaugggaaauggcugcuuuaagauuuaccacaaaugugacaacgcuugcaucgggagcauucggaauggcacauaugaucaugacguguacagagacgaggcccugaacaaucgcuuccagaucaagggaguugaacucaaaucuggcuacaaggauuggauucuguggaucuccuuugccaucagcugcuuccuucugugugugguccuccugggguuuauuaugugggcuugccaaaaaggaaacauccgguguaauauuugcaucuga

SEQ ID NO: 195577 - RNA, 1701 nt, Artificial Sequence; identical to SEQ ID NO: 194916
  derived and/or modified sequence opt5 from hemagglutinin__InfluenzaA__AIJ10770

SEQ ID NO: 195578 - RNA, 1701 nt, Artificial Sequence; identical to SEQ ID NO: 194916
  derived and/or modified sequence opt5 from hemagglutinin__InfluenzaA__AIJ10771

SEQ ID NO: 195579 - RNA, 1701 nt, Artificial Sequence; identical to SEQ ID NO: 194916
  derived and/or modified sequence opt5 from hemagglutinin__InfluenzaA__AIJ10772

SEQ ID NO: 195580 - RNA, 1701 nt, Artificial Sequence; identical to SEQ ID NO: 194916
  derived and/or modified sequence opt5 from hemagglutinin__InfluenzaA__AIJ10773

SEQ ID NO: 195581 - RNA, 1701 nt, Artificial Sequence
  derived and/or modified sequence opt5 from hemagglutinin__InfluenzaA__AIJ10774
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcaacuccccgcaccagauucuugacggggaaaauuguacacugaucgaugcccuccugggagacccccagugcgauggcuuucagaacaaaaagugggaccuguucgucgagcggucuaaagccuauagcaauuguuacccuuaugaugugcccgacuacgcuucccuccgcucucugguugccagcuccgggacccuugaauuuaacaaugagagcuucaacugggcuggagugacgcaaaauggcaccucuuccgccugcauuagaggcagcaacucuuccuuuuucagccggcugaauuggcucacacaucugaacuuuaaguauccugcgcuuaacgucaccaugcccaauaacgagcaguucgauaagcuguacaucuggggagugcaccauccugggacagacaaagaucagauuuuucucuaugcccagucuuccggccgcaucaccguuagcacgaagagaucccaacaggcugugauuccgaauaucgggucucggccccgcaucagaaacauuccuagccggaucuccauuuacuggacaaucgucaaacccggagacauucugcugaucaauagcaccggcaaccucaucgccccucgcggguacuucaagauuagaucuggaaaauccagcaucaugcggucugaugcucccauuggcaaguguaagagcgaaugcaucacaccgaauggcuccauuccuaacgacaaacccuuucagaaugugaaccgcaucaccuauggggccuguccuagauacgugaagcagucuacccugaaacuugcgacaggaaugcggaauguccccgagaagcaaacgcgcggcaucuucggggccauugcuggauuuaucgaaaacggcugggaggggaugauggacggaugguauggcuucagacaccagaauagcgagggccgggggcaggccgcugaucugaaauccacccaaagcgccauugaccagaucaacggaaagcucaauagacugauuggcaaaacaaacgaaaaguuccaccagaucgagaaggaauuuucugagguugaagggcgcauucaggaucuugagaaauacguggaggacaccaagaucgaucugugguccuauaacgccgaacuccugguggcucuggagaaucaacauacaaucgaccucaccgauagcgaaaugaacaaacuguucgagaagacgaaaaagcagcuucgggaaaaugcggaggacaugggaaacggcugcuuuaagauuuaccacaaaugugauaaugccugcaucgggucuauuagaaacggcacauaugaccaugaugucuaccgcgacgaggcucugaauaaccgguuccagaucaagggaguggaacucaaauccggcuacaaggacuggauucuguggaucagcuuugccaucuccugcuuccuucuguguguugugcuccugggguuuauuaugugggccugccagaaaggaaauaucagauguaacauuugcaucuga

SEQ ID NO: 195582 - RNA, 1701 nt, Artificial Sequence
  derived and/or modified sequence opt5 from hemagglutinin__InfluenzaA__AIJ10776
augaagaccaucauugcccugagcugcauccucugucugguguucgcucagaaacuucccggcaacgacaauuccacagccacgcugugccucgggcaccaugcggucccuaacggaaccauuguuaagacaaucaccaaugauagaauugaggugacaaacgcuaccgaacuggugcaaaauucuagcaucggcgagaucugugacuccccgcaccagauucuugauggggaaaacugcacacugaucgacgcccuccugggagauccccagugugacggcuuucagaauaaaaagugggaucuguucgucgagcggucuaaagccuacagcaacugcuauccuuacgacgugcccgauuaugcuucccuccgcucucugguugccagcuccgggacccuugaauuuaauaacgagagcuucaauugggcuggagugacgcaaaacggcaccucuuccgccuguauuagaggcagcaauucuuccuuuuucagccggcugaacuggcucacacaucugaauuuuaaguacccugcgcuuaacgucaccaugcccaacaaugagcaguucgacaagcuguauaucuggggagugcaccauccugggacagauaaagaccagauuuuucucuacgcccagucuuccggccgcaucaccguuagcacgaagagaucccaacaggcugugauuccgaacaucgggucucggccccgcaucagaaauauuccuagccggaucuccauuuauuggacaaucgucaaacccggagauauucugcugaucaacagcaccggcaaucucaucgccccucgcggguacuucaagauuagaucuggaaaauccagcaucaugcggucugacgcucccauuggcaagugcaagagcgaauguaucacaccgaacggcuccauuccuaaugacaaacccuuucagaacgugaaucgcaucaccuacggggccugcccuagauaugugaagcagucuacccugaaacuugcgacaggaaugcggaacguccccgagaagcaaacgcgcggcaucuucggggccauugcuggauuuaucgaaaauggcugggaggggaugguugauggaugguacggcuucagacaccagaacagcgagggccgggggcaggccgcugaccugaaauccacccaagccgccauugaucagaucaauggaaagcucaacagacugauuggcaaaacaaaugaaaaguuccaccagaucgagaaggaauuuagcgagguggaagggcgcauucaggaccuugagaaauauguggaggauaccaagaucgaccuguggucuuacaacgcugaacuccuggucgcgcuggagaaccaacauacaaucgaucucaccgacuccgaaaugagcaaacuguucgagaagacgaaaaagcagcuucgggaaaaugccgaggauaugggaaacggcuguuuuaagauuuaucacaaaugcgacaaugcuugcaucgggucuauuagaaacggcacauacgaucaugacguguaucgcgacgaggcccugaauaaccgguuccagaucaagggaguugaacucaaauccggcuacaaggauuggauucuguggaucagcuuugccaucuccuguuuccuucugugcgugguccuccugggguuuauuaugugggcuugucagaaaggaaauaucagaugcaacauuuguaucuga

SEQ ID NO: 195583 - RNA, 1701 nt, Artificial Sequence; identical to SEQ ID NO: 194916
  derived and/or modified sequence opt5 from hemagglutinin__InfluenzaA__AIJ10777

SEQ ID NO: 195584 - RNA, 1701 nt, Artificial Sequence; identical to SEQ ID NO: 194916
  derived and/or modified sequence opt5 from hemagglutinin__InfluenzaA__AIJ10778

SEQ ID NO: 195585 - RNA, 1701 nt, Artificial Sequence
  derived and/or modified sequence opt5 from hemagglutinin__InfluenzaA__AIJ10780
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacucuuuucagaauaaaaagugggaucuguucgucgagcggagcaaagccuauuccaacuguuacccuuaugacgugcccgauuacgcuucucuccgcagccugguugccuccagcggcacccuugaauuuaauaacgagucuuucaauugggcuggggugacgcaaaacggaaccuccagcgccugcauuagaggcucuaauuccagcuuuuucucucggcugaacuggcucacacauuccaauuuuaaguauccugcgcugaacgucaccaugcccaacaaugagcaguucgacaaacuuuacaucuggggcgugcaccauccugggacagauaaggaccagauuuuucuguaugcccagagcuccggacgcaucaccguuucuacgaagagaagccaacaggcugugauuccgaacaucggcucccggccccgcaucagaaauauuccuagccggaucucuauuuacuggacaaucgucaaacccggggauauucuccugaucaacuccaccggaaaucugaucgccccucgcggcuacuucaagauuagaagcgggaaaucuagcaucaugcgguccgacgcucccauuggaaaguguaagucugaaugcaucacaccgaacggcagcauuccuaaugacaaacccuuucagaacgugaaucgcaucaccuauggcgccuguccuagauacgugaagcaguccacccucaaacuggcgacagggaugcggaacguccccgagaagcaaacgcgcggaaucuucggcgccauugcuggguuuaucgaaaauggaugggagggcaugauggaugggugguauggauucagacaccagaacagcgagggccggggccaggccgcugaccuuaaaucuacccaagccgccauugaucagaucaaugggaagcugaacagacucauuggaaaaacaaaugaaaaguuccaccagaucgagaaggaauuuuccgagguugaaggccgcauucaggacaucgagaaauacguggaggauaccaagaucgaccuguggagcuauaacgcugaacuucugguggcgcucgagaaccaacauacaauugaucugaccgacucugaaaugaauaaacuguucgagaagacgaaaaagcagcuccgggaaaacgccgaggauauggggaauggaugcuuuaagaucuaccacaaaugugacaacgcuugcauuggcuccaucagaaaugggacauaugaucaugacgucuaccgcgacgaggcccugaacaaucgguuccagauuaagggcguggaacuuaaaagcggauacaaggauuggauccuguggaucuccuuugccauuucuugcuuccuccuguguguugcccuucugggcuuuaucaugugggcuugccagaaagggaacauuagauguaauaucugcauuuga

SEQ ID NO: 195586 - RNA, 1701 nt, Artificial Sequence; identical to SEQ ID NO: 194916
  derived and/or modified sequence opt5 from hemagglutinin__InfluenzaA__AIJ10781

SEQ ID NO: 195587 - RNA, 1701 nt, Artificial Sequence; identical to SEQ ID NO: 194916
  derived and/or modified sequence opt5 from hemagglutinin__InfluenzaA__AIJ10782

SEQ ID NO: 195588 - RNA, 1701 nt, Artificial Sequence
  derived and/or modified sequence opt5 from hemagglutinin__InfluenzaA__AIJ10783
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggugggagucacgcaaaacggcaccucuuccgcuugcauuagaggcagcaauucuuccuuuuucagccggcugaacuggcucacacaucugaauuuuaaguauccugcccuuaacgugaccaugcccaacaaugagcaguucgacaagcuguacaucuggggaguucaccauccugggacagauaaagaccagauuuuucucuaugcgcagucuuccggccgcaucaccgugagcacgaagagaucccaacaggccgucauuccgaacaucgggucucggccccgcaucagaaauauuccuagccggaucuccauuuacuggacaaucgugaaacccggagauauucugcugaucaacagcaccggcaaucucaucgcuccucgcggguacuucaagauuagaucuggaaaauccagcaucaugcggucugacgcccccauuggcaaguguaagagcgaaugcaucacaccgaacggcuccauuccuaaugacaaacccuuucagaacgugaaucgcaucaccuauggggcuuguccuagauacgucaagcagucuacccugaaacuugccacaggaaugcggaacguucccgagaagcaaacgcgcggcaucuucggggcgauugccggauuuaucgaaaauggcugggaggggaugaaagauggaugguauggcuucagacaccagaacagcgagggccgggggcaggcugccgaccugaaguccacccaagcugccauugaucagaucaauggaaaacucaacagacugauuggcaagacaaaugaaaaguuccaccagaucgagaaagaauuuagcgagguggaagggcgcauucaggaccuugagaaguacguggaggauaccaaaaucgaccuguggucuuauaacgccgaacuccuggucgcucuggagaaccaacauacaaucgaucucaccgacuccgaaaugaauaagcuguucgagaaaacgaagaagcagcuucgggaaaacgcggaggauaugggaaauggcugcuuuaaaauuuaccacaagugugacaacgccugcaucgggagcauuagaaauggcacauaugaucaugacguguaccgcgacgaggcucugaacaaucgguuccagaucaaaggaguugaacucaagucuggcuacaaagauuggauucuguggaucuccuuugccaucagcugcuuccuucuguguguggcccuccugggguuuauuaugugggcuugccagaagggaaacaucagauguaauauuugcaucuga

SEQ ID NO: 195589 - RNA, 1701 nt, Artificial Sequence; identical to SEQ ID NO: 195588
  derived and/or modified sequence opt5 from hemagglutinin__InfluenzaA__AIJ10784

SEQ ID NO: 195590 - RNA, 1701 nt, Artificial Sequence
  derived and/or modified sequence opt5 from hemagglutinin__InfluenzaA__AIJ10785
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcaacuccccgcaccagauucuugacggggaaaauuguacacugaucgaugcccuccugggagacccccagugcgauggcuuucagaacaaaaagugggaccuguucgucgagcggucuaaagccuauagcaauuguuacccuuaugaugugcccgacuacgcuucccuccgcucucugguugccagcuccgggacccuugaauuuaacaaugagagcuucaacugggcuggagugacgcaaaauggcaccucuuccgccugcauuagaggcagcaacucuuccuuuuucagccggcugaauuggcucacacaucugaacuuuaaguauccugcgcuuaacgucaccaugcccaauaacgagcaguucgauaagcuguacaucuggggagugcaccauccugggacagacaaagaucagauuuuucucuaugcccagucuuccggccgcaucaccguuagcacgaagagaucccaacaggcugugauuccgaauaucgggucucggccccgcaucagaaacauuccuagccggaucuccauuuacuggacaaucgucaaacccggagacauucugcugaucaauagcaccggcaaccucaucgccccucgcggguacuucaagauuagaucuggaaaauccagcaucaugcggucugaugcucccauuggcaaguguaagagcgaaugcaucacaccgaauggcuccauuccuaacgacaaacccuuucagaaugugaaccgcaucaccuauggggccuguccuagauacgugaagcagucuacccugaaacuugcgacaggaaugcggaauguccccgagaagcaaacgcgcggcaucuucggggccauugcuggauuuaucgaaaacggcugggaggggaugauggacggaugguauggcuucagacaccagaauagcgagggccgggggcaggccgcugaucugaaauccacccaaagcgccauugaccagaucaacggaaagcucaauagacugauuggcaaaacaaacgaaaaguuccaccagaucgagaaggaauuuucugagguugaagggcgcauucaggaucuugagaaauacguggaggacaccaagaucgaucugugguccuauaacgccgaacuccugguggcucuggagaaucaacauacaaucgaccucaccgauagcgaaaugaacaaacuguucgagaagacgaaaaagcagcuucgggaaaaugcggaggacaugggaaacggcugcuuuaagauuuaccacaaaugugauaaugccugcaucgggucuauuagaaacggcacauaugaccaugaugucuaccgcgacgaggcucugaauaaccgguuccagaucaagggaguggaacucaaauccggcuacaaggacuggauucuguggaucagcuuugccaucuccugcuuccuucuguguguugcccuccugggguuuauuaugugggcuugccagaaaggaaauaucagauguaacauuugcaucuga

SEQ ID NO: 195591 - RNA, 1701 nt, Artificial Sequence; identical to SEQ ID NO: 195588
  derived and/or modified sequence opt5 from hemagglutinin__InfluenzaA__AIJ10786

SEQ ID NO: 195592 - RNA, 1701 nt, Artificial Sequence
  derived and/or modified sequence opt5 from hemagglutinin__InfluenzaA__AIJ10787
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggugggagucacgcaaaacggcaccucuuccgcuugcauuagaggcagcaauucuuccuuuuucagccggcugaacuggcucacacaucugaauuuuaaguauccugcccuuaacgugaccaugcccaacaaugagcaguucgacaagcuguacaucuggggaguucaccauccugggacagauaaagaccagauuuuucucuaugcgcagucuuccggccgcaucaccgugagcacgaagagaucccaacaggccgucauuccgaacaucgggucucggccccgcaucagaaauauuccuagccggaucuccauuuacuggacaaucgugaaacccggagauauucugcugaucaacagcaccggcaaucucaucgcuccucgcggguacuucaagauuagaucuggaaaauccagcaucaugcggucugacgcccccauuggcaaguguaagagcgaaugcaucacaccgaacggcuccauuccuaaugacaaacccuuucagaacgugaaucgcaucaccuauggggcuuguccuagauacgucaagcagucuacccugaaacuugccacaggaaugcggaacguucccgagaagcaaacgcgcggcaucuucggggcgauugccggauuuaucgaaaauggcugggaggggaugaaagauggaugguauggcuucagacaccagaacagcgagggccgggggcaggcugccgaccugaaguccacccaagcugccauugaucagaucaauggaaaacucaacagacugauuggcaagacaaaugaaaaguuccaccagaucgagaaagaauuuagcgagguggaagggcgcauucaggaccuugagaaguacguggaggauaccaaaaucgaccuguggucuuauaacgccgaacuccuggucgcucuggagaaccaacauacaaucgaucucaccgacuccgaaaugaauaagcuguucgagaaaacgaagaagcagcuucgggaaaacgcggaggauaugggaaauggcugcuuuaaaauuuaccacaagugugacaacgccugcaucgggagcauuagaaauggcacauaugaucaugacguguaccgcgacgaggcucugaacaaucgguucagaaucaaaggaguugaacucaagucuggcuacaaagauuggauucuguggaucuccuuugccaucagcugcuuccuucuguguguggcccuccugggguuuauuaugugggcuugccagaagggaaacauccgcuguaauauuugcaucuga

SEQ ID NO: 195593 - RNA, 1701 nt, Artificial Sequence; identical to SEQ ID NO: 195590
  derived and/or modified sequence opt5 from hemagglutinin__InfluenzaA__AIJ10788

SEQ ID NO: 195594 - RNA, 1701 nt, Artificial Sequence; identical to SEQ ID NO: 195590
  derived and/or modified sequence opt5 from hemagglutinin__InfluenzaA__AIJ10789

SEQ ID NO: 195595 - RNA, 1701 nt, Artificial Sequence; identical to SEQ ID NO: 195588
  derived and/or modified sequence opt5 from hemagglutinin__InfluenzaA__AIJ10790

SEQ ID NO: 195596 - RNA, 1701 nt, Artificial Sequence; identical to SEQ ID NO: 194916
  derived and/or modified sequence opt5 from hemagglutinin__InfluenzaA__AIJ10791

SEQ ID NO: 195597 - RNA, 1701 nt, Artificial Sequence
  derived and/or modified sequence opt5 from hemagglutinin__InfluenzaA__AIJ10792
augaagaccaucauugcccugagcuacauccucugccugguguucgcucagaaacuucccggcgacgauaacuccacagccacgcugugucucgggcaccaugcggucccuaauggaaccauuguuaagacaaucaccaacgacagaauugaggugacaaaugcuaccgaacuggugcaaaacucuagcaucggcgagaucugcgauuccccgcaccagauucuugacggggaaaauuguacacugaucgaugcccuccugggagacccccagugcgauggcuuucagaacaaaaagugggaccuguucgucgagcggucuaaagccuauagcaauuguuacccuuaugaugugcccgacuacgcuucccuccgcucucugguugccagcuccgggacccuugaauuuaacaaugagagcuucaacugggcuggagugacgcaaaauggcaccucuuccgccugcauuagaggcagcaacucuuccuuuuucagccggcugaauuggcucacacaucugaacuuuaaguauccugcgcuuaaugucaccaugcccaacaacgagcaguucgauaagcuguacaucuggggagugcaccauccugggacagacaaagaucagauuuuucucuaugcccagucuuccggccgcaucaccguuagcacgaagagaucccaacaggcugugauuccgaauaucgggucucggccccgcaucagaaacauuccuagccggaucuccauuuacuggacaaucgucaaacccggagacauucugcugaucaauagcaccggcaaccucaucgccccucgcggguacuucaagauuagaucuggaaaauccagcaucaugcggucugacgcucccauuggcaaguguaagagcgaaugcaucacaccgaauggcuccauuccuaacgauaaacccuuucagaaugugaaccgcaucaccuauggggccuguccuagauacgugaagcagucuacccugaaacuugcgacaggaaugcggaauguccccgagaagcaaacgcgcggcaucuucggggccauugcuggauuuaucgaaaacggcugggaggggaugguugacggaugguauggcuucagacaccagaauagcgagggccgggggcaggccgcugaucugaaauccacccaagccgccauugaccagaucaacggaaagcucaauagacugauuggcaaaacaaacgaaaaguuccaccagaucgagaaggaauuuagcgagguggaagggcgcauucaggaucuugagaaauacguggaggacaccaagaucgaucuguggucuuauaaugcugaacuccuggucgcgcuggagaaccaacauacaaucgaccucaccgauuccgaaaugaacaaacuguucgagaagacgaaaaagcagcuucgggaaaaugccgaggacaugggaaacggcugcuuuaagauuuaccacaaaugugauaaugcuugcaucgggagcauuagaaacggcacauaugaccaugacguguaccgcgaugaggcccugaauaaccgguuccagaucaagggaguugaacucaaaucuggcuacaaggacuggauucuguggaucuccuuugccaucagcugcuuccuucugugugugguccuccugggguuuauuaugugggcuugccagaaaggaaauaucagauguaacauuugcaucuga

SEQ ID NO: 195598 - RNA, 1701 nt, Artificial Sequence; identical to SEQ ID NO: 192907
  derived and/or modified sequence opt5 from hemagglutinin__InfluenzaA__AIJ29347

SEQ ID NO: 195599 - RNA, 1701 nt, Artificial Sequence
  derived and/or modified sequence opt5 from hemagglutinin__InfluenzaA__AIJ29349
augaagaccaucauugcccugagcuacauccucugccugguguucgcucagaaauuucccggcaacgacaauuccacagccacgcuuugucuggggcaccaugcggucccuaacggaaccauuguuaagacaaucaccaaugauagaauugaggugacaaacgcuaccgaacucgugcaaaauucuagcaucggcgagaucugcgacuccccgcaccagauucuggauggggaaaacuguacacuuaucgacgcccugcucggagauccccagugcgacggcuuccagaauaaaaagugggaucuguuugucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcauuagacggagcaauucuuccuucuuuagccgccuuaacuggcugacccaucucaauuucaaguauccugcccugaacgucacaaugcccaacaaugagcaguuugacaaacuuuacaucuggggcgugcaccauccugggaccgauaaagaccagauuuuccuguaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucuccugaucaacagcacaggaaaucugaucgcuccuagaggcuacuuuaagauucggucugggaaauccagcaucaugcgcucugacgcccccauuggaaaguguaagagcgaaugcaucaccccgaacggcuccauuccuaaugacaaacccuuccagaacgugaauagaaucaccuauggcgcuuguccucgguacgugaagcagucuacacucaaacuggccacggggaugcgcaacguccccgagaagcaaaccagaggaaucuuuggcgcgauugccggguucaucgaaaauggaugggagggcaugguugaugggugguauggauuccggcaccagaacagcgagggcagaggccaggcugccgaccuuaaauccacacaagcugccauugaucagaucaaugggaagcugaaccgccucauuggaaaaaccaaugaaaaguuucaccagaucgagaaggaguucagcgaaguggaaggccggauucaggaccuggagaaauacguggaggauacaaagaucgaccuuuggucuuauaacgccgaacugcucgucgcucuggagaaccaacauaccaucgaucugacggacuccgaaaugaauaaacucuuugagaagacaaagaagcagcugagagaaaacgcggaggauauggggaauggaugcuucaagauuuaccacaaaugugacaacgccugcaucggcagcauucgcaaugggaccuaugaucaugacguguaccgggacgaggcucuuaacaauagauuucagaucaagggcguugaacugaaaucuggauacaaggauuggauucucuggaucuccuucgccaucagcugcuuucugcuuuguguggcccugcucggcuucauuaugugggcuugccagaaagggaacauccgcuguaauauuugcaucuga

SEQ ID NO: 195600 - RNA, 1701 nt, Artificial Sequence
  derived and/or modified sequence opt5 from hemagglutinin__InfluenzaA__AIJ29351
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagucuacacugaaacuugccacggggaugcgcaacguccccgagaagcaaaccagaggaaucuucggcgcgauugccggguuuaucgaaaauggaugggagggcaugguugaugggugguauggauuccggcaccagaacagcgagggcagaggccaggcugccgaccugaaauccacacaagcugccauugaucagaucaaugggaagcucaaccgccugauuggaaaaaccaaugaaaaguuccaccagaucgagaaggaauuuagcgagguggaaggccggauucaggaccuugagaaauacguggaggauacaaagaucgaccuguggucuuauaacgccgaacuccuggucgcucuggagaaccaacauaccaucgaucucacggacuccgaaaugaauaaacuguucgagaagaccaaaaagcagcuuagagaaaacgcggaggauauggggaauggaugcuuuaagauuuaccacaaaugugacaacgccugcaucggcagcauucgcaaugggacauaugaucaugacguguaccgggacgaggcucugaacaauagauuccagaucaagggcguugaacucaaaucuggauacaaggauuggauucuguggaucuccuuugccaucagcugccuucugcucuguguggcccugcugggcuucauuaugugggcuugccagaaagggaacauccgcuguaauauuugcaucuga

SEQ ID NO: 195601 - RNA, 1701 nt, Artificial Sequence; identical to SEQ ID NO: 192504
  derived and/or modified sequence opt5 from hemagglutinin__InfluenzaA__AIJ29353

SEQ ID NO: 195602 - RNA, 1701 nt, Artificial Sequence
  derived and/or modified sequence opt5 from hemagglutinin__InfluenzaA__AIJ29355
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacuccagcuuuuucucucggcugaauuggcucacacaucugaacuuuaaguauccugcccuuaaugucaccaugcccaacaacgagcaguucgacaagcuguacauuuggggcgugcaccauccugggacggauaaagaccagaucuuucucuaugcgcaauccagcggacgcauuacaguuuccaccaagagaucucagcaggccgugaucccgaauauuggcagccggucccgcaucagaaacauccccagccggauuucuaucuacuggacaauugucaaaccuggggauauccugcugauuaauuccaccggaaaccucaucgcuccccgcggcuacuucaagaucagaagcgggaaaucuagcauuaugcgguccgacgccccuaucggaaaguguaauucugaaugcauuacccccaacggcagcaucccgaaugacaagccuuuucagaacgugaaucgcauuacauauggcgcuugucccagauacgugaaacaauccacgcugaaacuugccaccgggaugcggaacgucccugagaagcagacacgcggaaucuucggcgcgaucgccggguuuauugaaaauggaugggagggcaugguugaugggugguauggauucagacaccagaacagcgagggccggggccaagcugccgaccugaagucuacccaggcugccaucgaucagauuaaugggaaacucaacagacugaucggaaagacaaaugaaaaauuccaccagauugagaaggaauuuuccgagguggaaggccgcauccaagaccuugagaaguacguggaggauaccaaaauugaccuguggagcuauaacgccgaacuccuggucgcucuggagaaccagcauacgaucgaucucacagacucugaaaugaauaagcuguucgagaaaaccaagaaacagcuucgggaaaacgcggaggauauggggaauggaugcuuuaagaucuaccacaagugugacaacgccugcauuggcuccaucagaaaugggaccuauaaccaugauguguaccgcgacgaggcucugaauaaccgguuccagauuaaaggcguugaacucaagagcggauacaaagacuggauccuguggauuuccuuugccaucucuugcuuccuucuguguguggcccuccugggcuuuaucaugugggcuugccaaaaggggaauauuagauguaacaucugcauuuga

SEQ ID NO: 195603 - RNA, 1701 nt, Artificial Sequence; identical to SEQ ID NO: 192098
  derived and/or modified sequence opt5 from hemagglutinin__InfluenzaA__AIJ29357

SEQ ID NO: 195604 - RNA, 1701 nt, Artificial Sequence
  derived and/or modified sequence opt5 from hemagglutinin__InfluenzaA__AIJ29359
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauaacuccuuuuucucucgccugaauuggcucacccaucugaacuuuaaguauccugcccuuaacgucacaaugcccaauaacgagcaguucgacaagcuguacaucuggggcgugcaccauccugggaccgauaaagaccagauuuuucucuaugcgcagagcucuggaagaaucacgguuuccacaaagcggagccaacaggccgugauuccgaauaucggcucccgccccagaauccggaacauuccuucucgcaucagcauuuacuggaccaucgucaaacccggggauauucugcugaucaauuccacaggaaaccucaucgcuccuagaggcuacuucaagauucggagcgggaaaucuuccaucaugcgcagcgacgcccccauuggaaaguguaagucugaaugcaucaccccgaauggcagcauuccuaacgacaaacccuuucagaaugugaacagaaucaccuauggcgcuuguccucgguacgugaagcaguccacacugaaacuugccacggggaugcgcaauguccccgagaagcaaaccagaggaaucuucggcgcgauugccggguuuaucgaaaacggaugggagggcaugguugaugggugguauggauuccggcaccaaaauucugagggcagaggccaggcugccgaccugaaaagcacacaggcugccauugaucagaucaacgggaagcucaaucgccugauuggaaaaaccaacgaaaaguuccaccagaucgagaaggaauuuuccgagguggaaggccggauucaggaccuugagaaauacguggaggauacaaagaucgaccuguggagcuauaacgccgaacuccuggucgcucuggagaaucaacauaccaucgaucucacggacucugaaaugaacaaacuguucgagaagaccaaaaagcagcuuagagaaaaugcggaggauauggggaacggaugcuuuaagauuuaccacaaaugugacaaugccugcaucggcuccauucgcaacgggacauaugaucaugacguguaccgggacgaggcuaucaauaacagauuccagauuaagggcguugaacugaaaagcggauacaaggauuggauccucuggaucucuuuugccauuuccugcuuccugcuuuguguggcccugcucggcuuuaucaugugggcuugccagaaagggaauauucgcuguaacaucugcauuuga

SEQ ID NO: 195605 - RNA, 1701 nt, Artificial Sequence
  derived and/or modified sequence opt5 from hemagglutinin__InfluenzaA__AIJ29361
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacguuucccuccgcucucugguggcuagcuccgggacccuugaauuuaauaacgagagcuucaauuggacgggagucacccaaaacggcacaucuuccgccugcauuagacggagcaauaacuccuuuuucucucgccugaauuggcucacccaucugaacuuuaaguauccugcucuuaacgugacaaugcccaauaacgagcaguucgacaagcuguacaucuggggcguucaccauccugggaccgauaaagaccagauuuuucucuaugcccagagcucuggaagaaucacgguguccacaaagcggagccaacaggcggucauuccgaauaucggcucccgccccagaauccggaacauuccuucucgcaucagcauuuacuggaccaucgugaaacccggggauauucugcugaucaauuccacaggaaaccucaucgccccuagaggcuacuucaagauucggagcgggaaaucuuccaucaugcgcagcgacgcucccauuggaaaguguaagucugaaugcaucaccccgaauggcagcauuccuaacgacaaacccuuucagaaugugaacagaaucaccuauggcgccuguccucgguacgucaagcaguccacacugaaacuugcuacggggaugcgcaauguucccgagaagcaaaccagaggaaucuucggcgccauugcgggguuuaucgaaaacggaugggagggcaugguggaugggugguauggauuccggcaccaaaauucugagggcagaggccaggccgcugaccugaaaagcacacaggccgcuauugaucagaucaacgggaagcucaaucgccugauuggaaaaaccaacgaaaaguuccaccagaucgagaaggaauuuuccgagguggaaggccggauucaggaccuugagaaauacgucgaggauacaaagaucgaccuguggagcuauaacgccgaacuccugguggcccuggagaaucaacauaccaucgaucucacggacucugaaaugaacaaacuguucgagaagaccaaaaagcagcuuagagaaaaugcugaggauauggggaacggaugcuuuaagauuuaccacaaaugugacaaugcgugcaucggcuccauucgcaacgggacauaugaucaugacguuuaccgggacgaggcccugaauaacagauuccagaucaagggcguggaacucaaaagcggauacaaggauuggauucuguggaucucuuuugcuaucuccugcuuccuucugugugucgcccuccugggcuuuauuaugugggccugccagaaagggaauauccgcuguaacauuugcaucuga

SEQ ID NO: 195606 - RNA, 1701 nt, Artificial Sequence; identical to SEQ ID NO: 193064
  derived and/or modified sequence opt5 from hemagglutinin__InfluenzaA__AIL93623

SEQ ID NO: 195607 - RNA, 1701 nt, Artificial Sequence
  derived and/or modified sequence opt5 from hemagglutinin__InfluenzaA__AIL93634
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauauguuaagagcaccaagcugagacuugccacagggcugcggaaugugcccucuauccagagccgcggacucuuuggcgcuauugccggguucaucgaaggaggcuggaccgggaugguggacggaugguacggcuaucaucaccaaaacgagcagggcuccggguacgccgcugaccugaaaucuacgcagaaugcgaucgauaagauuacaaacaaagucaauagcgugaucgagaagaugaacacccaguuuaccgccguuggaaaagaguucaaucaccuugagaagagaauugaaaaccugaauaagaaaguggacgauggcuuccucgacaucuggacauacaacgcugagcugcugguccuccuggaaaaugagcggacccuugauuaucaugacuccaacgugaagaaccuguacgagaaaguccgcaaucaacucaagaacaaugccaaagaaauugggaacggauguuuugaguucuaucacaagugcaauaacacauguauggaaagcgugaagaauggcacguacgauuauccuaaauacucugaggaagccaagcugaacagagagaaaaucgacgggguuaaacuugaguccacccggaucuaucagauucuggcuaucuacagcacaguggccucuucccucguccuggugguuagccugggcgcgauuuccuuuuggaugugcucuaauggaagccuccagugccgcaucuguauuuga

SEQ ID NO: 195608 - RNA, 1701 nt, Artificial Sequence
  derived and/or modified sequence opt5 from hemagglutinin__InfluenzaA__AIL93645
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuucgcuauccugcgcuuaacgucaccaugcccaacaaugagcaguucgacaagcuguacaucuggggagugcaccauccugggacagauaaggaccagauuuuucucuaugcccagucuuccggcagaaucaccguuagcacgaaacggucccaacaggcugugauuccgaacaucgggucucgccccagaauccggaauauuccuagccgcaucuccauuuacuggacaaucgucaagcccggagauauucugcugaucaacagcaccggcaaucucaucgccccuagaggguacuucaaaauucggucuggaaaguccagcaucaugcgcucugacgcucccauuggcaaauguaagagcgaaugcaucacaccgaacggcuccauuccuaaugacaagcccuuucagaacgugaauagaaucaccuauggggccuguccucgguacgugaaacagucuacccugaaacuugcgacaggaaugcgcaacguccccgagaagcaaacgagaggcaucuucggggccauugcuggauuuaucgaaaauggcugggaggggaugguugauggaugguauggcuuccggcaccagaacagcgagggcagagggcaggccgcugaccugaaguccacccaagccgccauugaucagaucaauggaaaacucaaccgccugauuggcaagacaaaugaaaaauuccaccagaucgagaaggaauuuagcgagguggaagggcggauucaggaccuugagaaguacguggaggauaccaaaaucgaccuguggucuuauaacgcugaacuccuggucgcgcuggagaaccaacauacaaucgaucucaccgacuccgaaaugaauaagcuguucgagaaaacgaagaaacagcuuagagaaaacgccgaggauaugggaaauggcugcuuuaagauuuaccacaagugugacaacgcuugcaucgggagcauucgcaauggcacauaugaucaugacguguaccgggacgaggcccugaacaauagauuccagaucaaaggaguugaacucaagucuggcuacaaagauuggauucuguggaucuccuuugccaucagcugcuuccuucuguguguggcucuccugggguuuauuaugugggccugccagaagggaaacauccgcuguaauauuugcaucuga

SEQ ID NO: 195609 - RNA, 1701 nt, Artificial Sequence; identical to SEQ ID NO: 193018
  derived and/or modified sequence opt5 from hemagglutinin__InfluenzaA__AIL93657

SEQ ID NO: 195610 - RNA, 1701 nt, Artificial Sequence; identical to SEQ ID NO: 193018
  derived and/or modified sequence opt5 from hemagglutinin__InfluenzaA__AIL93669

SEQ ID NO: 195611 - RNA, 1701 nt, Artificial Sequence
  derived and/or modified sequence opt5 from hemagglutinin__InfluenzaA__AIL93681
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcagcgccgggucuggaaucauuaucuccgacacccccguccaugauugcaauaccacaugucagacgccugagggcgcuaucaacaccagccuccccuuccagaauauucacccgaucacaauuggcaagugcccuaaauaugugaagucuaccaagcugagacuugccacagggcugcggaacguucccagcauccagucccgcggacucuuuggcgcuauugccggguucaucgaaggaggcuggaccgggaugguggacggaugguacggcuaucaucaccaaaaugagcagggcucuggguacgccgcugaccugaaaagcacgcagaacgcgaucgauaagauuacaaauaaagucaacuccgugaucgagaagaugaauacccaguuuaccgccguuggaaaagaguucaaccaccuugagaagagaauugaaaaucugaacaagaaaguggacgauggcuuccucgacaucuggacauacaaugcugagcugcugguccuccuggaaaacgagcggacccuugauuaucaugacagcaaugugaagaaccuguacgagaaaguccgcaaccaacucaagaauaacgccaaagaaauugggaauggauguuuugaguucuaucacaagugcgauaacacauguauggaaucugugaagaauggcacguacgacuauccuaaauacuccgaggaagccaagcugaacagagagaaaaucgaugggguuaaacuugagagcacccggaucuaucagauucuggcuaucuacucuacaguggccuccagccucguccuggugguuucccugggcgcgauuucuuuuuggaugugcagcaauggaucccuccagugccgcaucuguauuuga

SEQ ID NO: 195612 - RNA, 1701 nt, Artificial Sequence; identical to SEQ ID NO: 195608
  derived and/or modified sequence opt5 from hemagglutinin__InfluenzaA__AIL93692

SEQ ID NO: 195613 - RNA, 1701 nt, Artificial Sequence; identical to SEQ ID NO: 195608
  derived and/or modified sequence opt5 from hemagglutinin__InfluenzaA__AIL93716

SEQ ID NO: 195614 - RNA, 1701 nt, Artificial Sequence; identical to SEQ ID NO: 193018
  derived and/or modified sequence opt5 from hemagglutinin__InfluenzaA__AIL93728

SEQ ID NO: 195615 - RNA, 1701 nt, Artificial Sequence; identical to SEQ ID NO: 193018
  derived and/or modified sequence opt5 from hemagglutinin__InfluenzaA__AIL93740

SEQ ID NO: 195616 - RNA, 1701 nt, Artificial Sequence
  derived and/or modified sequence opt5 from hemagglutinin__InfluenzaA__AIL93752
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgaccggccgcaccagauucuugauggggaaaacuguacacugaucgacgcccuccugggagauccccagugcgacggcuuucagaauaaaaagugggaucuguucgucgagcgcuccaaagccuauucuaacuguuacccuuaugacgugcccgauuacgcuagccucagaucccugguugccucuagcgggacccuugaauuuaauaacgaguccuucaauugggcuggagugacgcaaaacggcaccagcucugccugcauucggggcuccaauagcuccuuuuucucucgccugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagagcucuggcagaaucaccguuuccacgaagaaaagccaacaggcugugauuccgaacaucgggucccggccccgcaucagaaauauuccuucucggaucagcauuuacuggacaaucgucaagcccggagauauucugcugaucaacuccaccggcaaucucaucgccccucgcggguacuucaaaauuagaagcggaaagucuuccaucaugcggagcgacgcucccauuggcaaguguaaaucugaaugcaucacaccgaacggcagcauuccuaaugacaagcccuuucagaacgugaaucgcaucaccuauggggccuguccuagauacgugaaacaguccacccugaagcuggcgacaggaaugcggaacguccccgagaaacaaacgcgcggcaucuucggggccauugcuggauuuaucgaaaauggcugggaggggaugguugauggaugguauggcuucagacaccagaacucugagggccgggggcaggccgcugaccuuaagagcacccaagccgccauugaucagaucaauggaaaacucaacagacugauuggcaagacaaaugaaaaguuccaccagaucgagaaagaauuuuccgagguggaagggcgcauucaggaccuugagaaguacguggaggauaccaaaaucgaccuguggagcuauaacgcugaacuccuggucgcgcuggagaaccaacauacaaucgaucucaccgacucugaaaugaauaagcuguucgagaaaacgaagaagcagcuucgggaaaacgccgaggauaugggaaauggcugcuuuaaaauuuaccacaagugugacaacgcuugcaucggguccauuagaaauggcacauaugaucaugacguguaccgcgacgaggcccugaacaaucgguuccagaucaaaggaguugaacucaagagcggcuacaaagauuggauucuguggaucucuuuugccaucuccugcuuccuucuguguguggcucuccugggguuuauuaugugggccugccagaagggaaacaucagauguaauauuugcaucuga

SEQ ID NO: 195617 - RNA, 1701 nt, Artificial Sequence
  derived and/or modified sequence opt5 from hemagglutinin__InfluenzaA__AIL93764
augaagaccaucauugcccugagcuacauccucugccugguguucacacagaaacuucccggcaacgacaauuccacggcuacccugugucucgggcaccaugccgucccuaacggaacaauuguuaagaccaucacaaaugauagaauugaggugaccaacgcgacagaacuggugcaaaauucuagcaucggcgagaucugcgacuccccgcaccagauucuugauggggaaaacuguacccugaucgacgcucuccugggagauccccagugcgacggcuuucagaauaaaaagugggaucuguucgucgagcggucuaaagccuauagcaacuguuacccuuaugacgugcccgauuacgccucccuccgcucucugguugcuagcuccgggacgcuugaauuuaauaacgagagcuucaauugggccggagugacccaaaacggcacaucuuccgcuugcauuagaggcagcaauucuuccuuuuucagccggcugaacuggcucacccaucugaauuuuaaguauccugcccuuaacgucacaaugcccaacaaugagcaguucgacaagcuguacaucuggggagugcaccauccugggaccgauaaagaccagauuuuucucuaugcgcagucuuccggccgcaucacgguuagcacaaagagaucccaacaggccgugauuccgaacaucgggucucggccccgcaucagaaauauuccuagccggaucuccauuuacuggaccaucgucaaacccggagauauucugcugaucaacagcacaggcaaucucaucgcuccucgcggguacuucaagauuagaucuggaaaauccagcaucaugcggucugacgcccccauuggcaaguguaagagcgaaugcaucaccccgaacggcuccauuccuaaugacaaacccuuucagaacgugaaucgcaucaccuauggggcuuguccuagauacgugaagcagucuacacugaaacuugccacgggaaugcggaacguccccgagaagcaaacccgcggcaucuucggggcgauugccggauuuaucgaaaauggcugggaggggaugguugauggaugguauggcuucagacaccagaacagcgagggccgggggcaggcugccgaccugaaauccacacaagcugccauugaucagaucaauggaaagcucaacagacugauuggcaaaaccaaugaaaaguuccaccagaucgagaaggaauuuagcgagguggaagggcgcauucaggaccuugagaaauacguggaggauacaaagaucgaccuguggucuuauaacgccgaacuccuggucgcucuggagaaccaacauaccaucgaucucacggacuccgaaaugaauaaacuguucgagaagaccaaaaagcagcuucgggaaaacgcggaggauaugggaaauggcugcuuuaagauuuaccacaaaugugacaacgccugcaucgggagcauuagaaaugagacauaugaucaugacguguaccgcgacgaagcucugaacaaucgguuccagaucaagggcguugagcucaaaucuggauacaaggauuggauucuguggaucuccuuugccaucagcugcuuccuucuguguguggcccuccugggcuuuauuaugugggcuugccagaaagggaacaucagauguaauauuugcaucuga

SEQ ID NO: 195618 - RNA, 1701 nt, Artificial Sequence; identical to SEQ ID NO: 193018
  derived and/or modified sequence opt5 from hemagglutinin__InfluenzaA__AIL93776

SEQ ID NO: 195619 - RNA, 1701 nt, Artificial Sequence; identical to SEQ ID NO: 193018
  derived and/or modified sequence opt5 from hemagglutinin__InfluenzaA__AIL93788

SEQ ID NO: 195620 - RNA, 1701 nt, Artificial Sequence; identical to SEQ ID NO: 193018
  derived and/or modified sequence opt5 from hemagglutinin__InfluenzaA__AIL93812

SEQ ID NO: 195621 - RNA, 1701 nt, Artificial Sequence; identical to SEQ ID NO: 193018
  derived and/or modified sequence opt5 from hemagglutinin__InfluenzaA__AIL93824

SEQ ID NO: 195622 - RNA, 1701 nt, Artificial Sequence; identical to SEQ ID NO: 195611
  derived and/or modified sequence opt5 from hemagglutinin__InfluenzaA__AIL93836

SEQ ID NO: 195623 - RNA, 1701 nt, Artificial Sequence
  derived and/or modified sequence opt5 from hemagglutinin__InfluenzaA__AIL93847
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcagcgccgggucuggaaucauuaucuccgacacccccguccaugauugcaauaccacaugucagacgccugagggcgcuaucaacaccagccuccccuuccagaauauucacccgaucacaauuggcaagugcccuaaauaugugaagucuaccaagcugagacuugccacagggcugcggaacguucccagcauccagucccgcggacucuuuggcgcuauugccggguucaucgaaggaggcuggaccgggaugguggacggaugguacggcuaucaucaccaaaaugagcagggcucuggguacgccgcugaccugaaaagcacgcagaacgcgaucgauaagauuacaaauaaagucaacuccgugaucgagaagaugaauacccaguuuaccgccguuggaaaagaguucaaccaccuugagaagagaauugaaaaucugaacaagaaaguggacgauggcuuccucgacaucuggacauacaaugcugagcugcugguccuccuggaaaacgagcggacccuugauuaucaugacagcaaugugaagaaccuguacgagaaaguccgcaaccaacucaagaauaacgccaaagaaauugggaauggauguuuugaguucuaucacaagugcgauaacacauguauggaaucugugaagaauggcacguacgacuauccuaaauacuccgaggaagccaagcugaacagagagaaaaucgaugggguuaaacuugagagcacccggaucuaucagauucuggcuaucuacucuacaguggccuccagccucguccuggugguuucccugggcgcgauuugcuuuuggaugugcucuaauggaagccuccagugucgcaucugcauuuga

SEQ ID NO: 195624 - RNA, 1701 nt, Artificial Sequence; identical to SEQ ID NO: 195608
  derived and/or modified sequence opt5 from hemagglutinin__InfluenzaA__AIL93858

SEQ ID NO: 195625 - RNA, 1701 nt, Artificial Sequence; identical to SEQ ID NO: 193018
  derived and/or modified sequence opt5 from hemagglutinin__InfluenzaA__AIL93870

SEQ ID NO: 195626 - RNA, 1701 nt, Artificial Sequence
  derived and/or modified sequence opt5 from hemagglutinin__InfluenzaA__AIL93882
augaagaccaucauugcccugagcuacauccucugccugguguucgcucagaaacccccuggcaacgacaauuccacagccacgcuuugucuggggcaccaugcggucccgaacggaaccauuguuaagacaaucaccaaugauagaauugaggugacaaacgcuaccgaacucgugcaaaauucuagcaucggcgagaucugcgacucuccccaccagauucuggauggggaaaacuguacacuuaucgacgcccugcucggagauccucagugcgacggcuuucagaauaaaaagugggaucuguucgucgagcgguccaaagccuauagcaacuguuaccccuaugacgugccugauuacgcuucccugcgcucucucguugccagcuccgggacccuggaauuuaauaacgagagcuucaauugggcuggagugacgcaaaacggcaccucuuccgccugcauuagaggcagcaauucuuccuuuuucagccggcuuaacuggcugacacaucucaauuuuaaguaucccgcgcugaacgucaccaugccuaacaaugagcaguucgacaaacuuuacaucuggggagugcaccauccggggacagauaaggaccagauuuuucuguaugcccagucuuccggccgcaucaccguuagcacgaagagaucccaacaggcugugauucccaacaucgggucucggccucgcaucagaaauauucccagccggaucuccauuuacuggacaaucgucaaaccuggagauauucuccugaucaacagcaccggcaaucugaucgcuccccgcggguacuucaagauuagaucuggaaaauccagcaucaugcggucugacgccccgauuggcaaguguaagagcgaaugcaucacaccuaacggcuccauucccaaugacaaaccuuuucagaacgugaaucgcaucaccuauggggccugucccagauacgugaagcagucuacccucaaacuggcgacaggaaugcggaacguccccgagaagcaaacgcgcggcaucuucggggccauugcuggauuuaucgaaaauggcugggaggggaugguugauggaugguauggcuucagacaccagaacagcgagggccgggggcaggccgcugaccuuaaauccacccaagccgccauugaucagaucaauggaaagcugaacagacucauuggcaaaacaaaugaaaaguuccaccagaucgagaaggaauuuagcgagguggaagggcgcauucaggaccuggagaaauacguggaggauaccaagaucgaccuuuggucuuauaacgcugaacugcucgucgcgcuggagaaccaacauacaaucgaucugaccgacuccgaaaugaauaaacucuucgagaagacgaaaaagcagcugcgggaaaacgccgaggauaugggaaauggcugcuuuaagauuuaccacaaaugugacaacgcuugcaucgggagcauuagaaauggcacauaugaucaugacguguaccgcgacgaggcccuuaacaaucgguuccagaucaagggaguugaacugaaaucuggcuacaaggauuggauucucuggaucuccuuugccaucagcugcuuccugcuuuguguggcucugcucggguuuauuaugugggccugccagaaaggaaacaucagauguaauauuugcaucuga

SEQ ID NO: 195627 - RNA, 1701 nt, Artificial Sequence; identical to SEQ ID NO: 193018
  derived and/or modified sequence opt5 from hemagglutinin__InfluenzaA__AIL93894

SEQ ID NO: 195628 - RNA, 1701 nt, Artificial Sequence
  derived and/or modified sequence opt5 from hemagglutinin__InfluenzaA__AIL93906
augaaggccauccuggugguccuccuguacaccuucgcuacagccaacgcggacacgcuuugcauuggcuaucacgcuaauaacagcaccgauacaguugacaccgugcuggagaagaaugugacagucacccauuccaucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucaauuacgaagaacugcgggagcagcuuuccagcgugucuuccuucgaacgcuuugagauguuccccaagaccagcucuuggccuaaccacgacuccaauaagggagucacagccgcuuguccccaugccggcgcgaaaucuuuuuauaagaaccugaucuggcucgugaaaaagggcaauagcuacccuaaacuguccaagagcuauauuaacgauaaggggaaagaaguucuugugcuguggggaauccaccaccccuccaccacagccgaccaacagucucucuaccagaaugcugaugccuacgucuucgugggcaccagcaaguauuccaaaaaguuuaaaccugagauugcuaucagaccgaaggugcgggaccaggaggggcgcaugaacuacuauuggacgcugauugaacccggagauaaaaucacauucgaggccaccggcaaccuggucguuccuagauacgcguuugccauggaacggaaugcugggagcggaauuaucaucucugacacacccgugcaugauugcaacaccaccugucaaacaccugagggcgccauuaauacgucccuccccuuccagaacauccacccgauuaccaucggcaagugcccuaaguaugugaaaagcacaaagcugcgccuugcuaccgggcugagaaauguccccucuauucagagccggggacucuuuggcgccaucgccggguucaucgaaggaggcuggacagggaugguggacggaugguacggcuaucaucaccagaacgagcaaggcuccggguacgcugcggaccugaaaucuacccagaaugccauugauaagaucacgaacaaaguuaauagcgugauugagaagaugaacacacaguuuaccgcugucggaaaggaguucaaucaccuugagaaacgcaucgaaaaccugaauaagaaaguggacgauggcuuccucgacauuuggaccuacaacgccgagcugcugguucuccuggaaaaugagagaacacuugauuaucaugacuccaacgugaagaaccuguacgagaaaguccggaaucagcucaagaacaaugccaaggaaaucgggaacggauguuuugaguucuaucacaaaugcgauaauaccuguauggaaagcgugaagaacggcacauacgacuauccuaaauacucugaggaagcuaagcugaaucgcgagaaaaucgauggggucaaacuugaguccacgagaauuuaucaaauccuggccauuuacagcaccguggcgucuucccucguucugguggucagccugggcgcuaucuccuuuuggaugugcucuaacggaagccuccagugccggauuuguaucuga

SEQ ID NO: 195629 - RNA, 1701 nt, Artificial Sequence
  derived and/or modified sequence opt5 from hemagglutinin__InfluenzaA__AIL93917
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgaccggccgcaccagauucuugauggggaaaacuguacacugaucgacgcccuccugggagauccccagugcgacggcuuucagaauaaaaagugggaucuguucgucgagcgcuccaaagccuauucuaacuguuacccuuaugacgugcccgauuacgcuagccucagaucccugguugccucuagcgggacccuugaauuuaauaacgaguccuucaauugggcuggagugacgcaaaacggcaccagcucugccugcauucggggcuccaauagcuccuuuuucucucgccugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagagcucuggcagaaucaccguuuccacgaagcggagccaacaggcugugauuccgaacaucgggucccgccccagaauccggaauauuccuucucgcaucagcauuuacuggacaaucgucaaacccggagauauucugcugaucaacuccaccggcaaucucaucgccccuagaggguacuucaagauucggagcggaaaaucuuccaucaugcgcagcgacgcucccauuggcaaguguaagucugaaugcaucacaccgaacggcagcauuccuaaugacaaacccuuucagaacgugaauagaaucaccuauggggccuguccucgguacgugaagcaguccacccugaaacuugcgacaggaaugcgcaacguccccgagaagcaaacgagaggcaucuucggggccauugcuggauuuaucgaaaauggcugggaggggaugguugauggaugguauggcuuccggcaccagaacucugagggcagagggcaggccgcugaccugaaaagcacccaagccgccauugaucagaucaauggaaagcucaaccgccugauuggcaaaacaaaugaaaaguuccaccagaucgagaaggaauuuuccgagguggaagggcggauucaggaccuugagaaauacguggaggauaccaagaucgaccuguggagcuauaacgcugaacuccuggucgcgcuggagaaccaacauacaaucgaucucaccgacucugaaaugaauaaacuguucgagaagacgaaaaagcagaugagagaaaacgccgaggauaugggaaauggcugcuuuaagauuuaccacaaaugugacaacgcuugcaucggguccauucgcaauggcacauaugaucaugacguguaccgggacgaggcccuuaacaauagauuccagaucaagggaguugaacugaaaagcggcuacaaggauuggauucucuggaucucuuuugccaucuccugcuuccugcuuuguguggcucugcucggguuuauuaugugggccugccagaaaggaaacauccgcuguaauauuugcaucuga

SEQ ID NO: 195630 - RNA, 1701 nt, Artificial Sequence; identical to SEQ ID NO: 193064
  derived and/or modified sequence opt5 from hemagglutinin__InfluenzaA__AIL93929

SEQ ID NO: 195631 - RNA, 1701 nt, Artificial Sequence
  derived and/or modified sequence opt5 from hemagglutinin__InfluenzaA__AIL93940
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguuucuccccuccaucugggcaaaugcaacaucgccggguggauucugggaaauccugagugugaaagccucuccacagccucuagcugguccuacaucguggagaccucuagcuccgacaacggcacgugcuauccgggggauuuuauuaauuacgaagaacugcgggagcagcuuagcucugucuccagcuucgaacgcuuugagaucuuccccaagaccucuuccuggccuaaccacgacagcaauaagggagugacagcugccuguccccaugcuggcgccaaaucuuuuuauaagaaccugaucuggcucguuaaaaagggcaauuccuacccuaaacugagccaauccuauauuaacgauaaggggaaggaagugcuuguccuguggggaauccaccaccccucuaccacagcggaccagcagagccucuaccagaaugccgaugcuuacguguucgugggcaccuccagauauagcaaaaaguuuaaaccugagauugccauccggccgaagguccgcgaccaagaggggagaaugaacuacuauuggacgcugguugaacccggagauaaaauuacauucgaggcuaccggcaaccugguggugccucgguacgccuuuacaauggaacgcaaugcggggucuggaaucauuaucuccgacacccccguccaugauugcaacaccacaugucagacgccugagggcgccaucaauaccagccuccccuuccagaacauucacccgaucacaauuggcaagugcccuaaauaugugaagucuaccaagcugagacuugcuacagggcugcggaauguucccagcauccagucccgcggacucuuuggcgccauugcuggguucaucgaaggaggcuggaccgggaugguggacggaugguacggcuaucaucaccaaaacgagcagggcucuggguacgccgccgaccugaaaagcacgcagaaugcuaucgauaagauuacaaacaaagucaauuccgugaucgagaagaugaacacccaguuuaccgcgguuggaaaagaguucaaucaccuugagaagagaauugaaaaccugaauaagaaaguggacgauggcuuccucgacaucuggacauacaacgccgagcugcugguccuccuggaaaaugagcggacccuugauuaucaugacagcaacgugaagaaccuguacgagaaaguccgcaaucaacucaagaacaaugcuaaagaaauugggaacggauguuuugaguucuaucacaagugcgauaauacauguauggaaucugugaagaacggcacguacgacuauccuaaauacuccgaggaagccaagcugaauagagagaaaaucgaugggguuaaacuugagagcacccggaucuaucagauucuggccaucuacucuacaguggcuuccagccucguccuggugguuucccugggcgccauuucuuuuuggaugugcagcaacggaucccuccagugccgcaucuguauuuga

SEQ ID NO: 195632 - RNA, 1701 nt, Artificial Sequence; identical to SEQ ID NO: 193018
  derived and/or modified sequence opt5 from hemagglutinin__InfluenzaA__AIL93951

SEQ ID NO: 195633 - RNA, 1701 nt, Artificial Sequence; identical to SEQ ID NO: 193018
  derived and/or modified sequence opt5 from hemagglutinin__InfluenzaA__AIL93963

SEQ ID NO: 195634 - RNA, 1701 nt, Artificial Sequence; identical to SEQ ID NO: 192882
  derived and/or modified sequence opt5 from hemagglutinin__InfluenzaA__AIL93975

SEQ ID NO: 195635 - RNA, 1701 nt, Artificial Sequence; identical to SEQ ID NO: 195611
  derived and/or modified sequence opt5 from hemagglutinin__InfluenzaA__AIL93987

SEQ ID NO: 195636 - RNA, 1701 nt, Artificial Sequence; identical to SEQ ID NO: 193018
  derived and/or modified sequence opt5 from hemagglutinin__InfluenzaA__AIL93998

SEQ ID NO: 195637 - RNA, 1701 nt, Artificial Sequence; identical to SEQ ID NO: 195608
  derived and/or modified sequence opt5 from hemagglutinin__InfluenzaA__AIL94010

SEQ ID NO: 195638 - RNA, 1701 nt, Artificial Sequence; identical to SEQ ID NO: 195608
  derived and/or modified sequence opt5 from hemagglutinin__InfluenzaA__AIL94022

SEQ ID NO: 195639 - RNA, 1701 nt, Artificial Sequence
  derived and/or modified sequence opt5 from hemagglutinin__InfluenzaA__AIL94046
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgaccggccgcaccagauucuugauggggaaaacuguacacugaucgacgcccuccugggagauccccagugcgacggcuuucagaauaaaaagugggaucuguucgucgagcgcuccaaagccuauucuaacuguuacccuuaugacgugcccgauuacgcuagccucagaucccugguugccucuagcgggacccuugaauuuaauaacgaguccuucaauugggcuggagugacgcaaaacggcaccagcucugccugcauucggggcuccaauagcuccuuuuucucucgccugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagagcucuggcagaaucaccguuuccacgaagcggagccaacaggcugugauuccgaacaucgggucccgccccagaauccggaauauuccuucucgcaucagcauuuacuggacaaucgucaaacccggagauauucugcugaucaacuccaccggcaaucucaucgccccuagaggguacuucaagauucggagcggaaaaucuuccaucaugcgcagcgacgcucccauuggcaaguguaagucugaaugcaucacaccgaacggcagcauuccuaaugacaaacccuuucagaacgugaauagaaucaccuauggggccuguccucgguacgugaagcaguccacccugaaacuugcgacaggaaugcgcaacguccccgagaagcaaacgagaggcaucuucggggccauugcuggauuuaucgaaaauggcugggaggggaugguugauggaugguauggcuuccggcaccagaacucugagggcagagggcaggccgcugaccugaaaagcacccaagccgccauugaucagaucaauggaaagcucaaccgccugauuggcaaaacaaaugaaaaguuccaccagaucgagaaggaauuuuccgagguggaagggcggauucaggaccuugagaaauacguggaggauaccaagaucgaccuguggagcuauaacgcugaacuccuggucgcgcuggagaaccaacauacaaucgaucucaccgacucugaaaugaauaaacuguucgagaagacgaaaaagcagcuuagagaaaacgccgaggauaugggaaauggcugcuuuaagauuuaccacaaaugugacaacgcuugcaucggguccauucgcaauggcacauaugaucaugacguguaccgggacgaggcccugaacaauagauuccagaucaagggaguugaacucaaaagcggcuacaaggauuggauucuguggaucucuuuugccaucuccugcuuccuucuguguguggcucuccugggguuuauuaugugggccugccagaaaggaaacauccgcuguaauauuugcaucuga

SEQ ID NO: 195640 - RNA, 1701 nt, Artificial Sequence
  derived and/or modified sequence opt5 from hemagglutinin__InfluenzaA__AIL94058
augaaggccauccuggugguccuccuguacaccuucgcucccgccaacgcggacacacuuugcauuggcuaucacgcuaauaacagcacggauaccguugacacagugcuggagaagaaugugaccgucacacauuccgugaaccuccuggaagauaagcacaaugggaaacuuuguaagcugagaggaguugccccucuccaucugggcaaaugcaacaucgccggguggauucugggaaauccggagugugaaucucucagcaccgcuuccucuuggagcuacaucguggagacauccucuagcgacaacgggaccugcuaucccggcgauuuuauuaauuacgaagaacugcgggagcagcuuuccagcgucucuuccuucgaacgcuuugagaucuucccuaagacgagcucuuggcccaaccacgacuccaauaagggagugaccgccgcuuguccucaugccggcgcgaaaucuuuuuauaagaaccugaucuggcucguuaaaaagggcaauagcuaccccaaacugucccaaagcuauauuaacgauaaggggaaggaagugcuuguccuguggggaauccaccacccuuccacaaccgccgaccagcagucucucuaccagaaugcugaugccuacguguucgugggcacaagcagauauuccaaaaaguuuaaaccggagauugcuauccggcccaagguccgcgaccaagaggggagaaugaacuacuauuggacccugguugaaccuggagauaaaauuacguucgaggccacaggcaaccugguggugccccgguacgcguuuaccaucgaacgcagcgccgggucuggaauuaucaucuccgacacaccuguccaugauugcaauaccaccugucagacacccgagggcgcuauuaacacgagccucccguuccagaauauccacccuauuaccaucggcaagugccccaaauaugugaagucuacaaagcugagacuugccaccgggcugcggaacguuccuagcauucagucccgcggacucuuuggcgcuaucgccggguucaucgaaggaggcuggacagggaugguggacggaugguacggcuaucaucaccaaaaugagcagggcucuggguacgccgcugaccugaaaagcacccagaacgcgauugauaagaucacgaauaaagucaacuccgugauugagaagaugaauacacaguuuaccgccguuggaaaagaguucaaccaccuugagaagagaaucgaaaaucugaacaagaaaguggacgauggcuuccucgacauuuggaccuacaaugcugagcugcugguccuccuggaaaacgagcggacacuugauuaucaugacagcaaugugaagaaccuguacgagaaaguccgcaaccaacucaagaauaacgccaaagaaaucgggaauggauguuuugaguucuaucacaagugcgauaacaccuguauggaaucugugaagaauggcacauacgacuaucccaaauacuccgaggaagccaagcugaacagagagaaaaucgaugggguuaaacuugagagcacgcggauuuaucagauccuggcuauuuacucuaccguggccuccagccucguccuggugguuucccugggcgcgaucucuuuuuggaugugcagcaauggaucccuccagugccgcauuuguaucuga

SEQ ID NO: 195641 - RNA, 1701 nt, Artificial Sequence; identical to SEQ ID NO: 195611
  derived and/or modified sequence opt5 from hemagglutinin__InfluenzaA__AIL94069

SEQ ID NO: 195642 - RNA, 1701 nt, Artificial Sequence; identical to SEQ ID NO: 193064
  derived and/or modified sequence opt5 from hemagglutinin__InfluenzaA__AIL94080

SEQ ID NO: 195643 - RNA, 1701 nt, Artificial Sequence; identical to SEQ ID NO: 195608
  derived and/or modified sequence opt5 from hemagglutinin__InfluenzaA__AIL94235

SEQ ID NO: 195644 - RNA, 1701 nt, Artificial Sequence; identical to SEQ ID NO: 193064
  derived and/or modified sequence opt5 from hemagglutinin__InfluenzaA__AIL94247

SEQ ID NO: 195645 - RNA, 1701 nt, Artificial Sequence
  derived and/or modified sequence opt5 from hemagglutinin__InfluenzaA__AIL94258
augaagaccaucauugcccugagcuacauccucugccugguguucacacagaaacuucccggcaacgacaauuccacggcuacccugugucucgggcaccaugccgucccuaacggaacaauuguuaagaccaucacaaaugauagaauugaggugaccaacgcgacagaacuggugcaaaauucuagcaucggcgagaucugcgacuccccgcaccagauucuugauggggaaaacuguacccugaucgacgcucuccugggagauccccagugcgacggcuuucagaauaaaaagugggaucuguucgucgagcggucuaaagccuauagcaacuguuacccuuaugacgugcccgauuacgccucccuccgcucucugguugcuagcuccgggacgcuugaauuuaauaacgagagcuucaauugggccggagugacccaaaacggcacaucuuccgcuugcauuagaggcagcaauucuuccuuuuucagccggcugaacuggcucacccaucugaauuuuaaguauccugcccuuaacgucacaaugcccaacaaugagcaguucgacaagcuguacaucuggggagugcaccauccugggaccgauaaagaccagauuuuucucuaugcgcagucuuccggccgcaucacgguuagcacaaagagaucccaacaggccgugauuccgaacaucgggucucggccccgcaucagaaauauuccuagccggaucuccauuuacuggaccaucgucaaacccggagauauucugcugaucaacagcacaggcaaucucaucgcuccucgcggguacuucaagauuagaucuggaaaauccagcaucaugcggucugacgcccccauuggcaaguguaagagcgaaugcaucaccccgaacggcuccauuccuaaugacaaacccuuucagaacgugaaucgcaucaccuauggggcuuguccuagauacgugaagcagucuacacugaaacuugccacgggaaugcggaacguccccgagaagcaaacccgcggcaucuucggggcgauugccggauuuaucgaaaauggcugggaggggaugguugauggaugguauggcuucagacaccagaacagcgagggccgggggcaggcugccgaccugaaauccacacaagcugccauugaucagaucaauggaaagcucaacagacugauuggcaaaaccaaugaaaaguuccaccagaucgagaaggaauuuagcgagguggaagggcgcauucaggaccuugagaaauacguggaggauacaaagaucgaccuguggucuuauaacgccgaacuccuggucgcucuggagaaccaacauaccaucgaucucacggacuccgaaaugaauaaacuguucgagaagaccaaaaagcagcuucgggaaaacgcggaggauaugggaaauggcugcuuuaagauuuaccacaaaugugacaacgccugcaucgggagcauuagaaauggcacauaugaucaugacguguaccgcgacgaggcucugaacaaucgguuccagaucaagggaguugaacucaaaucuggcuacaaggauuggauucuguggaucuccuuugccaucagcugcuuccuucuguguguggcccuccugggguuuauuaugugggcuugccagaaaggaaacaucagauguaauauuugcaucuga

SEQ ID NO: 195646 - RNA, 1701 nt, Artificial Sequence
  derived and/or modified sequence opt5 from hemagglutinin__InfluenzaA__AIL94270
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaacagcgaaugcaucacaccgaauggcuccauuccuaacgacaagcccuuucagaaugugaaccgcaucaccuauggggccuguccuagauacgugaaacagucuacccugaaacuugcgacaggaaugcggaauguccccgagaagcaaacgcgcggcaucuucggggccauugcuggauuuaucgaaaacggcugggaggggaugguugauggaugguauggcuucagacaccagaauagcgagggccgggggcaggccgcugaccugaaguccacccaagccgccauugaucagaucaacggaaaacucaauagacugauuggcaagacaaacgaaaaauuccaccagaucgagaaggaauuuagcgagguggaagggcgcauucaggaccuugagaaguacguggaggauaccaaaaucgaccuguggucuuauaacgcugaacuccuggucgcgcuggagaaucaacauacaaucgaucucaccgacuccgaaaugaacaagcuguucgagaaaacgaagaaacagcuucgggaaaaugccgaggauaugggaaacggcugcuuuaagauuuaccacaagugugacaaugcuugcaucgggagcauuagaaacggcacauaugaucaugacguguaccgcgacgaggcccugaauaaccgguuccagaucaaaggaguugaacucaagucuggcuacaaagauuggauucuguggaucuccuuugccaucagcugcuuccuucuguguguggcucuccugggguuuauuaugugggccugccagaagggaaauaucagauguaacauuugcaucuga

SEQ ID NO: 195647 - RNA, 1701 nt, Artificial Sequence; identical to SEQ ID NO: 193018
  derived and/or modified sequence opt5 from hemagglutinin__InfluenzaA__AIL94282

SEQ ID NO: 195648 - RNA, 1701 nt, Artificial Sequence; identical to SEQ ID NO: 193018
  derived and/or modified sequence opt5 from hemagglutinin__InfluenzaA__AIL94294

SEQ ID NO: 195649 - RNA, 1701 nt, Artificial Sequence
  derived and/or modified sequence opt5 from hemagglutinin__InfluenzaA__AIL94306
augaagaccaucacagcccugagcuacauucucugccuggcuuucgcccagaaacccccuggcaacgacaauuccacggcgacccuuugucuggggcaccaugcugugccgaacggaacaaucgucaagaccauuacaaaugauagaaucgagguuaccaacgccacagaacucgugcaaaauucuagcauuggcgagaucugcgacucuccccaccagauccuggauggggaaaacuguacccuuauugacgcccugcucggagauccucagugcgacggcuuucagaauaaaaagugggaucuguucguggagcgguccaaggcuuauagcaacuguuaccccuaugacgucccugauuacgccucccugcgcucucucguggcuagcuccgggacgcuggaauuuaauaacgagagcuucaauugggccggaguuacccaaaacggcacaucuuccgcgugcaucagaggcagcaauucuuccuuuuucagccggcuuaacuggcugacccaucucaauuuuaaguaucccgcccugaacgugacaaugccuaacaaugagcaguucgacaaacuuuacauuuggggaguccaccauccggggaccgauaaagaccagaucuuucuguaugcucagucuuccggccgcauuacggugagcacaaagagaucccaacaggccguuauccccaacauugggucucggccucgcaucagaaauauccccagccggauuuccaucuacuggaccauugugaaaccuggagauauccuccugauuaacagcacaggcaaucugaucgcuccccgcggguacuucaagaucagaucuggaaaauccagcauuaugcggucugacgccccgaucggcaaguguaagagcgaaugcauuaccccuaacggcuccauccccaaugacaaaccuuuucagaacgucaaucgcauuaccuauggggcgugucccagauacgugaagcagucuacacucaaacuggccacgggaaugcggaacgugcccgagaagcaaacccgcggcaucuucggggcuaucgccggauuuauugaaaauggcugggaggggauggucgauggaugguauggcuucagacaccagaacagcgagggccgggggcaggcugccgaccuuaaauccacacaagccgcuaucgaucagauuaauggaaagcugaacagacucaucggcaaaaccaaugaaaaguuccaccagauugagaaggaauuuagcgagguugaagggcgcauccaggaccuggagaaauacguggaggauacaaagauugaccuuuggucuuauaacgcggaacugcucguggcccuggagaaccaacauaccaucgaucugacggacuccgaaaugaauaaacucuucgagaagaccaaaaagcagcugcgggaaaacgcugaggauaugggaaauggcugcuuuaagaucuaccacaaaugugacaacgccugcauugggagcaucagaaauggcacauaugaucaugacgucuaccgcgacgaggcccuuaacaaucgguuccagauuaagggaguggaacugaaaucuggcuacaaggauuggauccucuggauuuccuuugcuaucagcugcuuccugcuuuguguugcccugcucggguuuaucaugugggcgugccagaaaggaaacauuagauguaauaucugcauuuga

SEQ ID NO: 195650 - RNA, 1701 nt, Artificial Sequence
  derived and/or modified sequence opt5 from hemagglutinin__InfluenzaA__AIL94318
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagucuacacugaaacuugccacggggaugcgcaacguccccgagaagcaaaccagaggaaucuucggcgcgauugccggguuuaucgaaaauggaugggagggcaugguugaugggugguauggauuccggcaccugaacagcgagggcagaggccaggcugccgaccucaaauccacacaggcugccauugaucaaaucaaugggaagcugaaccgccuuauuggaaaaaccaaugaaaaguuccaccagaucgagaaggaauuuagcgagguggaaggccggauucaggaccuggagaaauacguggaggauacaaagaucgaccucuggucuuauaacgccgaacugcuggucgcucucgagaaccagcauaccaucgaucugacggacuccgaaaugaauaaacuuuucgagaagaccaaaaagcaacugagagaaaacgcggaggauauggggaauggaugcuuuaagauuuaccacaaaugugacaacgccugcaucggcagcauucgcaaugggacauaugaucauaacguguaccgggacgaggcucucaauaacagauuccagaucaagggcguugaacugaaaucuggauacaaggacuggauucuuuggaucuccuuugccaucagcugcuuccugcucuguguggcccugcugggcuuuauuaugugggcuugccagaaagggaauauccgcuguaacauuugcaucuga

SEQ ID NO: 195651 - RNA, 1701 nt, Artificial Sequence; identical to SEQ ID NO: 192882
  derived and/or modified sequence opt5 from hemagglutinin__InfluenzaA__AIL94330

SEQ ID NO: 195652 - RNA, 1701 nt, Artificial Sequence; identical to SEQ ID NO: 193064
  derived and/or modified sequence opt5 from hemagglutinin__InfluenzaA__AIL94354

SEQ ID NO: 195653 - RNA, 1701 nt, Artificial Sequence; identical to SEQ ID NO: 193018
  derived and/or modified sequence opt5 from hemagglutinin__InfluenzaA__AIL94365

SEQ ID NO: 195654 - RNA, 1701 nt, Artificial Sequence
  derived and/or modified sequence opt5 from hemagglutinin__InfluenzaA__AIL94377
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccauugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcagaacggcaccucuuccgccugcauuagaggcagcaauucuuccuuuuucagccggcugaacuggcucacacaccugaauuuuaaguauccugcgcuuaacgucaccaugcccaacaaugagcaauucgacaagcuguacaucuggggagugcaucacccugggacagauaaagaccagauuuuucucuaugcccagucuuccggccgcaucaccguuagcacgaagagaucccagcaagcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcagacgcgcggcaucuucggggccauugcuggauuuaucgaaaauggcugggaggggaugguugauggaugguauggcuucagacaccaaaacagcgagggccgggggcaggccgcugaccugaaauccacccaggccgccauugaucaaaucaauggaaagcucaacagacugauuggcaaaacaaaugaaaaguuccaucagaucgagaaggaauuuagcgagguggaagggcgcauucaggaccuugagaaauacguggaggauaccaagaucgaccuguggucuuauaacgcugaacuccuggucgcgcuggagaaccagcacacaaucgaucucaccgacuccgaaaugaauaaacuguucgagaagacgaaaaagcaacuucgggaaaacgccgaggauaugggaaauggcugcuuuaagauuuaccauaaaugugacaacgcuugcaucgggagcauuagaaauggcacauaugaucacgacguguaccgcgacgaggcccugaacaaucgguuccagaucaagggaguugaacucaaaucuggcuacaaggauuggauucuguggaucuccuuugccaucagcugcuuccuucuguguguggcucuccugggguuuauuaugugggccugccagaaaggaaacaucagauguaauauuugcaucuga

SEQ ID NO: 195655 - RNA, 1701 nt, Artificial Sequence
  derived and/or modified sequence opt5 from hemagglutinin__InfluenzaA__AIL94389
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauauguuaagagcaccaagcugagacuugccacagggcugcggaaugugcccucuauccagagccgcggacucuuuggcgcuauugccggguucaucgaaggaggcuggaccgggaugguggacggaugguacggcuaucaucaccaaaacgagcagggcuccggguacgccgcugaccugaaaucuacgcagaaugcgaucgauaagauuacaaacaaagucaauagcgugaucgagaagaugaacacccaguuuaccgccguuggaaaagaguucaaucaccuugagaagagaauugaaaaccugaauaagaaaguggacgauggcuuccucgacaucuggacauacaacgcugagcugcugauucuccuggaaaaugagcggacccuugauuaucaugacuccaacgucaagaaccuguacgagaaagugcgcaaucaacucaagaacaaugccaaagaaaucgggaacggauguuuugaguucuaucacaagugcgauaauacauguauggaaagcgucaagaacggcacguacgacuauccuaaauacucugaggaagccaagcugaauagagagaaaaucgauggggugaaacuugaguccacccggauuuaucagauccuggcuauuuacagcacaguugccucuucccucgugcuggucgugagccugggcgcgaucuccuuuuggaugugcucuaacggaagccuccagugccgcauuuguaucuga

SEQ ID NO: 195656 - RNA, 1701 nt, Artificial Sequence; identical to SEQ ID NO: 193018
  derived and/or modified sequence opt5 from hemagglutinin__InfluenzaA__AIL94411

SEQ ID NO: 195657 - RNA, 1701 nt, Artificial Sequence; identical to SEQ ID NO: 193018
  derived and/or modified sequence opt5 from hemagglutinin__InfluenzaA__AIL94423

SEQ ID NO: 195658 - RNA, 1701 nt, Artificial Sequence; identical to SEQ ID NO: 195611
  derived and/or modified sequence opt5 from hemagglutinin__InfluenzaA__AIL94435

SEQ ID NO: 195659 - RNA, 1701 nt, Artificial Sequence; identical to SEQ ID NO: 193018
  derived and/or modified sequence opt5 from hemagglutinin__InfluenzaA__AIL94446

SEQ ID NO: 195660 - RNA, 1701 nt, Artificial Sequence; identical to SEQ ID NO: 193018
  derived and/or modified sequence opt5 from hemagglutinin__InfluenzaA__AIL94458

SEQ ID NO: 195661 - RNA, 1701 nt, Artificial Sequence
  derived and/or modified sequence opt5 from hemagglutinin__InfluenzaA__AIL94470
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccgcucaugauugcaacaccacaugucagacgccugagggcgccaucaauaccucccuccccuuccagaacauucacccgaucacaauuggcaagugcccuaaauaugucaagagcaccaagcugagacuugcuacagggcugcggaaugugcccucuauccagagccgcggacucuuuggcgccauugccggguucaucgaaggaggcuggaccgggaugguugacggaugguacggcuaucaucaccaaaacgagcagggcuccggguacgcugcggaccugaaaucuacgcagaaugccaucgauaagauuacaaacaaagugaauagcgucaucgagaagaugaacacccaguuuaccgcugugggaaaagaguucaaucaccuugagaagagaauugaaaaccugaauaagaaaguugacgauggcuuccucgacaucuggacauacaacgccgagcugcuggugcuccuggaaaaugagcggacccuugauuaucaugacuccaacgucaagaaccuguacgagaaagugcgcaaucaacucaagaacaaugccaaagaaauugggaacggauguuuugaguucuaucacaagugcgauaauacauguauggaaagcgucaagaacggcacguacgacuauccuaaauacucugaggaagcuaagcugaauagagagaaaaucgauggggugaaacuugaguccacccggaucuaucagauucuggccaucuacagcacaguugcgucuucccucgugcuggucgugagccugggcgcuauuuccuuuuggaugugcucuaacggaagccuccagugccgcaucuguauuuga

SEQ ID NO: 195662 - RNA, 1701 nt, Artificial Sequence
  derived and/or modified sequence opt5 from hemagglutinin__InfluenzaA__AIL94481
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugguugauggaugguauggcuucagacaccagaacagcgagggccgggggcaggccgcugaccugaaauccacccaagccgccauugaucagaucaauggaaagcucaacagacugauuggcaaaacaaaugaaaaguuccaccagaucgagaaggaauuuagcgagguggaagggcgcauucaggaccuugagaaauacguggaggauaccaagaucgaccuguggucuuauaacgcugaacuccuggucgcgcuggagaaccaacauacaaucgaucucaccgacuccgaaaugaauaaacuguucgagaagacgaaaaagcagcuucgggaaaacgccgaggauaugggaaauggcugcuuuaagauuuaccacaaaugugacaacgcuugcaucgggagcauuagaaauggcacauaugaucaugacguguaccgcgacgaggcccugaacaaucgguuccagaucaagggaguugaacucaaaucuggcuacaaggauuggauuaucuggaucuccuuugccauuagcugcuuccugcuuuguguggcucugcucggguuuaucaugugggccugccagaaaggaaacauuagauguaauaucugcauuuga

SEQ ID NO: 195663 - RNA, 1701 nt, Artificial Sequence
  derived and/or modified sequence opt5 from hemagglutinin__InfluenzaA__AIL94493
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaaaagaaugccgggagcggaaucauuaucucugacacccccguccaugauugcaacaccacaugucagacgccugagggcgcuaucaauaccuccuuccccuuucagaacauucacccgaucacaauuggcaaaugcccuaaguauguuaagagcaccaaacuccgccuggccacagggcuuagaaaugugcccucuauccagagccggggacuguucggcgcuauugccggguuuaucgaaggaggcuggaccgggaugguggacggaugguacggcuaucaucaccaaaacgagcagggcuccggguacgccgcugaccucaagucuacgcagaaugcgaucgauaaaauuacaaacaaggucaauagcgugaucgagaaaaugaacacccaguucaccgccguuggaaaggaguucaaucaccuggagaagcgcauugaaaaccuuaauaaaaagguggacgauggcuuucuggacaucuggacauacaacgcugagcuccugguccugcucgaaaaugagagaacccuggauuaucaugacuccaacgugaaaaaccuuuacgagaagguccggaaucaacugaaaaacaaugccaaggaaauugggaacggauguuucgaguuuuaucacaagugcgauaauacauguauggaaagcgugaaaaacggcacguacgacuauccuaaguacucugaggaagccaaacucaaucgcgagaagaucgaugggguuaaacuggaguccaccagaaucuaucagauucuugcuaucuacagcacaguggccucuucccugguccucgugguuagccugggcgcgauuuccuucuggaugugcucuaacggaagccugcagugccggaucuguauuuga

SEQ ID NO: 195664 - RNA, 1701 nt, Artificial Sequence; identical to SEQ ID NO: 195611
  derived and/or modified sequence opt5 from hemagglutinin__InfluenzaA__AIL94504

SEQ ID NO: 195665 - RNA, 1701 nt, Artificial Sequence; identical to SEQ ID NO: 193018
  derived and/or modified sequence opt5 from hemagglutinin__InfluenzaA__AIL94515

SEQ ID NO: 195666 - RNA, 1701 nt, Artificial Sequence; identical to SEQ ID NO: 193018
  derived and/or modified sequence opt5 from hemagglutinin__InfluenzaA__AIL94527

SEQ ID NO: 195667 - RNA, 1701 nt, Artificial Sequence
  derived and/or modified sequence opt5 from hemagglutinin__InfluenzaA__AIL94539
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccgcucaugauugcaacaccacaugucagacgccugagggcgccaucaauaccucccuccccuuccagaacauucacccgaucacaauuggcaagugcccuaaauaugucaagagcaccaagcugagacuugcuacagggcugcggaaugugcccucuauccagagccgcggacucuuuggcgccauugccggguucaucgaaggaggcuggaccgggaugguugacggaugguacggcuaucaucaccaaaacgagcagggcuccggguacgcugcggaccugaaaucuacgcagaaugccaucgauaagauuacaaacaaagugaauagcgucaucgagaagaugaacacccaguuuaccgcugugggaaaagaguucaaucaccuugagaagagaauugaaaaccugaauaagaaaguugacgauggcuuccucgacaucuggacauacaacgccgagcugcuggugcuccuggaaaaugagcggacccuugauuaucaugacuccaacgucaagaaccuguacgagaaagugcgcaaucaacucaagaacaaugccaaagaagucgggaacggauguuuugaguucuaucacaagugcgauaauacauguauggaaagcgugaagaacggcacguacgacuauccuaaauacucugaggaagcuaagcugaauagagagaaaauugaugggguuaaacuugaguccacccggaucuaucagauccuggccauuuacagcacaguggcgucuucccucguccuggugguuagccugggcgcuaucuccuuuuggaugugcucuaacggaagccuccagugccgcauuuguaucuga

SEQ ID NO: 195668 - RNA, 1701 nt, Artificial Sequence; identical to SEQ ID NO: 195611
  derived and/or modified sequence opt5 from hemagglutinin__InfluenzaA__AIL94550

SEQ ID NO: 195669 - RNA, 1701 nt, Artificial Sequence
  derived and/or modified sequence opt5 from hemagglutinin__InfluenzaA__AIL94561
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugguugauggaugguauggcuucagacaccagaacagcgagggccgggggcaggccgcugaccugaaauccacccaagccgccauugaucagaucaauggaaagcucaacagacugauuggcaaaacaaaugaaaaguuccaccagaucgagaaggaauuuagcgagguggaagggcgcauucaggaccuugagaaauacguggaggauaccaagaucgaccuguggucuuauaacgcugaacuccuggucgcgcuggagaaccaacauacaaucgaucucaccgacuccgaaaugaauaaacuguucgagaagacgaaaaagcagcuucgggaaaacgccgaggauaugggaaauggcugcuuuaagauuuaccacaaaugugacaacgcuugcaucgggagcauuagaaauggcacauaugaucaugacguguaccgcgacgaggcccugaacaaucgguuccagaucaagggaguugaacucaaaucuggcuacaaggauuggauucuguggaucuccuuugccaucagcugcuuccuucuguguguggcucuccugggguuuauuaugugggccugccagagaggaaacauccgcuguaauauuugcaucuga

SEQ ID NO: 195670 - RNA, 1701 nt, Artificial Sequence
  derived and/or modified sequence opt5 from hemagglutinin__InfluenzaA__AIL94573
augaaggccauccuggugguccuccuguacaccuucgcuacagccaacgcggacacgcuuugcauuggcuaucacgcuaauaacagcaccgauacaguugacaccgugcuggagaagaaugugaucgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacauccucuagcgacaacggaaccugcuauccgggggauuuuaucaauuacgaagaacugcgggagcagcuuuccagcgucucuuccuucgaacgcuuugagaucuuccccaagacgagcucuuggccuaaccacgacuccaauaagggagugaccgccgcuuguccccaugccggcgcgaaaucuuuuuauaagaaccugauuuggcucguuaaaaagggcaauagcuacccuaaacugucccaaagcuauaucaacgauaaggggaaggaagugcuuguccuguggggcauucaccaccccuccacaaccgccgaccagcagucucucuaccagaaugcugaugccuacguguucgugggcacaagcagauauuccaaaaaguuuaaaccugagaucgcuauucggccgaagguccgcgaccaagaggggagaaugaacuacuauuggacccugguugaacccggagauaaaaucacguucgaggccacaggcaaccugguggugccucgguacgcguuuaccauggaacgcaaugccgggagcggaauuaucaucucugacacacccguccaugauugcaacaccaccugucagacaccugagggcgcuauuaauacgucccuccccuuccagaacauccacccgauuaccaucggcaagugcccuaaauauguuaagagcacaaagcugagacuugccaccgggcugcggaaugugcccucuauucagagccgcggacucuuuggcgcuaucgccggguucaucgaaggaggcuggacagggaugguggacggaugguacggcuaucaucaccaaaacgagcagggcuccggguacgccgcugaccugaaaucuacccagaaugcgauugauaagaucacgaacaaagucaauagcgugauugagaagaugaacacacaguuuaccgccguuggaaaagaguucaaucaccuugagaagagaaucgaaaaccugaauaagaaaguggacgauggcuuccucgacauuuggaccuacaacgcugagcugcugguccuccuggaaaaugagcggacacuugauuaucaugacuccaacgugaagaaccuguacgagaaaguccgcaaucaacucaagaacaaugccaaagaaaucgggaacggauguuuugaguucuaucacaagugcgauaauaccuguauggaaagcgugaagaacggcacauacgacuauccuaaauacucugaggaagccaagcugaauagagagaaaaucgaugggguuaaacuugaguccacgcggguguaucagauucuggcuaucuacagcaccgucgccucuucccucgugcugguugugagccugggcgcgauuuccuuuuggaugugcucuaacggaagccuccagugccgcaucuguauuuga

SEQ ID NO: 195671 - RNA, 1701 nt, Artificial Sequence
  derived and/or modified sequence opt5 from hemagglutinin__InfluenzaA__AIL94584
augaaggccauccuggugguccuccuguacaccuucgcuacagccaacgcggacacgcuuugcauuggcuaucacgcuaauaacagcaccgauacaguugacaccgugcuggagaaaaauaucacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucaauuacgaagaacugcgggagcagcuuuccagcgugucuuccuucgaacgcuuugagaucuuccccaagaccagcucuuggccuaaccacgacuccaauaagggagucacagccgcuuguccccaugccggcgcgaaaucuuuuuauaagaaccugauuuggcucgugaaaaagggcaauagcuacccuaaacugucccaaagcuauaucaacgauaaggggaaggaaguucuugugcuguggggcauucaccaccccuccaccacagccgaccagcagucucucuaccagaaugcugaugccuacgucuucgugggaaccagcagauauuccaaaaaguuuaaaccugagaucgcuauucggccgaaggugcgcgaccaagaggggagaaugaacuacuauuggacgcuggucgaacccggagauaaaaucacauucgaggccaccggcaaccugguugugccucgguacgcguuuacaauggaacgcaaugccgggagcggaauuaucaucucugacacccccgugcaugauugcaacaccacaugucagacgccugagggcgcuauuaauaccucccuccccuuccagaacauccacccgauuacaaucggcagaugcccuaaguaugucaaaagcaccaagcugcggcuugccacagggcugcgcaaugugcccucuauucagagcagaggacucuuuggcgcuaucgccggguucaucgaaggaggcuggaccgggaugguugacggaugguacggcuaucaucaccaaaacgagcagggcuccggguacgccgcugaccugaagucuacgcagaaugcgauugauaaaaucacaaacaaggugaauagcgucauugagaaaaugaacacccaguuuaccgccgugggaaaggaguucaaucaccuugagaaacggaucgaaaaccugaauaagaagguugacgauggcuuccucgacauuuggacauacaacgcugagcugcuggugcuccuggaaaaugagcgcacccuugauuaucaugacuccaacgucaaaaaccuguacgagaaggugagaaaucaacucaaaaacaaugccaaggaaaucgggaacggauguuuugaguucuaucacaaaugcgauaauacauguauggaaagcgucaagaacggcacguacgacuauccuaaguacucugaggaagccaaacugaaucgggagaagaucgauggggugaaacuugaguccacccgcauuuaucagauccuggcuauuuacagcacaguugccucuucccucgugcuggucgugagccugggcgcgaucuccuuuuggaugugcucuaacggaagccuccagugcagaauuuguaucuga

SEQ ID NO: 195672 - RNA, 1701 nt, Artificial Sequence; identical to SEQ ID NO: 195079
  derived and/or modified sequence opt5 from hemagglutinin__InfluenzaA__AIL94595

SEQ ID NO: 195673 - RNA, 1701 nt, Artificial Sequence; identical to SEQ ID NO: 193018
  derived and/or modified sequence opt5 from hemagglutinin__InfluenzaA__AIL94606

SEQ ID NO: 195674 - RNA, 1701 nt, Artificial Sequence; identical to SEQ ID NO: 193064
  derived and/or modified sequence opt5 from hemagglutinin__InfluenzaA__AIL94618

SEQ ID NO: 195675 - RNA, 1701 nt, Artificial Sequence; identical to SEQ ID NO: 195611
  derived and/or modified sequence opt5 from hemagglutinin__InfluenzaA__AIL94629

SEQ ID NO: 195676 - RNA, 1701 nt, Artificial Sequence; identical to SEQ ID NO: 193018
  derived and/or modified sequence opt5 from hemagglutinin__InfluenzaA__AIL94640

SEQ ID NO: 195677 - RNA, 1701 nt, Artificial Sequence
  derived and/or modified sequence opt5 from hemagglutinin__InfluenzaA__AIL94652
augaaggccauccuggugguccuccuguacaccuucgcuacagccaacgcggacacgcuuugcauuggcuaucacgcuaauaacagcaccgauacaguugacaccgugcuggagaagaaugugacagucacccauuccaucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucaauuacgaagaacugcgggagcagcuuuccagcgugucuuccuucgaacgcuuugagauguuccccaagaccagcucuuggccuaaccacgacuccaauaagggagucacagccgcuuguccccaugccggcgcgaaaucuuuuuauaagaaccugaucuggcucgugaaaaagggcaauagcuacccuaaacuguccaagagcuauauuaacgauaaggggaaagaaguucuugugcuguggggaauccaccaccccuccaccacagccgaccaacagucucucuaccagaaugcugaugccuacgucuucgugggcaccagcaaguauuccaaaaaguuuaaaccugagauugcuaucagaccgaaggugcgggaccaggaggggcgcaugaacuacuauuggacgcugauugaacccggagauaaaaucacauucgaggccaccggcaaccuggucguuccuagauacgcguuugccauggaacggaaugcugggagcggaauuaucaucucugacacacccgugcaugauugcaacaccaccugucaaacaccugagggcgccauuaauacgucccuccccuuccagaacauccacccgauuaccaucggcaagugcccuaaguaugugaaaagcacaaagcugcgccuugcuaccgggcugagaaauguccccucuauucagagccggggacucuuuggcgccaucgccggguucaucgaaggaggcuggacagggaugguggacggaugguacggcuaucaucaccagaacgagcaaggcuccggguacgcugcggaccugaaaucuacccagaaugccauugauaagaucacgaacaaaguuaauagcgugauugagaagaugaacacacaguuuaccgcugucggaaaggaguucaaucaccuugagaaacgcaucgaaaaccugaauaagaaaguggacgauggcuuccucgacauuuggaccuacaacgccgagcugcugguucuccuggaaaaugagagaacacuugauuaucaugacuccaacgugaagaaccuguacgagaaaguccggaaucagcucaagaacaaugccaaggaaaucgggaacggauguuuugaguucuaucacaaaugcgauaauaccuguauggaaagcgugaagaacggcacauacgacuauccuaaauacucugaggaagcuaagcuggaucgcgagaaaaucgacggggucaaacuugaguccacgagaauuuaucaaauccuggccauuuacagcaccguggcgucuucccucguucugguggucagccugggcgcuaucuccuuuuggaugugcucuaauggaagccuccagugccggauuuguaucuga

SEQ ID NO: 195678 - RNA, 1701 nt, Artificial Sequence; identical to SEQ ID NO: 193064
  derived and/or modified sequence opt5 from hemagglutinin__InfluenzaA__AIL94663

SEQ ID NO: 195679 - RNA, 1701 nt, Artificial Sequence; identical to SEQ ID NO: 193064
  derived and/or modified sequence opt5 from hemagglutinin__InfluenzaA__AIL94674

SEQ ID NO: 195680 - RNA, 1701 nt, Artificial Sequence; identical to SEQ ID NO: 193018
  derived and/or modified sequence opt5 from hemagglutinin__InfluenzaA__AIL94697

SEQ ID NO: 195681 - RNA, 1701 nt, Artificial Sequence; identical to SEQ ID NO: 193064
  derived and/or modified sequence opt5 from hemagglutinin__InfluenzaA__AIL94709

SEQ ID NO: 195682 - RNA, 1701 nt, Artificial Sequence; identical to SEQ ID NO: 193064
  derived and/or modified sequence opt5 from hemagglutinin__InfluenzaA__AIL94720

SEQ ID NO: 195683 - RNA, 1701 nt, Artificial Sequence; identical to SEQ ID NO: 193018
  derived and/or modified sequence opt5 from hemagglutinin__InfluenzaA__AIL94731

SEQ ID NO: 195684 - RNA, 1701 nt, Artificial Sequence; identical to SEQ ID NO: 195611
  derived and/or modified sequence opt5 from hemagglutinin__InfluenzaA__AIL94743

SEQ ID NO: 195685 - RNA, 1701 nt, Artificial Sequence
  derived and/or modified sequence opt5 from hemagglutinin__InfluenzaA__AIL94754
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauauguuaagagcaccaagcugagacuugccacagggcugcggaaugugcccucuauccagagccgcggacucuuuggcgcuauugccggguucaucgaaggaggcuggaccgggaugguggacggaugguacggcuaucaucaccaaaacgagcagggcuccggguacgccgcugaccugaaaucuacgcagaaugcgaucgauaagauuacaaacaaagucaauagcgugaucgagaagaugaacacccaguuuaccgccguuggaaaagaguucaaucaccuugagaagagaauugaaaaccugaauaagaaaguggacgauggcuuccucgacaucuggacauacaacgcugagcugcugauucuccuggaaaaugagcggacccuugauuaucaugacuccaacgucaagaaccuguacgagaaagugcgcaaucaacucaagaacaaugccaaagaaaucgggaacggauguuuugaguucuaucacaagugcgauaauacauguauggaaagcgccaagaacggcacguacgacuauccuaaauacucugaggaagcuaagcugaauagagagaaaaucgauggggucaaacuugaguccacccggauuuaucagauccuggccauuuacagcacaguggcgucuucccucguucugguggucagccugggcgcuaucuccuuuuggaugugcucuaacggaagccuccagugccgcauuuguaucuga

SEQ ID NO: 195686 - RNA, 1701 nt, Artificial Sequence; identical to SEQ ID NO: 195639
  derived and/or modified sequence opt5 from hemagglutinin__InfluenzaA__AIL94765

SEQ ID NO: 195687 - RNA, 1701 nt, Artificial Sequence; identical to SEQ ID NO: 193018
  derived and/or modified sequence opt5 from hemagglutinin__InfluenzaA__AIL94777

SEQ ID NO: 195688 - RNA, 1701 nt, Artificial Sequence; identical to SEQ ID NO: 194926
  derived and/or modified sequence opt5 from hemagglutinin__InfluenzaA__AIL94789

SEQ ID NO: 195689 - RNA, 1701 nt, Artificial Sequence; identical to SEQ ID NO: 193064
  derived and/or modified sequence opt5 from hemagglutinin__InfluenzaA__AIL94800

SEQ ID NO: 195690 - RNA, 1701 nt, Artificial Sequence
  derived and/or modified sequence opt5 from hemagglutinin__InfluenzaA__AIL94811
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagaacacacugaaacuugccacggggaugcgcaauguccccgagaagcaaaccagaggaaucuucggcgcgauugccggguuuaucgaaaacggaugggagggcaugguugaugggugguauggauuccggcaccaaaauucugagggcagaggccaggcugccgaccugaaaagcacacaggcugccauugaucagaucaacgggaagcucaaucgccugauuggaaaaaccaacgaaaaguuccaccagaucgagaaggaauuuuccgagguggaaggccggauucaggaccuugagaaauacguggaggauacaaagaucgaccuguggagcuauaacgccgaacuccuggucgcucuggagaaucaacauaccaucgaucucacggacucugaaaugaacaaacuguucgagaagaccaaaaagcagcuuagagaaaaugcggaggauauggggaacggaugcuuuaagauuuaccacaaaugugacaaugccugcaucggcuccauucgcaacgggacauaugaucauaauguguaccgggacgaggcucugaacaauagauuccagaucaagggcguugaacucaaaagcggauacaaggacuggauucuguggaucucuuuugccaucuccugcuuccuucuguguguggcccuccugggcuuuauuaugugggcuugccagaaagggaacauccgcuguaauauuugcaucuga

SEQ ID NO: 195691 - RNA, 1701 nt, Artificial Sequence; identical to SEQ ID NO: 192882
  derived and/or modified sequence opt5 from hemagglutinin__InfluenzaA__AIL94823

SEQ ID NO: 195692 - RNA, 1701 nt, Artificial Sequence
  derived and/or modified sequence opt5 from hemagglutinin__InfluenzaA__AIL94835
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauuauucuaucggcgagaucugcgacagcccgcaccagauucuugauggggaaaacuguacacugaucgacgcccuccugggagauccccagugcgacggcuuucagaauaaaaagugggaucuguucgucgagcgguccaaagccuacucuaacuguuauccuuacgacgugcccgauuaugcuagccuccgcucccugguugccucuagcgggacccuugaauuuaauaacgaguccuucaauugggcuggagugacgcaaaacggcaccagcucugccugcauuagaggcuccaauagcuccuuuuucucucggcugaacuggcucacacaucugaauuuuaaguacccugcgcuuaacgucaccaugcccaacaaugagcaguucgacaagcuguauaucuggggagugcaccauccugggacagauaaagaccagauuuuucucuacgcccagagcucuggccgcaucaccguuuccacgaagagaagccaacaggcugugauuccgaacaucgggucccggccccgcaucagaaauauuccuucucggaucagcauuuacuggacaaucgucaaacccggagauauucugcugaucaacuccaccggcaaucucaucgccccucgcggguauuucaagauuagaagcggaaaaucuuccaucaugcggagcgacgcucccauuggcaaguguaagucugaaugcaucacaccgaacggcagcauuccuaaugacaaacccuuucagaacgugaaucgcaucaccuacggggccuguccuagauaugugaagcaguccacccugaaacuugcgacaggaaugcggaacguccccgagaagcaaacgcgcggcaucuucggggccauugcuggauuuaucgaaaauggcugggaggggaugguugauggaugguacggcuucagacaccagaacucugagggccgggggcaggccgcugaccugaaaagcacccaagccgccauugaucagaucaauggaaagcucaacagacugauuggcaaaacaaaugaaaaguuccaccagaucgagaaggaauuuuccgagguggaagggcgcauucaggaccuugagaaauauguggaggauaccaagaucgaccuguggagcuacaacgcugaacuccuggucgcgcuggagaaccaacauacaaucgaucucaccgacucugaaaugaauaaacuguucgagaagacgaaaaagcagcuucgggaaaacgccgaggauaugggaaauggcugcuuuaagauuuaucacaaaugugacaacgcuugcaucggguccauuagaaauggcacauacgaucaugacguguaccgcgacgaggcccugaacaaucgguuccagaucaagggaguugaacucaaaagcggcuauaaggauuggauucuguggaucucuuuugccaucuccugcuuccuucuguguguggcucuccugggguuuauuaugugggccugccagaaaggaaacaucagauguaauauuugcaucuga

SEQ ID NO: 195693 - RNA, 1701 nt, Artificial Sequence
  derived and/or modified sequence opt5 from hemagglutinin__InfluenzaA__AIL94847
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacgacgagaaauucgauaagcuguacauuuggggcgugcaccauccugggacggacaacgaucagaucuuucucuaugcgcaggccucuggacgcauuacaguuuccaccaaaagaagccaacagacagugaucccgaauauuggcucccggccccgcgucagaaacaucccuucucggaucagcauuuacuggaccaucgugaagcccggggacauucugcugaucaauuccaccggaaaccucauugcuccucgcggcuacuucaaaaucagaagcgggaagucuuccaucaugcggagcgacgcccccauuggaaaguguaauucugaaugcaucacaccgaacggcagcauuccuaaugauaaacccuuucagaacgugaaucgcaucacguauggcgcuuguccuagauacgucaagcagaacacccugaaacuugccacagggaugcggaauguucccgagaagcaaacccgcggaauuuucggcgcgaucgccggguuuaucgaaaacggaugggagggcaugguggacgggugguauggauucagacaccaaaauuccgagggcauuggccaggcugccgaucugaaaucuacacaggcugccaucgaccagauuaacgggaagcucaaucggcugaucggaaaaaccaacgaaaaguuccaccagauugagaaggaauuuagcgagguggaaggcagaauccaggaucuugagaaauacgucgaggacacgaagauugaucugugguccuauaacgccgaacuccugguggcucuggagaaucaacauacaaucgaccucaccgauagcgaaaugaacaaacuguucgagaagaccaaaaagcagcuucgcgaaaaugcggaggacauggggaacggaugcuuuaagaucuaccacaaaugugauaaugccugcauuggcucuauccggaacgggacauaugaccaugacguuuacagagaugaggcucugaauaaccgcuuccagauuaagggcguggaacucaaauccggauacaaggacuggauccuguggauuagcuuugccaucucuugcuuccuucugugugucgcccuccugggcuuuaucaugugggcuugccagaaagggaauauucgguguaacaucugcauuuga

SEQ ID NO: 195694 - RNA, 1701 nt, Artificial Sequence; identical to SEQ ID NO: 188557
  derived and/or modified sequence opt5 from hemagglutinin__InfluenzaA__AIL94859

SEQ ID NO: 195695 - RNA, 1701 nt, Artificial Sequence
  derived and/or modified sequence opt5 from hemagglutinin__InfluenzaA__AIL94871
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaauuuuaaguauccugcccuuaacgucaccaugcccaacaaugagcaguucgacaagcuguacauuuggggcgugcaccauccugggacggauaaagaccagaucuuucucuaugcgcaagccucuggacgcauuacaguuuccaccaagagaagccagcaggcugugaucccgaacauuggcucccggccccgcgucagaaauaucccuucucggaucagcauuuacuggacaaucgugaaacccggggauauucugcugaucaacuccaccggaaaucucauugccccucgcggcuacuucaagaucagaagcgggaaaucuuccaucaugcggagcgacgcucccauuggaaaguguaacucugaaugcaucaccccgaauggcagcauuccuaacgacaagcccuuucagaaugugaaccgcaucacauauggcgccuguccuagauacgucaaacaauccacgcugaagcuggcgaccgggaugcggaauguucccgagaaacagacacgcggaauuuucggcgccaucgcuggguuuaucgaaaacggaugggagggcaugguggaugggugguauggauucagacaccaaaauucugagggccggggccaggccgcugaccuuaagagcacccaggccgccauugaucagaucaacgggaaacucaauagacugauuggaaagacaaacgaaaaauuccaccagaucgagaaggaauuuuccgagguggaaggccgcauucaagaccuugagaaguacgucgaggauaccaaaaucgaccuguggagcuauaacgcugaacuccugguggcgcuggagaaucagcauacgauugaucucacagacucugaaaugaacaagcuguucgagaaaaccaagaaacagcuucgggaaaaugccgaggauauggggaacggaugcuuuaccaucuaccacaagugugacaaugcuugcaucggcuccauuagaaacgggacauaugaucauaauguuuaccgcgacgaggcccugaacaaucgguuccagaucaagggcauugaacucaaaagcggauacaaggacuggauccuguggauuucuuuugccaucuccugcuuccuucuguguguggcucuccugggcuuuaucaugugggccugccaaaaagggaacauuagauguaauaucugcauuuga

SEQ ID NO: 195696 - RNA, 1701 nt, Artificial Sequence; identical to SEQ ID NO: 195104
  derived and/or modified sequence opt5 from hemagglutinin__InfluenzaA__AIL94883

SEQ ID NO: 195697 - RNA, 1701 nt, Artificial Sequence; identical to SEQ ID NO: 195089
  derived and/or modified sequence opt5 from hemagglutinin__InfluenzaA__AIL94894

SEQ ID NO: 195698 - RNA, 1701 nt, Artificial Sequence; identical to SEQ ID NO: 192882
  derived and/or modified sequence opt5 from hemagglutinin__InfluenzaA__AIL94906

SEQ ID NO: 195699 - RNA, 1701 nt, Artificial Sequence; identical to SEQ ID NO: 193018
  derived and/or modified sequence opt5 from hemagglutinin__InfluenzaA__AIL94918

SEQ ID NO: 195700 - RNA, 1701 nt, Artificial Sequence; identical to SEQ ID NO: 193018
  derived and/or modified sequence opt5 from hemagglutinin__InfluenzaA__AIL94930

SEQ ID NO: 195701 - RNA, 1701 nt, Artificial Sequence; identical to SEQ ID NO: 193018
  derived and/or modified sequence opt5 from hemagglutinin__InfluenzaA__AIL94942

SEQ ID NO: 195702 - RNA, 1701 nt, Artificial Sequence; identical to SEQ ID NO: 193064
  derived and/or modified sequence opt5 from hemagglutinin__InfluenzaA__AIL94954

SEQ ID NO: 195703 - RNA, 1701 nt, Artificial Sequence; identical to SEQ ID NO: 192882
  derived and/or modified sequence opt5 from hemagglutinin__InfluenzaA__AIL94965

SEQ ID NO: 195704 - RNA, 1701 nt, Artificial Sequence
  derived and/or modified sequence opt5 from hemagglutinin__InfluenzaA__AIM55837
augaaggccauccuggugguccuccuguacaccuucgcuacagccacggcggacacccuuugcauuggcuaucacgcuaacaauagcacagauaccguugacacagugcuggagaagaacgugaccgucacacauuccgugaaucuccuggaagauaagcacaacgggaaacuuuguaagcugagaggaguugcuccccuccaucugggcaaaugcaauaucgccggguggauucugggaaacccugagugugaaucucucagcaccgccuccucuuggagcuacaucguggagacguccucuagcgacaaugggaccugcuauccgggcgauuuuauuaacuacgaagaacugcgggagcagcuuuccagcgucucuuccuucgaacgcuuugagaucuuccccaagacaagcucuuggccuaaucacgacuccaacaagggagugaccgccgcuuguccccaugccggcgcgaaaucuuuuuauaagaaucugaucuggcucguuaaaaagggcaacagcuacccuaaacugucccaaagcuauauuaaugauaaggggaaggaagugcuuguccuguggggaauccaccaccccuccacaaccgccgaccagcagucucucuaccagaacgcugaugccuacguguucgugggcacgagcagauauuccaaaaaguuuaaaccugagauugcuauccggccgaagguccgcgaccaagaggggagaaugaauuacuauuggacacugguugaacccggagauaaaauuaccuucgaggccacaggcaaccugguggugccucgguacgcguuuaccauggaacgcaacgccgggagcggaaucauuaucucugacacccccguccaugauugcaauacaacgugucagaccccugagggcgcuaucaacacaucccuccccuuccagaauauucacccgaucaccauuggcaagugcccuaaauauguuaagagcacaaagcugucucuugccaccgggcugagaaacgugcccagcauccagucccggggacucuuuggcgcuauugccggguucaucgaaggaggcuggacggggaugguggacggaugguacggcuaucaucaccaaaaugagcagggcucuggguacgccgcugaccugaaaagcacacagaacgcgaucgauaagauuaccaauaaagucaacuccgugaucgagaagaugaauacccaguuuacagccguuggaaaagaguucaaccaccuugagaagcgcauugaaaaucugaacaagaaaguggacgauggcuuccucgacaucuggaccuacaaugcugagcugcugguccuccuggaaaacgagagaacacuugauuaucaugacagcaaugugaagaaccuguacgagaaaguccggaaccaacucaagaauaacgccaaagaaauugggaauggauguuuugaguucuaucacaagugcgauaacacguguauggaaucugugaagaauggcaccuacgacuauccuaaauacuccgaggaagccaagcugaaccgcgagaaaaucgaugggguuaaacuugagagcacaagaaucuaucagauucuggcuaucuacucuaccguggccuccagccucguccuggugguuucccugggcgcgauuucuuuuuggaugugcagcaauggaucccuccagugccggaucuguauuuga

SEQ ID NO: 195705 - RNA, 1701 nt, Artificial Sequence
  derived and/or modified sequence opt5 from hemagglutinin__InfluenzaA__AIM55848
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauauguuaagagcaccaagcugagacuugccacagggcugcggaauauccccucuauucagagccgcggacucuuuggcgcuaucgccggguucaucgaaggaggcuggaccgggaugguggacggaugguacggcuaucaucaccaaaacgagcagggcuccggguacgccgcugaccugaaaucuacgcagaaugcgauugauaagaucacaaacaaagugaauagcgucauugagaagaugaacacccaguuuaccgccgugggaaaagaguucaaucaccuugagaagagaaucgaaaaccugaauaagaaaguugacgauggcuuccucgacauuuggacauacaacaccgagcugcuggugcuccuggaaaaugagcggacacuugauuaucaugacuccaacgucaagaaccuguacgagaaagugcgcaaucaacucaagaacaaugcuaaagaaaucgggaacggauguuuugaguucuaucacaagugcgauaauacguguauggaaagcgucaagaacggcaccuacgacuauccuaaauacucugaggaagccaagcugaauagagagaaaaucgauggggugaaacuugaguccacacggauuuaucagauccuggccauuuacagcaccguugcuucuucccucgugcuggucgugagccugggcgccaucuccuuuuggaugugcucuaacggaagccuccagugccgcauuuguaucuga

SEQ ID NO: 195706 - RNA, 1701 nt, Artificial Sequence; identical to SEQ ID NO: 193064
  derived and/or modified sequence opt5 from hemagglutinin__InfluenzaA__AIM55859

SEQ ID NO: 195707 - RNA, 1701 nt, Artificial Sequence; identical to SEQ ID NO: 193064
  derived and/or modified sequence opt5 from hemagglutinin__InfluenzaA__AIM55870

SEQ ID NO: 195708 - RNA, 1701 nt, Artificial Sequence; identical to SEQ ID NO: 193064
  derived and/or modified sequence opt5 from hemagglutinin__InfluenzaA__AIM55881

SEQ ID NO: 195709 - RNA, 1701 nt, Artificial Sequence; identical to SEQ ID NO: 194926
  derived and/or modified sequence opt5 from hemagglutinin__InfluenzaA__AIM55893

SEQ ID NO: 195710 - RNA, 1701 nt, Artificial Sequence; identical to SEQ ID NO: 194045
  derived and/or modified sequence opt5 from hemagglutinin__InfluenzaA__AIM55904

SEQ ID NO: 195711 - RNA, 1701 nt, Artificial Sequence; identical to SEQ ID NO: 193064
  derived and/or modified sequence opt5 from hemagglutinin__InfluenzaA__AIM55915

SEQ ID NO: 195712 - RNA, 1710 nt, Artificial Sequence
  derived and/or modified sequence opt5 from hemagglutinin__InfluenzaA__AIM55926
augaaggccauccuggugguccuccuguacaccuucgcuacaacgaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauuaauuacgaagaacugcgggagcagcuuuccagcgucucuuccuucgaacgcuuugagaucuuccccaagacaagcucuuggccuaaccacgacuccaauaagggagugaccgcugccuguccccaugcuggcgccaagagcuuuuauaagaaccugaucuggcucguuaaaaagggcaauucuuacccuaaacugucccaaagcuauauuaacgauaaggggaaggaagugcuuguccuguggggaauccaccaccccuccacaaccgcggaccagcagucucucuaccagaaugccgaugcuuacguguucgugggcacgagcagauauuccaaaaaguuuaaaccugagauugccauccggccgaagguccgcgaccaagaggggagaaugaacuacuauuggacacugguugaacccggagauaaaauuaccuucgaggcuacaggcaaccugguggugccucgguacgccuuuaccauggaacgcaaugcggggagcggaaucauuaucucugacacccccguccaugauugcaacacaacgugucagaccccugagggcgccaucaauacaucccucaccagccugcccuuccagaacauucacccgaucacaauuggcaagugcccuaaauaugugaagucuaccaaacuuagacuggcuacggggcuccggaauguucccagcauccagucccgcggacuguuuggcgccauugcuggguucaucgaaggaggcuggacagggaugguggacggaugguacggcuaucaucaccaaaacgagcagggcucuggguacgccgccgaccuuaaaagcacccagaaugcuaucgauaagauuaccaacaaagucaauuccgugaucgagaagaugaacacacaguuuaccgcgguuggaaaagaguucaaucaccuggagaagagaauugaaaaccucaauaagaaaguggacgauggcuuccuggacaucuggacauacaacgccgagcugcucguccugcuugaaaaugagcggacgcuggauuaucaugacagcaacgugaagaaccucuacgagaaaguccgcaaucaacugaagaacaaugcuaaagaaauugggaacggauguuuugaguucuaucacaagugcgauaauaccuguauggaaucugugaagaacggcacauacgacuauccuaaauacuccgaggaagccaaacuuaauagagagaagaucgaugggguuaagcuggagagcacccggaucuaucagauucucgccaucuacucuacaguggcuuccagccugguccuggugguuucccucggcgccauuucuuuuuggaugugcagcaacggaucccugcagugccgcaucuguauuuga

SEQ ID NO: 195713 - RNA, 1701 nt, Artificial Sequence; identical to SEQ ID NO: 193064
  derived and/or modified sequence opt5 from hemagglutinin__InfluenzaA__AIM55937

SEQ ID NO: 195714 - RNA, 1701 nt, Artificial Sequence; identical to SEQ ID NO: 194045
  derived and/or modified sequence opt5 from hemagglutinin__InfluenzaA__AIM55948

SEQ ID NO: 195715 - RNA, 1701 nt, Artificial Sequence; identical to SEQ ID NO: 194027
  derived and/or modified sequence opt5 from hemagglutinin__InfluenzaA__AIM55962

SEQ ID NO: 195716 - RNA, 1701 nt, Artificial Sequence; identical to SEQ ID NO: 194045
  derived and/or modified sequence opt5 from hemagglutinin__InfluenzaA__AIM55984

SEQ ID NO: 195717 - RNA, 1701 nt, Artificial Sequence; identical to SEQ ID NO: 194926
  derived and/or modified sequence opt5 from hemagglutinin__InfluenzaA__AIM55995

SEQ ID NO: 195718 - RNA, 1701 nt, Artificial Sequence
  derived and/or modified sequence opt5 from hemagglutinin__InfluenzaA__AIM56017
augaaggccauccuggugguccuccuguacaccuucgcuacaacgaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauuaauuacgaagaacugcgggagcagcuuuccagcgucucuuccuucgaacgcuuugagaucuuccccaagacaagcucuuggccuaaccacgacuccaauaagggagugaccgcugccuguccccaugcuggcgccaagagcuuuuauaagaaccugaucuggcucguuaaaaagggccacucuuacccuaaacugucccaaagcuauauuaaugauaaggggaaggaagugcuuguccuguggggaauccaccaucccuccacaaccgcggaccagcagucucucuaccagaacgccgaugcuuacguguucgugggcacgagcagauauuccaaaaaguuuaaaccugagauugccauccggccgaagguccgcgaccaagaggggagaaugaauuacuauuggacacugguugaacccggagauaaaauuaccuucgaggcuacaggcaaccugguggugccucgguacgccuuuaccauggaacgcaacgcggggagcggaaucauuaucucugacacccccguccacgauugcaauacaacgugucagaccccugagggcgccaucaacacaucccuccccuuccagaauauucauccgaucaccauuggcaagugcccuaaauauguuaagagcacaaagcugagacuugcuaccgggcugcggaacgugcccucuauccagagccgcggacucuuuggcgccauugcuggguucaucgaaggaggcuggacggggaugguggacggaugguacggcuaucaccaccaaaaugagcagggcuccggguacgccgccgaccugaaaucuacacagaacgcuaucgauaagauuaccaauaaagucaacagcgugaucgagaagaugaauacccaguuuacagcgguuggaaaagaguucaaccaucuugagaagagaauugaaaaucugaacaagaaaguggacgauggcuuccucgacaucuggaccuacaaugccgagcugcugguccuccuggaaaacgagcggacacuugauuaucacgacuccaaugugaagaaccuguacgagaaaguccgcaaccaacucaagaauaacgcuaaagaaauugggaauggauguuuugaguucuaucauaagugcgauaacacguguauggaaagcgugaagaauggcaccuacgacuauccuaaauacucugaggaagccaagcugaacagagagaaaaucgaugggguuaaacuugaguccacacggaucuaucagauucuggccaucuacagcaccguggcuucuucccucguccuggugguuagccugggcgccauuuccuuuuggaugugcucuaauggaagccuccagugccgcaucuguauuuga

SEQ ID NO: 195719 - RNA, 1701 nt, Artificial Sequence; identical to SEQ ID NO: 195718
  derived and/or modified sequence opt5 from hemagglutinin__InfluenzaA__AIM56028

SEQ ID NO: 195720 - RNA, 1701 nt, Artificial Sequence
  derived and/or modified sequence opt5 from hemagglutinin__InfluenzaA__AIM56039
augaaggccauccuggugguccuccuguaccccuucgcuaccgccaacgcggacacacuuugcauuggcuaucacgcuaauaacagcacggauaccguugacacagugcuggagaaaaaugugaccgucacacauuccgugaaccuccuggaagauaagcacaaugggaaacuuuguaagcugagaggaguugccccucuccaucugggcaaaugcaacaucgccggguggauucugggaaauccggagugugaaucucucagcaccgcuuccucuuggagcuacaucguggaggccuccucuagcgacaacggcacaugcuaucccggggauuuuauuaauuacgaagaacugcgggagcagcuuuccagcgucucuuccuucgaacgcuuugagaucuucccuaagaccagcucuuggcccaaccacgacuccaauaagggagugacggcugccuguccucaugcgggcgccaagagcuuuuauaagaaccugaucuggcucguuaaaaagggcaauucuuaccccaaacugucccaaagcuauauuaacgauaaggggaaggaagugcuuguccuguggggaauccaccacccuuccaccacagcugaccagcagucucucuaccagaaugccgaugcuuacguguucgugggcaccagcagauauuccaaaaaguuuaaaccggagauugccauccggcccaagguccgcgaccaagaggggagaaugaacuacuauuggacacugguugaaccuggagauaaaauuaccuucgaggcgacgggcaaccugguggugccccgguacgccuuuacaauggaacgcaaugcugggagcggaaucauuaucucugacaccccuguccaugauugcaacacaaccugucagacccccgagggcgccaucaauacaucccucccguuccagaacauucacccuaucacgauuggcaagugccccaaauauguuaagagcaccaagcugagacuugcuacagggcugcggaaugugccuucuauccagagccgcggacucuuuggcgccauugccggguucaucgaaggaggcuggaccgggaugguggacggaugguacggcuaucaucaccaaaacgagcagggcuccggguacgcugcggaccugaaaucuacacagaaugccaucgauaagauuaccaacaaagucaauagcgugaucgagaagaugaacacgcaguuuacagcuguuggaaaagaguucaaucaccuugagaagagaauugaaaaccugaauaagaaaguggacgauggcuuccucgacaucuggaccuacaacgccgagcugcugguccuccuggaaaaugagcggacccuugauuaucaugacuccaacgugaagaaccuguacgagaaaguccgcaaucaacucaagaacaaugccaaagaaauugggaacggauguuuugaguucuaucacaagugcgauaauacauguauggaaagcgugaagaacggcaccuacgacuaucccaaauacucugaggaagcuaagcugaauagagagaaaaucgaugggguuaaacuugaguccacacggaucuaucagauucuggccaucuacagcacgguggcgucuucccucguccuggugguuagccugggcgcuauuuccuuuuggaugugcucuaacggaagccuccagugccgcaucuguauuuga

SEQ ID NO: 195721 - RNA, 1701 nt, Artificial Sequence
  derived and/or modified sequence opt5 from hemagglutinin__InfluenzaA__AIM56050
augaaggccauccuggugguccuccuguacaccuucgcuacaacgaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauuaauuacgaagaacugcgggagcagcuuuccagcgucucuuccuucgaacgcuuugagaucuuccccaagacaagcucuuggccuaaccacgacuccaauaagggagugaccgcugccuguccccaugcuggcgccaagagcuuuuauaagaaccugaucuggcucguuaaaaagggcaauucuuacccuaaacugucccaaagcuauauuaacgauaaggggaaggaagugcuuguccuguggggaauccaccaccccuccacaaccgcggaccagcagucucucuaccagaaugccgaugcuuacguguucgugggcacgagcagauauuccaaaaaguuuaaaccugagauugccauccggccgaagguccgcgaccaagaggggagaaugaacuacuauuggacacugguugaacccggagauaaaauuaccuucgaggcuacaggcaaccugguggugccucgguacgccuuuaccauggaacgcaaugcggggagcggaaucauuaucucugacacccccguccaugauugcaacacaacgugucagaccccugagggcgccaucaauacaucccuccccuuccagaacauucacccgaucaccauuggcaagugcccuaaauauguuaagagcacaaagcugagacuugcuaccgggcugcggaaugugcccucuauccagagccgcggacucuuuggcgccauugcuggguucaucgaaggaggcuggacggggaugguggacggaugguacggcuaucaucaccaaaacgagcagggcuccggguacgccgccgaccugaaaucuacacagaaugcuaucgauaagauuaccaacaaagucaauagcgugaucgagaagaugaacacccaguuuacagcgguuggaaaagaguucaaucaccuugagaagagaauugaaaaccugaauaagaaaguggacgauggcuuccucgacaucuggaccuacaacgccgagcugcugguccuccuggaaaaugagcggacacuugauuaucaugacuccaacgugaagaaccuguacgagaaaguccgcaaucaacucaagaacaaugcuaaagaaauugggaacggauguuuugaguucuaucacaagugcgauaauacguguauggaaagcgugaagaacggcaccuacgacuauccuaaauacucugaggaagccaagcugaauagagggaaaaucgauggcguuaaacuugaguccacacggaucuaucagauucuggccaucuacagcaccguggcuucuucccucguccuggugguuagccugggagccauuuccuuuuggaugugcucuaacggcagccuccagugccgcaucuguauuuga

SEQ ID NO: 195722 - RNA, 1701 nt, Artificial Sequence; identical to SEQ ID NO: 193064
  derived and/or modified sequence opt5 from hemagglutinin__InfluenzaA__AIM56061

SEQ ID NO: 195723 - RNA, 1701 nt, Artificial Sequence; identical to SEQ ID NO: 193064
  derived and/or modified sequence opt5 from hemagglutinin__InfluenzaA__AIM56072

SEQ ID NO: 195724 - RNA, 1701 nt, Artificial Sequence; identical to SEQ ID NO: 194917
  derived and/or modified sequence opt5 from hemagglutinin__InfluenzaA__AIM56083

SEQ ID NO: 195725 - RNA, 1701 nt, Artificial Sequence; identical to SEQ ID NO: 193064
  derived and/or modified sequence opt5 from hemagglutinin__InfluenzaA__AIM56105

SEQ ID NO: 195726 - RNA, 1701 nt, Artificial Sequence; identical to SEQ ID NO: 193064
  derived and/or modified sequence opt5 from hemagglutinin__InfluenzaA__AIM56116

SEQ ID NO: 195727 - RNA, 1701 nt, Artificial Sequence
  derived and/or modified sequence opt5 from hemagglutinin__InfluenzaA__AIM56127
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaaggccagcucuuggccuaaccacgacuccaauaagggagugaccgcugccuguccccaugcgggcgccaagagcuuuuauaagaaccugaucuggcucguuaaaaagggcaauucuuacccuaaacugucccaaagcuauauuaacgauaaggggaaggaagugcuuguccuguggggaauccaccaccccuccacaaccgcugaccagcagucucucuaccagaaugccgaugcuuacguguucgugggcacaagcagauauuccaaaaaguuuaaaccugagauugccauccggccgaagguccgcgaccaagaggggagaaugaacuacuauuggacccugguugaacccggagauaaaauuacguucgaggcgacaggcaaccugguggugccucgguacgccuuuaccauggaacgcaaugcugggagcggaaucauuaucucugacacacccguccaugauugcaacaccaccugucagacaccugagggcgccaucaauacgucccuccccuuccagaacauucacccgaucaccauuggcaagugcccuaaauauguuaagagcacaaagcugagacuugcuaccgggcugcggaauauccccucuauucagagccgcggacucuuuggcgccaucgccggguucaucgaaggaggcuggacagggaugguggacggaugguacggcuaucaucaccaaaacgagcagggcuccggguacgcugcggaccugaaaucuacccagaaugccauugauaagaucacgaacaaagugaauagcgucauugagaagaugaacacacaguuuaccgcugugggaaaagaguucaaucaccuugagaagagaaucgaaaaccugaauaagaaaguugacgauggcuuccucgacauuuggaccuacaacgccgagcugcuggugcuccuggaaaaugagcggacacuugauuaucaugacuccaacgucaagaaccuguacgagaaagugcgcaaucaacucaagaacaaugccaaagaaaucgggaacggauguuuugaguucuaucacaagugcgauaauaccuguauggaaagcgucaagaacggcacauacgacuauccuaaauacucugaggaagcuaagcugaauagagagaaaaucgauggggugaaacuugaguccacgcggauuuaucagauccuggccauuuacagcaccguugcgucuucccucgugcuggucgugagccugggcgcuaucuccuuuuggaugugcucuaacggaagccuccagugccgcauuuguaucuga

SEQ ID NO: 195728 - RNA, 1701 nt, Artificial Sequence; identical to SEQ ID NO: 193064
  derived and/or modified sequence opt5 from hemagglutinin__InfluenzaA__AIM56138

SEQ ID NO: 195729 - RNA, 1701 nt, Artificial Sequence; identical to SEQ ID NO: 193064
  derived and/or modified sequence opt5 from hemagglutinin__InfluenzaA__AIM56149

SEQ ID NO: 195730 - RNA, 1701 nt, Artificial Sequence; identical to SEQ ID NO: 194917
  derived and/or modified sequence opt5 from hemagglutinin__InfluenzaA__AIM56160

SEQ ID NO: 195731 - RNA, 1701 nt, Artificial Sequence; identical to SEQ ID NO: 193064
  derived and/or modified sequence opt5 from hemagglutinin__InfluenzaA__AIM56171

SEQ ID NO: 195732 - RNA, 1701 nt, Artificial Sequence
  derived and/or modified sequence opt5 from hemagglutinin__InfluenzaA__AIM56182
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaaggccagcucuuggccuaaccacgacuccaauaagggagugaccgcugccuguccccaugcgggcgccaagagcuuuuauaagaaccugaucuggcucguuaaaaagggcaauucuuacccuaaacugucccaaagcuauauuaacgauaaggggaaggaagugcuuguccuguggggaauccaccaccccuccacaaccgcugaccagcagucucucuaccagaaugccgaugcuuacguguucgugggcacaagcagauauuccaaaaaguuuaaaccugagauugccauccggccgaagguccgcgaccaagaggggagaaugaacuacuauuggacccugguugaacccggagauaaaauuacguucgaggcgacaggcaaccugguggugccucgguacgccuuuaccauggaacgcaaugcugggagcggaaucauuaucucugacacacccguccaugauugcaacaccaccugucagacaccugagggcgccaucaauacgucccuccccuuccagaacauucacccgaucaccauuggcaagugcccuaaauaugugaaaagcacaaagcugagacuugcuaccgggcugcggaauauccccucuauucagagccgcggacucuuuggcgccaucgccggguucaucgaaggaggcuggacagggaugguugacggaugguacggcuaucaucaccaaaacgagcagggcuccggguacgcugcggaccugaaaucuacccagaaugccauugauaagaucacgaacaaagugaauagcgucauugagaagaugaacacacaguuuaccgcugugggaaaagaguucaaucaccuugagaagagaaucgaaaaccugaauaagaaaguugacgauggcuuccucgacauuuggaccuacaacgccgagcugcuggugcuccuggaaaaugagcggacacuugauuaucaugacuccaacgucaagaaccuguacgagaaagugcgcaaucaacucaagaacaaugccaaagaaaucgggaacggauguuuugaguucuaucacaagugcgauaauaccuguauggaaagcgucaagaacggcacauacgacuauccuaaauacucugaggaagcuaagcugaauaaagagaagaucgauggggugaaacuugaguccacgagaauuuaucagauccuggccauuuacagcaccguugcgucuucccucgugcuggucgugagccugggcgcuaucuccuuuuggaugugcucuaacggaagccuccagugccggauuuguaucuga

SEQ ID NO: 195733 - RNA, 1701 nt, Artificial Sequence
  derived and/or modified sequence opt5 from hemagglutinin__InfluenzaA__AIM56193
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaagugacauucgaggccaccggcaaccugguggucccucgguacgcguuuacaauggaacgcaaugccgggagcggaauuaucauuucugacacccccgugcaugauugcaacaccacaugucagacgccugagggcgcuaucaauaccucccuccccuuccagaacauccacccgauuacaaucggcaagugcccuaaauauguuaagagcaccaagcugagacuugccacagggcugcggaaugugcccucuauucagagccgcggacucuuuggcgcuaucgccggguucauugaaggaggcuggaccgggauggucgacggaugguacggcuaucaucaccaaaacgagcagggcuccggguacgccgcugaccugaaaucuacgcagaaugcgaucgauaagaucacaaacaaagugaauagcguuauugagaagaugaacacccaguuuaccgccgugggaaaagaguucaaucaccuugagaagagaaucgaaaaccugaauaagaaagucgacgauggcuuccucgacauuuggacauacaacgcugagcugcuggugcuccuggaaaaugagcggacccuugauuaucaugacuccaacgucaagaaccuguacgagaaagugcgcaaucaacucaagaacaaugccaaagaaaucgggaacggauguuuugaguucuaucacaagugcgauaauacauguauggaaagcguuaagaacggcacguacgacuauccuaaauacucugaggaagccaagcugaauagagagaaaauugauggggugaaacuugaguccacccggaucuaucagauccuggcuauuuacagcacagucgccucuucccucgugcugguugugagccugggcgcgaucuccuuuuggaugugcucuaacggaagccuccagugccgcauuuguaucuga

SEQ ID NO: 195734 - RNA, 1701 nt, Artificial Sequence; identical to SEQ ID NO: 193064
  derived and/or modified sequence opt5 from hemagglutinin__InfluenzaA__AIM56204

SEQ ID NO: 195735 - RNA, 1701 nt, Artificial Sequence; identical to SEQ ID NO: 193064
  derived and/or modified sequence opt5 from hemagglutinin__InfluenzaA__AIM56215

SEQ ID NO: 195736 - RNA, 1701 nt, Artificial Sequence; identical to SEQ ID NO: 193064
  derived and/or modified sequence opt5 from hemagglutinin__InfluenzaA__AIM56226

SEQ ID NO: 195737 - RNA, 1701 nt, Artificial Sequence; identical to SEQ ID NO: 195475
  derived and/or modified sequence opt5 from hemagglutinin__InfluenzaA__AIM56237

SEQ ID NO: 195738 - RNA, 1701 nt, Artificial Sequence; identical to SEQ ID NO: 193064
  derived and/or modified sequence opt5 from hemagglutinin__InfluenzaA__AIM56259

SEQ ID NO: 195739 - RNA, 1701 nt, Artificial Sequence
  derived and/or modified sequence opt5 from hemagglutinin__InfluenzaA__AIM56270
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcugugaauaccucccuccccuuccagaacauccacccgauuacaaucggcaagugcccuaaauauguuaagagcaccaagcugagacuugccacagggcugcggaaugugcccucuauucagagccgcggacucuuuggcgcuaucgccggguucauugaaggaggcuggaccgggauggucgacggaugguacggcuaucaucaccaaaacgagcagggcuccggguacgccgcugaccugaaaucuacgcagaaugcgaucgauaagaucacaaacaaagugaauagcguuauugagaagaugaacacccaguuuaccgccgugggaaaagaguucaaucaccuugagaagagaaucgaaaaccugaauaagaaagucgacgauggcuuccucgacauuuggacauacaacgcugagcugcuggugcuccuggaaaaugagcggacccuugauuaucaugacuccaacgucaagaaccuguacgagaaagugcgcaaucaacucaagaacaaugccaaagaaaucgggaacggauguuuugaguucuaucacaagugcgauaauacauguauggaaagcguuaagaacggcacguacgacuauccuaaauacucugaggaagccaagcugaauagagagaaaauugauggggugaaacuugaguccacccggaucuaucagauccuggcuauuuacagcacagucgccucuucccucgugcugguugugagccugggcgcgaucuccuuuuggaugugcucuaacggaagccuccagugccgcauuuguaucuga

SEQ ID NO: 195740 - RNA, 1701 nt, Artificial Sequence; identical to SEQ ID NO: 193064
  derived and/or modified sequence opt5 from hemagglutinin__InfluenzaA__AIM56281

SEQ ID NO: 195741 - RNA, 1701 nt, Artificial Sequence
  derived and/or modified sequence opt5 from hemagglutinin__InfluenzaA__AIM56292
augaaggccauccuggugguccuccuguacacccuugcuacagccaacgcggacacgcugugcauuggcuaucacgcuaauaacagcaccgauacaguugacaccgugcucgagaaaaaugugacagucacccauuccgugaaccugcuugaagauaagcacaaugggaaacuguguaagcucagaggaguugcuccccugcaucugggcaaaugcaacaucgccggguggauucucggaaauccugagugugaaucucugagcacagccuccucuuggagcuacaucguggagaccuccucuagcgacaacggcacgugcuauccgggggauuucauuaauuacgaggaacuucgggagcagcuguccagcgucucuuccuuugaacgcuucgagaucuuucccaagaccagcucuuggccuaaccacgacuccaauaagggagugacagccgcuuguccccaugccggcgcgaaaucuuucuauaagaaccucaucuggcugguuaaaaagggcaauagcuacccuaaacuuucccaaagcuauauuaacgauaaggggaaggaaauccuggugcucuggggcauucaccaccccuccaccacagccgaccagcagucucuguaccagaaugcugaugccuacgucuuugugggaaccagcagauauuccaaaaaguucaaaccugagaucgcuauucggccgaaggugcgcgaccaagaggggagaaugaacuacuauuggacgcuggucgaacccggagauaaaaucacauuugaggccaccggcaaccucguugugccucgguacgcguucacaauggaacgcaaugccgggagcggaauuaucaucucugacacccccgugcaugauugcaacaccacaugucagacgccugagggcgcuauuaauaccucccugcccuuucagaacauccacccgauuacaaucggcaagugcccuaaauaugucaagagcaccaaacuuagacuggccacagggcuccggaaugugcccucuauucagagccgcggacuguucggcgcuaucgccggguuuaucgaaggaggcuggaccgggaugguugacggaugguacggcuaucaucaccaaaacgagcagggcuccggguacgccgcugaccuuaagucuacgcagaaugcgauugauaagaucacaaacaaagugaauagcgucauugagaagaugaacacccaguucaccgccgugggaaaagaauuuaaucaccuggagaagagaaucgaaaaccucaauaagaaaguugacgauggcuuccuggacauuuggacauacaacgcugagcugcucgugcugcuugaaaaugagcggacccuggauuaucaugacuccaacgucaagaaccucuacgagaaagugcgcaaucaacugaagaacaaugccaaagaaaucgggaacggauguuucgaguuuuaucacaagugcgauaauacauguauggaaagcgucaagaacggcacguacgacuauccuaaauacucugaggaagccaaacuuaauagagagaagaucgauggggugaagcuggaguccacccggauuuaucagauccucgcuauuuacagcacaguugccucuucccuggugcuggucgugagccucggcgcgaucuccuucuggaugugcucuaacggaagccugcagugccgcauuuguaucuga

SEQ ID NO: 195742 - RNA, 1701 nt, Artificial Sequence
  derived and/or modified sequence opt5 from hemagglutinin__InfluenzaA__AIM56303
augaaggccauccuggugguccuccuguacacccuugcuacagccaacgcggacacgcugugcauuggcuaucacgcuaauaacagcaccgauacaguugacaccgugcucgagaaaaaugugacagucacccauuccgugaaccugcuugaagauaagcacaaugggaaacuguguaagcucagaggaguugcuccccugcaucugggcaaaugcaacaucgccggguggauucucggaaauccugagugugaaucucugagcacagccuccucuuggagcuacaucguggagaccuccucuagcgacaacggcacgugcuauccgggggauuucauuaauuacgaggaacuucgggagcagcuguccagcgucucuuccuuugaacgcuucgagaucuuucccaagaccagcucuuggccuaaccacgacuccaauaagggagugacagccgcuuguccccaugccggcgcgaaaucuuucuauaagaaccucaucuggcugguuaaaaagggcaauagcuacccuaaacuuucccaaagcuauauuaacgauaaggggaaggaagugcugguccucuggggaauccaccaccccuccaccacagccgaccagcagucucuguaccagaaugcugaugccuacguguuugugggcaccagcagauauuccaaaaaguucaaaccugagauugcuauccggccgaagguccgcgaccaagaggggagaaugaacuacuauuggacgcugguugaacccggagauaaaauuacauuugaggccaccggcaaccucguggugccucgguacgcguucacaauggaacgcaaugccgggagcggaaucauuaucucugacacccagguccaugauugcaacaccacaugucagacgcccgagggcgcuaucaauaccucccugccuuuucagaacauucaccccaucacaauuggcaagugcccgaaauauguuaagagcaccaaacuuagacuggccacagggcuccggaaugugccuucuauccaaagccgcggacuguucggcgcuauugccggguuuaucgaaggaggcuggaccgggaugguggacggaugguacggcuaucaucaccagaacgagcagggcuccggguacgccgcugaccuuaagucuacgcagaaugcgaucgauaagauuacaaacaaagucaauagcgugaucgagaagaugaacacccaauucaccgccguuggaaaagaauuuaaucaccuggagaagagaauugaaaaccucaauaagaaaguggacgauggcuuccuggacaucuggacauacaacgcugagcugcucguccugcuugaaaaugagcggacccuggauuaucaugacuccaacgugaagaaccucuacgagaaaguccgcaaucagcugaagaacaaugccaaagaaauugggaacggauguuucgaguuuuaucacaagugcgauaauacauguauggaaagcgugaagaacggcacguacgacuaucccaaauacucugaggaagccaaacuuaauagagagaagaucgaugggguuaagcuggaguccacccggaucuaucagauucucgcuaucuacagcacaguggccucuucccugguccuggugguuagccucggcgcgauuuccuucuggaugugcucuaacggaagccugcaaugccgcaucuguauuuga

SEQ ID NO: 195743 - RNA, 1701 nt, Artificial Sequence
  derived and/or modified sequence opt5 from hemagglutinin__InfluenzaA__AIM56314
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauauguuaagagcaccaagcugagacuugccacagggcugcggaaugugcccucuauccagagccgcggacucuuuggcgcuauugccggguucaucgaaggaggcuggaccgggaugguggacggaugguacggcuaucaucaccaaaacgagcagggcuccggguacgccgcugaccugaaaucuacgcagaaugcgaucgauaagauuacaaacaaagucaauagcgugaucgagaagaugaacacccaguuuaccgccguuggaaaagaguucaaucaccuugagaagagaauugaaaaccugaauaagaaaguggacgauggcuuccucgacaucuggacauacaacgcugagcugcugguccuccuggaaaaugagcggacccuugauuaucaugacuccaacgugaagaaacuguacgagaagguccgcaaccaacucaaaaauaacgccaaggaaauugggaauggauguuuugaguucuaucacaagugcgauaacacauguauggaaagcgugaaaaauggcacguacgacuauccuaaguacucugaggaagccaaacugaacagagagaagaucgaugggguuaaacuugaguccacccggaucuaucagauucuggcuaucuacagcacaguggccucuucccucguccuggugguuagccugggcgcgauuuccuuuuggaugugcucuaauggaagccuccagugccgcaucuguauuuga

SEQ ID NO: 195744 - RNA, 1701 nt, Artificial Sequence; identical to SEQ ID NO: 193064
  derived and/or modified sequence opt5 from hemagglutinin__InfluenzaA__AIM56325

SEQ ID NO: 195745 - RNA, 1701 nt, Artificial Sequence
  derived and/or modified sequence opt5 from hemagglutinin__InfluenzaA__AIM56336
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauauguuaagagcaccaagcugagacuugccacagggcugcggaauauccccucuauucagagccgcggacucuuuggcgcuaucgccggguucaucgaaggaggcuggaccgggaugguggacggaugguacggcuaucaucaccaaaacgagcagggcuccggguacgccgcugaccugaaaucuacgcagaaugcgauugauaagaucacaaacaaagugaauagcgucauugagaagaugaacacccaguuuaccgccgugggaaaagaguucaaucaccuugagaagagaaucgaaaaccugaauaagaaaguugacgauggcuuccucgacauuuggacauacaacgcugagcugcuggugcuccuggaaaaugagcggacccuugauuaucaugacuccaacgucaagaaccuguacgagaaaauccgcaaucaacucaagaacaaugccaaagaaaucgggaacggauguuuugaguucuaucacaagugcgauaauauguguauggaaagcgugaagaacggcacauacgacuauccuaaauacucugaggaagccaagcugaauagagagaaaauugauggggucaaacuugaguccacgcggaucuaucagauucuggcuaucuacagcaccguggccucuucccucguucugguggucagccugggcgcgauuuccuuuuggaugugcucuaacggaagccuccagugccgcaucuguauuuga

SEQ ID NO: 195746 - RNA, 1701 nt, Artificial Sequence
  derived and/or modified sequence opt5 from hemagglutinin__InfluenzaA__AIM56347
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacaaccuccucuuggagcuacaucguggagacguccucuagcgacaacgggaccugcuauccgggcgauuuuauuaauuacgaagaacugcgggagcagcuuuccagcgucucuuccuucgaacgcuuugagaucuuccccaagacaagcucuuggccuaaccacgacuccaauaagggagugaccgccgccuguccccaugcuggcgccaagagcuuuuauaagaaccugaucuggcucguuaaaaagggcaauucuuacccuaaacugucccaaagcuauauuaacgauaaggggaaggaagugcuuguccuguggggaauccaccaccccuccacaaccgcggaccagcagucucucuaccagaaugccgaugcuuacguguucgugggcacgagcagauauuccaaaaaguuuaaaccugagauugccauccggccgaagguccgcgaccaagaggggagaaugaacuacuauuggacacugguugaacccggagauaaaauuaccuucgaggcuacaggcaaccugguggugccucgguacgccuuuaccauggaacgcaaugcggggagcggaaucauuaucucugacacccccguccaugauugcaacacaacgugucagaccccugagggcgccaucaauacaucccuccccuuccagaacauucacccgaucaccauuggcaagugcccuaaauauguuaagagcacaaagcugagacuugcuaccgggcugcggaaugugcccucuauccagagccgcggacucuuuggcgccauugcuggguucaucgaaggaggcuggacggggaugguggacggaugguacggcuaucaucaccaaaacgagcagggcuccggguacgccgccgaccugaaaucuacacagaaugcuaucgauaagauuaccaacaaagucaauagcgugaucgagaagaugaacacccaguuuacagcgguuggaaaagaguucaaucaccuugagaagagaauugaaaaccugaauaagaaaguggacgauggcuuccucgacaucuggaccuacaacgccgagcugcugguccuccuggaaaaugagcggacacuugauuaucaugacuccaacgugaagaaccuguacgagaaaguccgcaaucaacucaagaacaaugcuaaagaaauugggaacggauguuuugaguucuaucacaagugcgauaauacguguauggaaagcgugaagaacggcaccuacgacuauccuaaauacucugaggaagccaagcugaauagagagaaaaucgaugggguuaaacuugaguccacacggaucuaucagauucuggccaucuacagcaccguggcuucuucccucguccuggugguuagccugggcgccauuuccuuuuggaugugcucuaacggaagccuccagugccgcaucuguauuuga

SEQ ID NO: 195747 - RNA, 1701 nt, Artificial Sequence
  derived and/or modified sequence opt5 from hemagglutinin__InfluenzaA__AIM56358
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguuaaacccggagauaagauuacauucgaagccaccggcaaccugguggugccucgguacgcguuuacaauggagcgcaaugccgggagcggaaucauuaucucugacacccccguccaugauugcaacaccacaugucagacgccugaaggcgcuaucaauaccucccuccccuuccagaacauucacccgaucacaauuggcaaaugcccuaaguauguuaagagcaccaaacugagacuugccacagggcugcggaaugugcccucuauccagagccgcggacucuuuggcgcuauugccggguucaucgagggaggcuggaccgggaugguggacggaugguacggcuaucaucaccaaaacgaacagggcuccggguacgccgcugaccugaagucuacgcagaaugcgaucgauaaaauuacaaacaaggucaauagcgugaucgagaaaaugaacacccaguuuaccgccguuggaaaggaguucaaucaccuugaaaagagaauugagaaccugaauaaaaagguggacgauggcuuccucgacaucuggacauacaacgcugaacugcugguccuccuggagaaugaacggacccuugauuaucaugacuccaacgugaaaaaccuguacgagaagguccgcaaucaacucaaaaacaaugccaaggagauugggaacggauguuuugaguucuaucacaagugcgauaauacauguauggagagcgugaaaaacggcacguacgacuauccuaaguacucugaagaggccaaacugaauagagaaaagaucgaugggguuaaacuugaguccacccggaucuaucagauucuggcuaucuacagcacaguggccucuucccucguccuggugguuagccugggcgcgauuuccuuuuggaugugcucuaacggaagccuccagugccgcaucuguauuuga

SEQ ID NO: 195748 - RNA, 1701 nt, Artificial Sequence; identical to SEQ ID NO: 193064
  derived and/or modified sequence opt5 from hemagglutinin__InfluenzaA__AIM56369

SEQ ID NO: 195749 - RNA, 1701 nt, Artificial Sequence
  derived and/or modified sequence opt5 from hemagglutinin__InfluenzaA__AIM56380
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauauguuaagagcaccaagcugagacuugccacagggcugcggaaugugcccucuauccagagccgcggacucuuuggcgcuauugccggguucaucgaaggaggcuggaccgggaugguggacggaugguacggcuaucaucaccaaaacgagcagggcuccggguacgccgcugaccugaaaucuacgcagaaugcgaucgauaagauuacaaacaaagucaauagcgugaucgagaagaugaacacccaguuuaccgccguuggaaaagaguucaaucaccuugagaagagaauugaaaaccugaauaagaaaguggacgauggcuuccucgacaucuggacauacaacgcugagcugcugguccuccuggaaaaugagcggacccuugauuaucaugacuccaacgugaagaaccuguacgagaaaguccgcaaucaacucaagaacaaugccaaagaaauugggaacggauguuuugaguucuaucacaagugcgauaauacauguauggaaagcgugaagaacggcacguacgacuauccuaaauacucugaggaagccaagcuguccagagagaaaaucgaugggguuaaacuugagagcacccggaucuaucagauucuggcuaucuacucuacaguggccuccagccucguccuggugguuucccugggcgcgauuucuuuuuggaugugcagcaauggaucccuccagugccgcaucuguauuuga

SEQ ID NO: 195750 - RNA, 1701 nt, Artificial Sequence; identical to SEQ ID NO: 193064
  derived and/or modified sequence opt5 from hemagglutinin__InfluenzaA__AIM56391

SEQ ID NO: 195751 - RNA, 1701 nt, Artificial Sequence; identical to SEQ ID NO: 193064
  derived and/or modified sequence opt5 from hemagglutinin__InfluenzaA__AIM56402

SEQ ID NO: 195752 - RNA, 1701 nt, Artificial Sequence; identical to SEQ ID NO: 194917
  derived and/or modified sequence opt5 from hemagglutinin__InfluenzaA__AIM56413

SEQ ID NO: 195753 - RNA, 1701 nt, Artificial Sequence; identical to SEQ ID NO: 193064
  derived and/or modified sequence opt5 from hemagglutinin__InfluenzaA__AIM56425

SEQ ID NO: 195754 - RNA, 1701 nt, Artificial Sequence; identical to SEQ ID NO: 193064
  derived and/or modified sequence opt5 from hemagglutinin__InfluenzaA__AIM56436

SEQ ID NO: 195755 - RNA, 1701 nt, Artificial Sequence; identical to SEQ ID NO: 193064
  derived and/or modified sequence opt5 from hemagglutinin__InfluenzaA__AIM56447

SEQ ID NO: 195756 - RNA, 1701 nt, Artificial Sequence; identical to SEQ ID NO: 193064
  derived and/or modified sequence opt5 from hemagglutinin__InfluenzaA__AIM56469

SEQ ID NO: 195757 - RNA, 1701 nt, Artificial Sequence
  derived and/or modified sequence opt5 from hemagglutinin__InfluenzaA__AIM56480
augaaggccauccuggugguccuccuguacaccuucgcuacaacgaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauuaauuacgaagaacugcgggagcagcuuuccagcgucucuuccuucgaacgcuuugagaucuuccccaagacaagcucuuggccuaaccacgacuccaauaagggagugaccgcugccuguccccaugcuggcgccaagagcuuuuauaagaaccugaucuggcucguuaaaaagggcaauucuuacccuaaacugucccaaagcuauauuaacgauaaggggaaggaagugcuuguccuguggggaauccaccaccccuccacaaccgcggaccagcagucucucuaccagaaugccgaugcuuacguguucgugggcacgagcagauauuccaaaaaguuuaaaccugagauugccauccggccgaagguccgcgaccaagaggggagaaugaacuacuauuggacacugguugaacccggagauaaaauuaccuucgaggcuacaggcaaccugguggugccucgguacgccuuuaccauggaacgcaaugcggggagcggaaucauuaucucugacacccccguccaugauugcaacacaacgugucagaccccugagggcgccaucaauacaucccuccccuuccagaacauucacccgaucacccugggcaagugcccuaaauauguuaagagcacaaaacuuagacuggcuaccgggcuccggaaugugcccucuauucagagccgcggacuguuuggcgccaucgcuggguucauugaaggaggcuggacggggaugguggacggaugguacggcuaucaucaccaaaacgagcagggcuccggguacgccgccgaccuuaaaucuacacagaaugcuaucgauaagaucaccaacaaagucaauagcgugauugagaagaugaacacccaguuuacagcgguuggaaaagaguucaaucaccuggagaagagaaucgaaaaccucaauaagaaaguggacgauggcuuccuggacauuuggaccuacaacgccgagcugcucguccugcuugaaaaugagcggacacuggauuaucaugacuccaacgugaagaaccucuacgagaaaguccgcaaucaacugaagaacaaugcuaaagaaaucgggaacggauguuuugaguucuaucacaagugcgauaauacguguauggaaagcgugaagaacggcaccuacgacuauccuaaauacucugaggaagccaaacuuaauagagagaagauugaugggguuaagcuggaguccacacggaucuaucagauccucgccauuuacagcaccguggcuucuucccugguccuggugguuagccucggcgccaucuccuuuuggaugugcucuaacggaagccugcagugccgcauuuguaucuga

SEQ ID NO: 195758 - RNA, 1701 nt, Artificial Sequence; identical to SEQ ID NO: 193064
  derived and/or modified sequence opt5 from hemagglutinin__InfluenzaA__AIM56491

SEQ ID NO: 195759 - RNA, 1710 nt, Artificial Sequence
  derived and/or modified sequence opt5 from hemagglutinin__InfluenzaA__AIM56502
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaaggccagcucuuggccuaaccacgacuccaauaagggagugaccgcugccuguccccaugcgggcgccaagagcuuuuauaagaaccugaucuggcucguuaaaaagggcaauucuuacccuaaacugucccaaagcuauauuaacgauaaggggaaggaagugcuuguccuguggggaauccaccaccccuccacaaccgcugaccagcagucucucuaccagaaugccgaugcuuacguguucgugggcacaagcagauauuccaaaaaguuuaaaccugagauugccauccggccgaagguccgcgaccaagaggggagaaugaacuacuauuggacccugguugaacccggagauaaaauuacguucgaggcgacaggcaaccugguggugccucgguacgccuuuaccauggaacgcaaugcugggagcggaaucauuaucucugacacacccguccaugauugcaacaccaccugucagacaccugagggcgccaucaauacgucccucaccagccugcccuuccagaacauucacccgaucacaauuggcaagugcccuaaauaugugaagucuaccaaacuuagacuggcuacagggcuccggaauauccccagcauucagucccgcggacuguuuggcgccaucgccggguucaucgaaggaggcuggaccgggaugguugacggaugguacggcuaucaucaccaaaacgagcagggcucuggguacgcugcggaccuuaaaagcacgcagaaugccauugauaagaucacaaacaaagucaauuccgugauugagaagaugaacacccaguuuaccgcugugggaaaagaguucaaucaccuggagaagagaaucgaaaaccucaauaagaaaguugacgauggcuuccuggacauuuggacauacaacgccgagcugcucgugcugcuugaaaaugagcggacccuggauuaucaugacagcaacgucaagaaccucuacgagaaagugcgcaaucaacugaagaacaaugccaaagaaaucgggaacggauguuuugaguucuaucacaagugcgauaauacauguauggaaucugucaagaacggcacguacgacuauccuaaauacuccgaggaagcuaaacuuaauagagagaagaucgauggggugaagcuggagagcacccggauuuaucagauccucgccauuuacucuacaguugcguccagccuggugcuggucgugucccucggcgcuaucucuuuuuggaugugcagcaacggaucccugcagugccgcauuuguaucuga

SEQ ID NO: 195760 - RNA, 1701 nt, Artificial Sequence; identical to SEQ ID NO: 193064
  derived and/or modified sequence opt5 from hemagglutinin__InfluenzaA__AIM56513

SEQ ID NO: 195761 - RNA, 1701 nt, Artificial Sequence; identical to SEQ ID NO: 195009
  derived and/or modified sequence opt5 from hemagglutinin__InfluenzaA__AIM56524

SEQ ID NO: 195762 - RNA, 1701 nt, Artificial Sequence; identical to SEQ ID NO: 193064
  derived and/or modified sequence opt5 from hemagglutinin__InfluenzaA__AIM56535

SEQ ID NO: 195763 - RNA, 1701 nt, Artificial Sequence; identical to SEQ ID NO: 193064
  derived and/or modified sequence opt5 from hemagglutinin__InfluenzaA__AIM56546

SEQ ID NO: 195764 - RNA, 1701 nt, Artificial Sequence; identical to SEQ ID NO: 194917
  derived and/or modified sequence opt5 from hemagglutinin__InfluenzaA__AIM56557

SEQ ID NO: 195765 - RNA, 1701 nt, Artificial Sequence
  derived and/or modified sequence opt5 from hemagglutinin__InfluenzaA__AIM56568
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuucagcaagaccucuuccuggcccaaccacgacagcaauaagggagugacagccgcuuguccucaugccggcgcgaaaucuuuuuauaagaaccugaucuggcucguuaaaaagggcaauuccuaccccaaacugagccaauccuauauuaacgauaaggggaaggaagugcuuguccuguggggaauccaccacccuucuaccacagccgaccagcagagccucuaccagaaugcugaugccuacguguucgugggcaccuccagauauagcaaaaaguuuaaacccgagauugcuauccggccuaagguccgcgaccaagaggggagaaugaacuacuauuggacgcugguugaaccgggagauaaaauuacauucgaggccaccggcaaccugguggugccccgguacgcguuuacaauggaacgcaaugccgggucuggaaucauuaucuccgacaccccuguccaugauugcaacaccacaugucagacgcccgagggcgcuaucaauaccagccucccuuuccagaacauucaccccaucacaauuggcaagugcccgaaauaugugaagucuaccaagcugagacuugccacagggcugcggaauguuccuagcauccagucccgcggacucuuuggcgcuauugccggguucaucgaaggaggcuggaccgggaugguggacggaugguacggcuaucaucaccaaaacgagcagggcucuggguacgccgcugaccugaaaagcacgcagaaugcgaucgauaagauuacaaacaaagucaauuccgugaucgagaagaugaacacccaguuuaccgccguuggaaaagaguucaaucaccuugagaagagaauugaaaaccugaauaagaaaguggacgauggcuuccucgacaucuggacauacaacgcugagcugcugguccuccuggaaaaugagcggacccuugauuaucaugacagcaacgugaagaaccuguacgagaaaguccgcaaucaacucaagaacaaugccaaagaaauugggaacggauguuuugaguucuaucacaagugcgauaauacauguauggaaucugugaagaacggcacguacgacuaucccaaauacuccgaggaagccaagcugaauagagagaaaaucgaugggguuaaacuugagagcacccggaucuaucagauucuggcuaucuacucuacaguggccuccagccucguccuggugguuucccugggcgcgauuucuuuuuggaugugcagcaacggaucccuccagugccgcaucuguauuuga

SEQ ID NO: 195766 - RNA, 1701 nt, Artificial Sequence
  derived and/or modified sequence opt5 from hemagglutinin__InfluenzaA__AIM56579
augaaggccauccuggugguccuccuguacaccuucgcuacaacgaacgccgacacccuuugcauuggcuaucacgcgaauaacagcacagauaccguugacacagugcuggagaaaaaugugaccgucacacauuccgugaaccuccuggaagaugagcacaaugggaaacuuuguaaacugagaggaguugcuccccuccaucugggcaagugcaacaucgccggguggauucugggaaauccugaaugugagucucucagcaccgccuccucuuggagcuacaucguggaaacguccucuagcgacaacgggaccugcuauccgggcgauuuuauuaauuacgaggagcugcgggaacagcuuuccagcgucucuuccuucgagcgcuuugaaaucuuccccaaaacaagcucuuggccuaaccacgacuccaauaagggagugaccgcugccuguccccaugcuggcgccaagagcuuuuauaaaaaccugaucuggcucguuaagaaaggcaauucuuacccuaagcugucccaaagcuauauuaacgauaaagggaaggaggugcuuguccuguggggaauccaccaccccuccacaaccgcggaccagcagucucucuaccagaauacggaugccuacguguucgugggcacaagcagauauuccaagaaauuuaagccugagauugcuauccggccgaaaguccgcgaccaagaagggagaaugagcuacuauuggacccugguugagcccggagauaagauuacauucgaagccaccggcaaccugguggugccucgguacgcuuuuaccauggagcgcaacgccgggucuggaaucauuaucuccgacacacccguccaugauugcaauacgaccugucagacaccugaaggcgcgaucaacaccagccuccccuuccagaauauucacccgaucacaauuggcaaaugcccuaaguaugugaaaucuaccaagcugagacuugccacggggcugcggaacguucccagcauccagucccgcggacucuuuggcgcuauugccggguucaucgagggaggcuggacagggaugguggacggaugguacggcuaucaucaccaaaaugagcagggcucuggguacgcugccgaccugaaaagcacccagaacgccaucgauaaaauuaccaauaaggucaacuccgugaucgaaaagaugaauacacaguuuaccgcuguuggaaaggaguucaaccaccuugaaaagagaauugagaaucugaacaagaagguggacgauggcuuccucgacaucuggacauacaaugcggaacugcugguccuccuggagaacgagcggacgcuugauuaucaugacagcaaugugaaaaaccuguacgaaaagguccgcaaccaacucaaaaauaacgccaaggagauugggaauggauguuuugaguucuaucacaaaugcgauaacaccuguauggaaucugugaagaauggcacauacgacuauccuaaguacuccgaagaggcuaaacugaacagagagaagaucgaugggguuaaacuugaaagcacccggaucuaucagauucuggccaucuacucuacaguggccuccagccucguccuggugguuucccugggcgcuauuucuuuuuggaugugcagcaauggaucccuccagugccgcaucuguauuuga

SEQ ID NO: 195767 - RNA, 1710 nt, Artificial Sequence
  derived and/or modified sequence opt5 from hemagglutinin__InfluenzaA__AIM56590
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccucacaagccugcccuuccagaacauucacccgaucaccauuggcaagugcccuaaauaugugaagucuacaaaacuuagacuggccaccgggcuccggaauguucccagcauccagucccgcggacuguuuggcgcuauugccggguucaucgaaggaggcuggacggggaugguggacggaugguacggcuaucaucaccaaaacgagcagggcucuggguacgccgcugaccuuaagagcacacagaaugcgaucgauaagauuaccaacaaagucaauuccgugaucgagaagaugaacacccaguuuacagccguuggaaaagaguucaaucaccuggagaagagaauugaaaaccucaauaagaaaguggacgauggcuuccuggacaucuggaccuacaacgcugagcugcucguccugcuugaaaaugagcggacacuggauuaucaugacagcaacgugaagaaccucuacgagaaaguccgcaaucaacugaagaacaaugccaaagaaauugggaacggauguuuugaguucuaucacaagugcgaugacacguguauggaaucugugaagaauggcaccuacgauuauccuaaauacuccgaggaagccaaacuuaacagagagaagaucgacgggguuaagcuggagagcacacggaucuaucagauucucgcuaucuacucuaccguggccuccagccugguccuggugguuucccucggcgcgauuucuuuuuggaugugcagcaauggaucccugcagugccgcaucuguauuuga

SEQ ID NO: 195768 - RNA, 1710 nt, Artificial Sequence
  derived and/or modified sequence opt5 from hemagglutinin__InfluenzaA__AIM56601
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccucacaagccugcccuuccagaacauucacccgaucaccauuggcaagugcccuaaauaugugaagucuacaaaacuuagacuggccaccgggcuccggaauguucccagcauccagucccgcggacuguuuggcgcuauugccggguucaucgaaggaggcuggacggggaugguggacggaugguacggcuaucaucaccaaaacgagcagggcucuggguacgccgcugaccuuaagagcacacagaaugcgaucgauaagauuaccaacaaagucaauuccgugaucgagaagaugaacacccaguuuacagccguuggaaaagaguucaaucaccuggagaagagaauugaaaaccucaauaagaaaguggacgauggcuuccuggacaucuggaccuacaacgcugagcugcucguccugcuugaaaaugagcggacacuggauuaucaugacagcaacgugaagaaccucuacgagaaaguccgcaaucaacugaagaacaaugccaaagaaauugggaacggauguuuugaguucuaucacaagugcgauaauacguguauggaaucugugaagaacggcaccuacgacuauccuaaauacuccgaggaagccaaacuuaauagagagaagaucgaugggguuaagcuggagagcacacggaucuaucagauucucgcuaucuacucuaccguggccuccagccugguccuggugguuucccucggcgcgauuucuuuuuggaugugcagcaacggaucccugcagugccgcaucuguauuuga

SEQ ID NO: 195769 - RNA, 1710 nt, Artificial Sequence
  derived and/or modified sequence opt5 from hemagglutinin__InfluenzaA__AIM56612
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaauaccgggagcggaaucauuaucucugacacccccguccaugauugcaacacaacgugucagaccccugagggcgccaucaauacaucccucaccagccugcccuuccagaacauucacccgaucacaauuggcaagugcccuaaauaugugaagucuaccaaacuuagacuggcuacggggcuccggaauguucccagcauccagucccgcggacuguuuggcgccauugcuggguucaucgaaggaggcuggacagggaugguggacggaugguacggcuaucaucaccaaaacgagcagggcucuggguacgccgccgaccuuaagagcacccagaaugcuaucgauaagauuaccaacaaagucaauuccgugaucgagaagaugaacacacaguuuaccgcgguuggaaaagaguucaaucaccuggagaagagaauugaaaaccucaauaagaaaguggacgauggcuuccuggacaucuggacauacaacgccgagcugcucguccugcuugaaaaugagcggacgcuggauuaucaugacagcaacgugaagaaccucuacgagaaaguccgcaaucaacugaagaacaaugcuaaagaaauugggaacggauguuuugaguucuaucacaagugcgauaauaccuguauggaaucugugaagaacggcacauacgacuauccuaaauacuccgaggaagccaaacuuaauagagagaagaucgaugggguuaagcuggagagcacccggaucuaucagauucucgccaucuacucuacaguggcuuccagccugguccuggugguuucccucggcgccauuucuuuuuggaugugcagcaacggaucccugcagugccgcaucuguauuuga

SEQ ID NO: 195770 - RNA, 1701 nt, Artificial Sequence
  derived and/or modified sequence opt5 from hemagglutinin__InfluenzaA__AIM56623
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaccuggcucguuaaaaagggcaauagcuacccuaaacugucccaaagcuauaucaacgauaaggggaaggaagugcuuguccuguggggcauucaccaccccuccacaaccgccgaccagcagucucucuaccagaaugcugaugccuacguguucgugggaacgagcagauauuccaaaaaguuuaaaccugagaucgcuauucggccgaagguccgcgaccaagaggggagaaugaacuacuauuggacacugguugaacccggagauaaaaucaccuucgaggccacaggcaaccugguggugccucgguacgcguuuaccauggaacgcaaugccgggagcggaauuaucauuucugacacccccguccaugauugcaacacaacgugucagaccccugagggcgcuaucaauacaucccuccccuuccagaacauccacccgauuaccaucggcaagugcccuaaauauguuaagagcacaaagcugagacuugccaccgggcugcggaaugugcccucuauucagagccgcggacucuuuggcgcuaucgccggguucauugaaggaggcuggacggggaugguggacggaugguacggcuaucaucaccaaaacgagcagggcuccggguacgccgcugaccugaaaucuacacagaaugcgaucgauaagaucaccaacaaagucaauagcgugauugagaagaugaacacccaguuuacagccguuggaaaagaguucaaucaccuugagaagagaaucgaaaaccugaauaagaaaguggacgauggcuuccucgacauuuggaccuacaacgcugagcugcugguccuccuggaaaaugagcggacacuugauuaucaugacuccaacgugaagaaccuguacgagaaaguccgcaaucaacucaagaacaaugccaaagaaaucgggaacggauguuuugaguucuaucacaagugcgauaauacguguauggaaagcgugaagaacggcaccuacgacuauccuaaauacucugaggaagccaagcugaauagagagaaaauugaugggguuaaacuugaguccacacggaucuaucagauccuggcuauuuacagcaccguggccucuucccucguccuggugguuagccugggcgcgaucuccuuuuggaugugcucuaacggaagccuccagugccgcauuuguaucuga

SEQ ID NO: 195771 - RNA, 1701 nt, Artificial Sequence
  derived and/or modified sequence opt5 from hemagglutinin__InfluenzaA__AIM56634
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccaacuccuggucuuacaucguggagaccagcuccucugacaauggcacgugcuauccgggggauuuuauuaacuacgaagaacugcgggagcagcuuagcuccgucagcucuuucgaacgcuuugagaucuuccccaagaccuccagcuggccuaaucacgacucuaacaagggagugacagccgcuuguccccaugccggcgcgaaauccuuuuauaagaaucugaucuggcucguuaaaaagggcaacagcuacccuaaacugucucaauccuauauuaaugauaaggggaaggaagugcuuguccuguggggaauccaccaccccagcaccacagccgaccagcagucccucuaccagaacgcugaugccuacguguucgugggcaccucuagauauagcaaaaaguuuaaaccugagauugcuauccggccgaagguccgcgaccaagaggggagaaugaacuacuauuggacgcugguugaacccggagauaaaauuacauucgaggccaccggcaaucugguggugccucgguacgcguuuacaauggaacgcaacgccggguccggaaucauuaucagcgacacccccguccaugauugcaauaccacaugucagacgccugagggcgcuaucaacaccucucuccccuuccagaauauucacccgaucacaauuggcaagugcccuaaauaugugaaguccaccaagcugagacuugccacagggcugcggaacguucccagcauccagucucgcggacucuuuggcgcuauugccggguucaucgaaggaggcuggaccgggaugguggacggaugguacggcuaucaucaccaaaaugagcagggcagcggguacgccgcugaccugaaauccacgcagaacgcgaucgauaagauuacaaauaaagucaacucugugaucgagaagaugaauacccaguuuaccgccguuggaaaagaguucaaccaccuugagaagagaauugaaaaucugaacaagaaaguggacgauggcuuccucgacaucuggacauacaaugcugagcugcugguccuccuggaaaacgagcggacccuugauuaucaugacagcaacgugaagaaucuguacgagaaaguccgcaaccaacucaagaauaacgccaaagaaauugggaauggauguuuugaguucuaucacaagugcgauaacacauguauggaauccgugaagaauggcacguacgacuauccuaaauacagcgaggaagccaagcugaacagagagaaaaucgaugggguuaaacuugagucuacccggaucuaucagauucuggcuaucuacuccacaguggccagcucucucguccuggugguuucccugggcgcgauuagcuuuuggaugugcuccaauggaucucuccagugccgcaucuguauuuga

SEQ ID NO: 195772 - RNA, 1710 nt, Artificial Sequence
  derived and/or modified sequence opt5 from hemagglutinin__InfluenzaA__AIM56645
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccucacaagccugcccuuccagaacauucacccgaucaccauuggcaagugcccuaaauaugugaagucuacaaagcugagacuugccaccgggcuccggaauguucccagcauccagucccgcggacuguuuggcgcuauugccggguucaucgaaggaggcuggacggggaugguggacggaugguacggcuaucaucaccaaaacgagcagggcucuggguacgccgcugaccagaaaagcacacagaaugcgaucgauaagauuaccaacaaagucaauuccgugaucgagaagaugaacacccaauuuacagccguuggaaaagaguucaaucaccuugagaagagaauugaaaaccugaauaagaaaguggacgauggcuuccucgacaucuggaccuacaacgcugagcugcugguccuccuggaaaaugagcggacacuugauuaucaugacagcaacgugaagaaccuguacgagaaaguccgcaaucagcucaagaacaaugccaaagaaauugggaacggauguuuugaguucuaucacaagugcgauaauacguguauggaaucugugaagaacggcaccuacgacuauccuaaauacuccgaggaagccaagcugaauagagagaaaaucgaugggguuaaacuugagagcacacggaucuaucagauucuggcuaucuacucuaccguggccuccagccucguccuggugguuucccugggcgcgauuucuuuuuggaugugcagcaacggaucccuccaaugccgcaucuguauuuga

SEQ ID NO: 195773 - RNA, 1701 nt, Artificial Sequence
  derived and/or modified sequence opt5 from hemagglutinin__InfluenzaA__AIM56656
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccaacagcuggccuaaucacgacucuaacaagggagugacagccgcuuguccccaugccggcgcgaaauccuuuuauaagaaucugaucuggcucguuaaaaagggcaacagcuacccuaaacugucucaauccuauauuaaugauaaggggaaggaagugcuuguccuguggggaauccaccaccccagcaccacagccgaccagcagucccucuaccagaacgcugaugccuacguguucgugggcaccucuagauauagcaaaaaguuuaaaccugagauugcuauccggccgaagguccgcgaccaagaggggagaaugaacuacuauuggacgcugguugaacccggagauaaaauuacauucgaggccaccggcaauaucguggugccucgguacgcguuuacaauggaacgcaacgccggguccggaauuaucaucagcgacacccccguccaugauugcaauaccacaugucagacgccugagggcgcuauuaacaccucucugcccuuccagaauauccacccgauuacaaucggcaagugcccuaaauaugugaaguccaccaagcucagacuggccacagggcuucggaacguucccagcauucagucucgcggacuguuuggcgcuaucgccggguucaucgaaggaggcuggaccgggaugguggacggaugguacggcuaucaucaccaaaaugagcagggcagcggguacgccgcugaccucaaauccacgcagaacgcgauugauaagaucacaaauaaagucaacucugugauugagaagaugaauacccaguuuaccgccguuggaaaagaguucaaccaccuggagaagagaaucgaaaaucuuaacaagaaaguggacgauggcuuccuggacauuuggacauacaaugcugagcuccugguccugcucgaaaacgagcggacccuggauuaucaugacagcaacgugaagaaucuuuacgagaaaguccgcaaccaacugaagaauaacgccaaagaaaucgggaauggauguuuugaguucuaucacaagugcgauaacacauguauggaauccgugaagaauggcacguacgacuauccuaaauacagcgaggaagccaagcucaacagagagaaaaucgaugggguuaagcuggagucuacccggauuuaucagauccuugcuauuuacuccacaguggccagcucucugguccucgugguuucccugggcgcgaucagcuuuuggaugugcuccaauggaucucugcagugccgcauuuguaucuga

SEQ ID NO: 195774 - RNA, 1701 nt, Artificial Sequence; identical to SEQ ID NO: 193064
  derived and/or modified sequence opt5 from hemagglutinin__InfluenzaA__AIM56667

SEQ ID NO: 195775 - RNA, 1701 nt, Artificial Sequence
  derived and/or modified sequence opt5 from hemagglutinin__InfluenzaA__AIM56678
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguucccccucuccaucugggcaaaugcaacaucgccggguggauucugggaaauccggagugugaaucucucagcacagccuccucuuggagcuacaucguggagaccuccucuagcgacaacggcacgugcuaucccggggauuuuauuaauuacgaagaacugcgggagcagcuuuccagcgucucuuccuucgaacgcuuugagaucuucccuaagaccagcucuuggcccaaccacgacuccaauaagggagugacagcugccuguccucaugcuggcgccaagagcuuuuauaagaaccugaucuggcucguuaaaaagggcaauucuuaccccaaacugucccaaagcuauauuaacgauaaggggaaggaagugcuuguccuguggggaauccaccacccuuccaccacagcggaccagcagucucucuaccagaaugccgaugcuuacguguucgugggcaccagcagauauuccaaaaaguuuaaaccggagauugccauccggcccaagguccgcgaccaagaggggagaaugaacuacuauuggacgcugguugaaccuggagauaaaauuacauucgaggcuaccggcaaccugguggugccccgguacgccuuuacaauggaacgcaaugcggggagcggaaucauuaucucugacaccccuguccaugauugcaacaccacaugucagacgcccgagggcgccaucaauaccucccucccguuccagaacauucacccuaucacaauuggcaagugccccaaauauguuaagagcaccaagcugagacuugcuacagggcugcggaaugugccuucuauccagagccgcggacucuuuggcgccauugcuggguucaucgaaggaggcuggaccgggaugguggacggaugguacggcuaucaucaccaaaacgagcagggcuccggguacgccgccgaccugaaaucuacgcagaaugcuaucgauaagauuacaaacaaagucaauagcgugaucgagaagaugaacacccaguuuaccgcgguuggaaaagaguucaaucaccuugagaagagaauugaaaaccugaauaagaaaguggacgauggcuuccucgacaucuggacauacaacgccgagcugcugguccuccuggaaaaugagcggacccuugauuaucaugacuccaacgugaagaaccuguacgagaaaguccgcaaucaacucaagaacaaugcuaaagaaauugggaacggauguuuugaguucuaucacaagugcgauaauacauguauggaaagcgugaagaacggcacguacgacuaucccaaauacucugaggaagccaagcugaauagagagaaaaucgaugggguuaaacuugaguccacccggaucuaucagauucuggccaucuacagcacaguggcuucuucccucguccuggugguuagccugggcgccauuuccuuuuggaugugcucuaacggaagccuccagugccgcaucuguauuuga

SEQ ID NO: 195776 - RNA, 1701 nt, Artificial Sequence; identical to SEQ ID NO: 195412
  derived and/or modified sequence opt5 from hemagglutinin__InfluenzaA__AIM56689

SEQ ID NO: 195777 - RNA, 1701 nt, Artificial Sequence; identical to SEQ ID NO: 193064
  derived and/or modified sequence opt5 from hemagglutinin__InfluenzaA__AIM56700

SEQ ID NO: 195778 - RNA, 1710 nt, Artificial Sequence
  derived and/or modified sequence opt5 from hemagglutinin__InfluenzaA__AIM56711
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguucccccucuccaucugggcaaaugcaacaucgccggguggauucugggaaauccggagugugaaucucucagcacagccuccucuuggagcuacaucguggagaccuccucuagcgacaacggcacgugcuaucccggggauuuuauuaauuacgaagaacugcgggagcagcuuuccagcgucucuuccuucgaacgcuuugagaucuucccuaagaccagcucuuggcccaaccacgacuccaauaagggagugacagcugccuguccucaugcuggcgccaagagcuuuuauaagaaccugaucuggcucguuaaaaagggcaauucuuaccccaaacugucccaaagcuauauuaacgauaaggggaaggaagugcuuguccuguggggaauccaccacccuuccaccacagcggaccagcagucucucuaccagaaugccgaugcuuacguguucgugggcaccagcagauauuccaaaaaguuuaaaccggagauugccauccggcccaagguccgcgaccaagaggggagaaugaacuacuauuggacgcugguugaaccuggagauaaaauuacauucgaggcuaccggcaaccugguggugccccgguacgccuuuacaauggaacgcaaugcggggagcggaaucauuaucucugacaccccuguccaugauugcaacaccacaugucagacgcccgagggcgccaucaauaccucccucacaagccugccguuccagaacauucacccuaucaccauuggcaagugccccaaauaugugaagucuacaaaacuuagacuggcuaccgggcuccggaauguuccuagcauccagucccgcggacuguuuggcgccauugcuggguucaucgaaggaggcuggacggggaugguggacggaugguacggcuaucaucaccaaaacgagcagggcucuggguacgccgccgaccuuaaaagcacacagaaugcuaucgauaagauuaccaacaaagucaauuccgugaucgagaagaugaacacccaguuuacagcgguuggaaaagaguucaaucaccuggagaagagaauugaaaaccucaauaagaaaguggacgauggcuuccuggacaucuggaccuacaacgccgagcugcucguccugcuugaaaaugagcggacacuggauuaucaugacagcaacgugaagaaccucuacgagaaaguccgcaaucaacugaagaacaaugcuaaagaaauugggaacggauguuuugaguucuaucacaagugcgauaauacguguauggaaucugugaagaacggcaccuacgacuaucccaaauacuccgaggaagccaaacuuaauagagagaagaucgaugggguuaagcuggagagcacacggaucuaucagauucucgccaucuacucuaccguggcuuccagccugguccuggugguuucccucggcgccauuucuuuuuggaugugcagcaacggaucccugcagugccgcaucuguauuuga

SEQ ID NO: 195779 - RNA, 1701 nt, Artificial Sequence; identical to SEQ ID NO: 195412
  derived and/or modified sequence opt5 from hemagglutinin__InfluenzaA__AIM56722

SEQ ID NO: 195780 - RNA, 1701 nt, Artificial Sequence; identical to SEQ ID NO: 193064
  derived and/or modified sequence opt5 from hemagglutinin__InfluenzaA__AIM56733

SEQ ID NO: 195781 - RNA, 1701 nt, Artificial Sequence; identical to SEQ ID NO: 193064
  derived and/or modified sequence opt5 from hemagglutinin__InfluenzaA__AIM56744

SEQ ID NO: 195782 - RNA, 1701 nt, Artificial Sequence
  derived and/or modified sequence opt5 from hemagglutinin__InfluenzaA__AIM56755
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuucccacgacagcaacaagggagugacagccgcuuguccccaugccggcgcgaaaucuuuuuauaagaaucugaucuggcucguuaaaaagggcaacuccuacccuaaacugagccaauccuauauuaaugauaaggggaaggaagugcuuguccuguggggaauccaccaccccucuaccacagccgaccagcagagccucuaccagaacgcugaugccuacguguucgugggcaccuccagauauagcaaaaaguuuaaaccugagauugcuauccggccgaagguccgcgaccaagaggggagaaugaauuacuauuggacgcugguugaacccggagauaaaauuacauucgaggccaccggcaaccugguggugccucgguacgcguuuacaauggaacgcaacgccgggucuggaaucauuaucuccgacacccccguccaugauugcaauaccacaugucagacgccugagggcgcuaucaacaccagccuccccuuccagaauauucacccgaucacaauuggcaagugcccuaaauaugugaagucuaccaagcugagacuugccacagggcugcggaacguucccagcauccagucccgcggacucuuuggcgcuauugccggguucaucgaaggaggcuggaccgggaugguggacggaugguacggcuaucaucaccaaaaugagcagggcucuggguacgccgcugaccugaaaagcacgcagaacgcgaucgauaagauuacaaauaaagucaacuccgugaucgagaagaugaauacccaguuuaccgccguuggaaaagaguucaaccaccuugagaagagaauugaaaaucugaacaagaaaguggacgauggcuuccucgacaucuggacauacaaugcugagcugcugguccuccuggaaaacgagcggacccuugauuaucaugacagcaaugugaagaaccuguacgagaaaguccgcaaccaacucaagaauaacgccaaagaaauugggaauggauguuuugaguucuaucacaagugcgauaacacauguauggaaucugugaagaauggcacguacgacuauccuaaauacuccgaggaagccaagcugaacagagagaaaaucgaugggguuaaacuugagagcacccggaucuaucagauucuggcuaucuacucuacaguggccuccagccucguccuggugguuucccugggcgcgauuucuuuuuggaugugcagcaauggaucccuccagugccgcaucuguauuuga

SEQ ID NO: 195783 - RNA, 1710 nt, Artificial Sequence; identical to SEQ ID NO: 195768
  derived and/or modified sequence opt5 from hemagglutinin__InfluenzaA__AIM56766

SEQ ID NO: 195784 - RNA, 1701 nt, Artificial Sequence
  derived and/or modified sequence opt5 from hemagglutinin__InfluenzaA__AIM56777
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagggaagcacaauggaaaacuuuguaagcugagaggcguugcuccccuccaucuggggaaaugcaacaucgccggauggauucugggcaauccugagugugaaucucucagcacagccuccucuuggagcuacaucguggagaccuccucuagcgauaacgggacgugcuauccgggagacuuuauuaauuacgaggaacugcgggagcagcuuuccagcgucucuuccuucgaacgcuuugagaucuuccccaagaccagcucuuggccuaaccacgauuccaauaagggcgugacagccgcuuguccccaugccggcgcgaaaucuuuuuauaagaaccugaucuggcucguuaaaaaggggaauagcuacccuaaacugucccaaagcuauauuaacgacaagggaaaggaagugcuuguccuguggggcauccaccaccccuccaccacagccgaucagcagucucucuaccagaaugcugacgccuacguguucguggggaccagcagauauuccaaaaaguuuaaaccugagauugcuauccggccgaagguccgcgaucaagagggaagaaugaacuacuauuggacgcugguugaacccggcgacaaaauuacauucgaggccaccgggaaccugguggugccucgguacgcguuuacaauggaacgcaaugccggaagcggcaucauuaucucugauacccccguccaugacugcaacaccacaugucagacgccugagggcgcuaucaauaccucccuccccuaucagaacauucacccgaucacaauugggaagugcccuaaauacguuaagagcaccaagcugagacuugccacaggacugcggaaugugcccucuauccagagccgcggccucuucggggcuauugccggauuuaucgaaggcggguggaccggaaugguggauggcugguauggcuaccaucaccaaaacgagcagggguccggauacgccgcugaccugaaaucuacgcagaaugcgaucgacaagauuacaaacaaagucaauagcgugaucgagaagaugaacacccaguucaccgccguuggcaaagaauuuaaucaccuugagaagagaauugaaaaccugaauaagaaaguggaugacggguuccucgauaucuggacauauaacgcugagcugcugguccuccuggaaaaugagcggacccuugacuaccaugauuccaacgugaagaaccuguaugagaaaguccgcaaucaacucaagaacaaugccaaagaaauuggaaacggcuguuucgaguuuuaccacaagugcgacaauacauguauggaaagcgugaagaacgggacguaugauuacccuaaauauucugaggaagccaagcugaauagagagaaaaucgacggcguuaaacuugaguccacccggaucuaccagauucuggcuaucuacagcacaguggccucuucccucguccuggugguuagccugggagcgauuuccuucuggaugugcucuaacggcagccuccagugccgcaucuguauuuga

SEQ ID NO: 195785 - RNA, 1701 nt, Artificial Sequence; identical to SEQ ID NO: 193064
  derived and/or modified sequence opt5 from hemagglutinin__InfluenzaA__AIM56788

SEQ ID NO: 195786 - RNA, 1701 nt, Artificial Sequence; identical to SEQ ID NO: 193064
  derived and/or modified sequence opt5 from hemagglutinin__InfluenzaA__AIM56799

SEQ ID NO: 195787 - RNA, 1701 nt, Artificial Sequence; identical to SEQ ID NO: 193064
  derived and/or modified sequence opt5 from hemagglutinin__InfluenzaA__AIM56810

SEQ ID NO: 195788 - RNA, 1701 nt, Artificial Sequence; identical to SEQ ID NO: 193064
  derived and/or modified sequence opt5 from hemagglutinin__InfluenzaA__AIM56821

SEQ ID NO: 195789 - RNA, 1683 nt, Artificial Sequence
  derived and/or modified sequence opt5 from hemagglutinin__InfluenzaA__AIN76383
augaacacccagauccugguguucgcccucauugcuaucguccccacaaaugccgacaagauuugccugggccaccaugcgguuagcaacgggacgaaagugaauacccuuacagagagaggaguggaagucgugaacgcuaccgagacaguugaacggaccaauaucccucgcauuuguuccaagggcaaaaagacaguggaucuggggcaaugcggacuccugggcaccaucacggggccgccccagugugaccaguuucuugaguucucugccgaucugaucauugaaagacgggagggaagcgacgucugcuacccuggcaaauuugugaacgaggaagcccuccgccagauccugagagaguccggcgggauugauaaggaagcuaugggauucaccuauucuggcauccggacaaaugggaccacaagcgccugucgcagauccggaucuagcuuuuacgcugagaugaaguggcugcucuccaacaccgacaaugccgcguucccccaaaugacgaaaagcuauaagaacacacggaaaucuccugcccugauuguuuggggcauccaccauuccgugagcaccgcugagcagacaaaacuuuacgggucuggaaauaagcuggucaccgugggcuccagcaacuaucagcagucuuuugugcccuccccuggcgcccgcccgcaagucaaugggcucagcggaagaauugauuuccacuggcugaugcuuaaccccaaugacaccguuacauuuuccuucaacggcgcuuuuaucgccccugaucgggcgucuuuccugcgcggaaagagcauggggauccaguccggcguccagguggacgccaacugcgaaggggauuguuaccauagcggaggcacgauuaucucuaaucuccccuuucagaacauugacuccagagcugugggcaagugcccucgguaugugaaacaaaagagccugcugcucgccaccgggaugaaaaauguucccgagaucccgaagggacgcggccuguucggggcuauugccggauucaucgaaaacggcugggaggggcuuaucgauggcugguacggauuuagacaccagaaugcccagggcgaagggacagcugcggacuacaaaucuacccaaagcgccauugaccagaucacaggaaagcugaaccggcucauugagaaaaccaaucagcaguucgagcugaucgauaacgaauuuaaugagguggaaaagcaaauuggcaacgucaucaauuggacgagagacuccaucacagagguguggucuuauaacgcugaacuucugguugccauggagaaucagcacaccauugaucucgccgacagcgagauggauaagcuguacgaacgcgugaaacggcagcugagagagaacgcugaagaggacgggaccggauguuucgaaaucuuucauaagugcgaugacgauuguauggccuccauucgcaauaacacauaugaccacagcaaauaccgggaggaggcgaugcagaacagaauccaaauugauccugucaagcucucuuccggcuauaaagacgugauccugugguucagcuuuggggcuucuugcuucauucuucuggccaucgucaugggccucguguuuaucugcguuaagaauggaaacaugcgcuguaccauuugcaucuga

SEQ ID NO: 195790 - RNA, 1689 nt, Artificial Sequence
  derived and/or modified sequence opt5 from hemagglutinin__InfluenzaA__AIP93103
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucagagugcccgaauggucuuacaucauggagaaagagaacccucgguauagccugugcuaccccggguccuuuaaugauuaugaagaacuuaagcaucugcucucuagcgucaagcacuucgaaaaagugaagauucugccuaaagacggauggacacaacaugagaccgauggcggcuccaaggccugugccguuucugggaaacccagcuuuuuccgcaacaugguguggcuuacaaagaagggaccuaauuacccggucgcuaaaagauccuauaacaauaccagcggcgagcagaugcugaucauuuggggagugcaccaccccaacgacgaagccgagcagcgggcucucuaccagaauguugggacguacgugucugccuccaccagcacacugaacaagcgcucuaccccugaaaucgcggccagacccaaagucuccggccuggggagccggauggaguuuucuuggacacuccuggaugugugggacaccauuuccuucgaaagcacgggaaaucuuguggcuccugaguauggcuuuaagaucuccaaacgcggcucuagcgggaucaugaagacagagggaacccugggcaacugcgaaacaaaaugucaaacaccccucggggccauuaacaccacccugccguuccauaauguccacccucuuacgaucggagagugccccaaguacguuaaguccgaaaaacuggugcucgcuaccggcccuagaaacgugccccagauugagagccgggggcuguuuggagccaucgcgggcuucauugaaggcggguggcagggaauggucgauggcugguauggguaccaucacucuaaugaccagggauccggcuaugccgcugauaaggagagcacacaaaaagccuuugaccgcaucaccaacaagguuaauucugugaucgagaaaaugaacacacaguucgaagcuguggggaaggaguuuagcaaucuggaaaagagacucgagaaccugaauaaaaagauggaagacggcuuccuugaugucuggaccuacaacgccgagcugcucgugcugauggagaaugaacggacgcuugacuuccacgauuccaacguuaaaaaucuguaugacaaggugcgcaugcagcucagagauaacgucaaagagcugggaaauggcuguuuugaguucuaccauaagugcgacgaugaguguaugaacucugugaagaacgggacauacgacuaucccaaauacgaggaagagagcaagcugaaacggaaugaaauuaagggagucaaacucuccagcaugggcguguaucagauccuggccauuuacgcuaccguugcggggucucuuucccuggccaucaugauugcuggaaucagcuuuuggaugugcucuaacggcucccuccaaugcagaaucuguauuuga

SEQ ID NO: 195791 - RNA, 1689 nt, Artificial Sequence; identical to SEQ ID NO: 184679
  derived and/or modified sequence opt5 from hemagglutinin__InfluenzaA__AIP93115

SEQ ID NO: 195792 - RNA, 1701 nt, Artificial Sequence
  derived and/or modified sequence opt5 from hemagglutinin__InfluenzaA__AIR93971
augaaggccauccuggugguccuccuguacaccuucgcuacaacgaacgccgacauucuuugcaucggcuaucacgcgaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacauugccggguggauccugggaaauccugagugugaaucucucagcacagccuccucuuggagcuacauuguggagaccuccucuagcgacaacggcacgugcuauccgggggauuuuaucgacuacgaagaacugcgggagcagcuuuccagcgucucuuccuucgaacgcuuugagaucuuccccaagaccagcucuuggccuaaucacgauuccaacaagggagugacagcugccuguccccaugcuggcgcccggagcuuuuauaaaaaucugauuuggcucguuaagaaaggcaacucuuacccuaagcuguccaaaagcuauaucaaugacaaggggaaggaagugcuuguccuguggggcauucaccaccccuccaccucugcggaucaacagagccucuaccagaacgccgacgcuuacguguucgugggaacauccagauauagcaaaaaguuuaaaccugagaucgccauucgcccgaaggucagagaucgggaggggcgcaugaauuacuauuggacccugguugaacccggagacaaaaucacguucgaggcuacaggcaaccugguggugccuagauacgccuuugcgauggaacggaacgccgggucuggaauuaucaccuccgauacacccguccaugacugcaauaccaccugucagacaccuaagggcgcuaucaacacgagccuccccuuccaaaauauucacccgaucaccauuggcaaaugcccuaaguaugugaagucuacaaaacugcgccuugccaccgggcugagaaacguucccagcauccagucccggggacucuuuggcgcuauugccggguucaucgagggaggcuggacagggaugguggacggaugguacggcuaucaucaccagaaugaacagggcucuggguacgccgcugaucuuaagagcacccaaaacgcgaucgacgagauuacgaauaaagucaacuccgugaucgagaagaugaauacacaguuuaccgccguuggaaaagaguucaaccaccuggagaagcgcauugaaaaucugaacaagaaaguggaugacggcuuccucgauaucuggaccuacaaugcugagcugcugguccuccuggaaaacgagagaacacuugacuaucaugauagcaaugugaagaaccuguacgagaaaguccggucucagcucaagaacaaugccaaagaaauugggaacggauguuuugaguucuaucacaagugcgacaauaccuguauggaauccgugaagaacggcacauacgauuauccuaaauacagcgaggaagccaagcugaaucgcgaggagaucgacgggguuaaacuugaaucuacgagaaucuaucagauucuggcuaucuacuccaccguggccagcucccucguccuggugguuucucugggcgcgauuagcuuuuggaugugcuccaacggaucucuccaaugccggaucuguauuuga

SEQ ID NO: 195793 - RNA, 1701 nt, Artificial Sequence
  derived and/or modified sequence opt5 from hemagglutinin__InfluenzaA__AIR93982
augaaggccauccuggugguccuccuguacaccauugcuacagccaacgcggacacgcuuugcaucggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacauugccggguggauccugggaaauccugagugugaaucucucagcacagccuccucuuggagcuacauuguggagaccuccucuagcgacaacggcacgugcuauccgggggauuucaucgacuacgaggaacugcgggagcagcuuuccagcgucucuuccuuugaacgcuucgagaucuuucccaagaccagcucuuggccuaaucacgauuccaacaagggagugacagccgcuuguccccaugccggcgcgcggagcuucuauaaaaaucugauuuggcucguuaagaaaggcaacucuuacccuaagcuguccaaaagcuauaucaaugacaaggggaaggaagugcuuguccuguggggcauucaccaccccuccaccucugccgaucaacagagccucuaccagaacgcugacgccuacguguuugugggaacauccagauauagcaaaaaguucaaaccugagaucgcuauucgcccgaaggucagagaucgggaggggcgcaugaauuacuauuggacccugguugaacccggagacaaaaucacguuugaggccacaggcaaccugguggugccuagauacgcguucaccauggaacggaacgccgggucuggaauuaucaucuccgauacacccguccaugacugcaauaccaccugucagacaccuaagggcgcuauuaacacgagccuccccuuucaaaauauccacccgauuaccaucggcaaaugcccuaaguaugugaagucuacaaaacugcgccuugccaccgggcugagaaacguucccagcauucagucccggggacucuucggcgcuaucgccggguuuaucgagggaggcuggacagggaugguggacggaugguacggcuaucaucaccagaaugaacagggcucuggguacgccgcugaucuuaagagcacccaaaacgcgauugacgagaucacgaauaaagucaacuccgugauugagaagaugaauacacaguucaccgccguuggaaaagaauuuaaccaccuggagaagcgcaucgaaaaucugaacaagaaaguggaugacggcuuccucgauauuuggaccuacaaugcugagcugcugguccuccuggaaaacgagagaacacuugacuaucaugauagcaaugugaagaaccuguacgagaaaguccggucucagcucaagaccaacgccaaagaaaucgggaauggauguuucgaguuuuaucacaagugcgacaacacauguauggaauccgugaagaauggcacguacgauuauccuaaauacagcgaggaagccaagcugaaccgcgaggagaucgacgggguuaaacuugaaucuaccagaauuuaucagauccuggcuauuuacuccacaguggccagcucccucguccuggugguuucucugggcgcgaucagcuucuggaugugcuccaauggaucucuccaaugccggauuuguaucuga

SEQ ID NO: 195794 - RNA, 1701 nt, Artificial Sequence
  derived and/or modified sequence opt5 from hemagglutinin__InfluenzaA__AIR93993
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugaaaggaguugcuccccuccaucugggcaagugcaacaucgccggguggauucugggaaauccugaguguggcucucucagcacagccuccucuuggagcuacaucguggaaaccuccucuagcgacaacgggacgugcuauccgggagauuuuauugacuacgaggaacugagagagcagcuuuccagcgucucuuccuucgagcgguuugaaaucuuccccaagaccagcucuuggccuaaucacgauuccaacaaaggcgugacagccgcuugucccaaugccggcagcaagucuuuuuauaaaaaccugaucuggcucguuaagaaagggaauagcuacccuaagcugagcaaguccuauauuaacgacaaaggaaaggaggugcuuguccuguggggcauccaucaccccucuaccagcgcggaucaacagucccucuaccagaaugccgacgcuuacguguucguggggacaagccgcuauucuaaaaaguuuaaaccugaaauugccaucagaccgaagguccggggacaggagggccgcauggauuacuauuggacccugguugagcccggggacaaaauuacguucgaagcuacaggaaaccugguggugccuagauacgccuuugcgauggagcggaacaccggcuccggcaucauuaucagcgauacacccguccacgacugcaauaccaucugucaaaccccuaagggggccauuaacacaucucuccccuuccagaauauccauccgauuacgaucggaaagugcccuaaauaugugaaguccaccaaacugcgccuugcuacaggccugagaaacguucccuccauucagucucgggggcucuuuggagccaucgcuggcuucaucgaagggggauggaccggcaugguggacggcugguacggguaucaccaucagaaugagcaaggaagcggcuacgccgccgaucugaaguccacacagaacgcuauugacgaaaucaccaauaaagucaacagcgugauugagaagaugaauacgcaguuuacagcgguugggaaggaguucaaccaccuugaaaaacgcaucgagaaucugaacaagaaaguggaugacggauuccucgauauuuggaccuacaaugccgaacugcugguccuccuggagaacgaaagaacccuugacuaucacgauucuaaugugaagaaccuguacgagaaaguccggucccagcucaagaacaaugcuaaggagaucggcaaaggguguuuugaguucuaucauaagugcgacacaauguguauggaaagcgugaaaaacggcaccuacgauuauccuaaguacucugaagaggccaaacugaaucgcgaagagaucgacggaguuaaacuugaguccacaagaauuuaucaaauccuggccauuuacagcacgguggcuuccucucucguccuggugguuagccugggcgccaucuccuuuuggaugugcucuaacgggagccuccagugccggauuuguaucuga

SEQ ID NO: 195795 - RNA, 1701 nt, Artificial Sequence
  derived and/or modified sequence opt5 from hemagglutinin__InfluenzaA__AIR94000
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacgagcuuccccuuucagaauauucacccgaucacaauuggcaagugcccuaaguaugugaaaucuaccaagcucagacuggcuacagggcuucggaacguucccagcauccagucccgcggacuguucggcgccauugccggguuuaucgagggaggcuggaccgggaugguggacggaugguacggcuaucaucaccagaaugaacaaggcucuggguacgcugcggaucucaaaagcacacagaacgccaucgacgagauuaccaauaaggucaacuccgugaucgagaaaaugaauacgcaguucacagcuguuggaaaggaguucaaccaccuggagaagagaauugaaaaucuuaacaaaaagguggaugacggcuuucuggauaucuggaccuacaaugccgagcuccugguccugcucgaaaacgagcggacccuggacuaucaugauagcaaugugaaaaaccuuuacgagaagguccgcucucagcugaaaacaaacgccaaggaaauugggaauggauguuucgaguuuuaucacaagugcgacaacaccuguauggaauccgugaaaaauggcacauacgauuauccuaaguacagcgaggaagcuaaacucaacagagaggagaucgacgggguuaagcuggaaucuacgcggaucuaucaaauucuugccaucuacuccaccguggcgagcucccugguccucgugguuucucugggcgcuauuagcuucuggaugugcuccaauggaucucugcagugccgcaucuguauuuga

SEQ ID NO: 195796 - RNA, 1683 nt, Artificial Sequence
  derived and/or modified sequence opt5 from hemagglutinin__InfluenzaA__AIR94116
auggagaccgccagccugaucacaauucuccugguggucacgguuuccaacgcugacaagaucugcauuggcuaccagucuaccaauagcacagaaaccguggauacacuuaccgagaacaaugugcccgucacacacgccaaggaacugcuccauaccgagcacaacgggaugcugugugcgacgucccuuggacauccucugauccucgauaccugcacaauugaaggccugaucuaugggaauccgucuugugaccugcuccugggaggcagagaguggagcuacaucguggagcggcccuccgcuguuaacgggcuuugcuauccuggaaauguggaaaaccuggaggaacuccgcucucuguucagcuccgccagaagcuaccaacggauucagaucuuucccgacaccauuuggaaugucucuuauuccggcacaagcaaggccuguucugauuccuucuaccgcagcaugagauggcuuacccagaaagacaacgcuuauccuauccaggaugcccaauacacgaauaaccagggcaagaauauucuguuuaugugggggaucaaccaucccccuacagacaccgcucagacaaaucucuacacccggaccgauacaacgaccucuguggccacagaggagauuaaccgcaccuucaaaccgcugaucggacccagaccucugguuaacggccucauggggcggaucaauuauuacugguccgugcugaagcccggacagacacuucgcauuaagagcaacggcaaucugaucgcgccuugguaugggcacauucucuccggagaaucucacggcagaauccugaaaaccgaccuuaagcggggcagcugcacgguccaaugucagacagagaaagggggacugaacaccacccuccccuuucagaauguguccaaguacgccuucggcaacugcagcaaauauauugggaucaagucucugaagcuggcugugggacuccgcaaugucccguccagaagcucucggggccuguuuggggccaucgcuggauucauugaaggcggcuggagcgggcuuguugccggaugguacggcuuucagcacuccaacgaucaaggggugggaauggcggccgaccgcgauucuacacagaaagcuaucgacaagauuaccagcaaagugaauaacaucgucgacaagaugaauaaacaguaugagauuaucgaucaugaguucaacgaaguggagacaagacugaauaugaucaacaauaagauugacgaucaaauccaggacauuugggccuacaacgcugaacuccugguucuucuggagaaccagaaaacgcucgaugaacacgacgccaaugugaacaaucuguacaacaaggucaagcgggcccugggcuccaaugcuguggaggaugggaaaggcuguuuugaacucuaucauaagugcgacgaucaguguauggagaccaucagaaacggaacauacaaucgccggaaauaucaagaggaaagcaagcuggagagacagaaaauugaaggcguuaaacuugagucugaagggaccuacaagauccugacaauuuauuccaccguggcgagcucucucgucaucgccaugggauucgcugccuuucuguucugggccauguccaacggcagcugccgcugcaauaucuguauuuga

SEQ ID NO: 195797 - RNA, 1701 nt, Artificial Sequence
  derived and/or modified sequence opt5 from hemagglutinin__InfluenzaA__AIT38333
augaagaccaucauuacacugagcuacauccucugccacguguucgcccagaaaauucauggcuccgacucuagcacggcuacccugugucuugggcaccaugccguccccaacggaacacugguuaagaccaucacaaaugaucaaauugaggugaccaacgcgacagaacucgugcaguccucuagcaccggcagaaucugcgacaauccucaccggauccuggaugggaaaaacuguacgcuuauugacgcucugcucggagauccgcauugcgacgaguuucagaauaaggaaugggaucuguucgucgagcgcuccaacgccuauucugacuguuaccccuauuacgugccugauuaugccagccugagaucccucguugcuagcucuggcacccuggaauuuaauaacgaguccuucaauuggacagggaucagccaggacggaaccucuuccagcugccggcgcggcucugugaaauccuuuuucagcagacuuaacuggcugcacggccucgaguacaaguaucccgcccaaaaugucacaaugcugaacaaugaugaauuugacaaacuuuacauuuggggagugcaccauccuuccaccgauucugaccagacgagccuguacguucagacauccgggcgggugaccgucagcacaaagcgcucucagcaaaccgugauccccaacauuggcuccagaccuugggugcgggggaucagcucucgcauuagcauccacuggaccaucgucaagccgggagacauucuccugaucaauuccacaggcaaccugauugcucccagaggguauuucaaaauccggggaggcaagucuagcauuaugcgcuccgaugccccuaucgacaacugugauagcgagugcguuacgcccaauggcaacaucccuaaugacaaacccuuucagaacgugaauagaauuaccuacgggccguguccucgguauaucaagcagaacacacucaagcuggcgaccggaaugcgcaaugugcccgaaaaacagacaagaggcguccuuggggccauugcuggauucaucgagaacggcugggaggggaugguggauggaugguacggcuuucggcaucaaaauucugaaggcaccgggcaggccgcugaccugaaguccacgcaggccgcgauugaucaaaucaacggaaaacucaauagacugaucggcaagacaaacgagaaauuccaccagauugaaaaggaguuuagcgaaaucgaggggcgcguucaggaccuugagaaauauguggaagauaccaagauugaccuguggucuuacaaugccgagcuccuggucgugcuggaaaaccagcacaccaucgaucucacagacuccgagaugaauaagcuguucgaacggaccagacgccaacuucgggagaacgcugaggacaugggaaacggcugcuucaaaauuuaucauaagugugauaaugccugcaucgggagcauuagaaacggcacauacguucacgacguguaccgcgaugaagcucugaauaaccgguuucagaucaaaggagucgagcucaaguccggcuauaaagacuggauccuguggauuucuuucgccaucagcugcuuucuucugugugccgugcuccugggguucauuacgugggcuugccagaagggaaauaucagauguaacauuugcaucuga

SEQ ID NO: 195798 - RNA, 1698 nt, Artificial Sequence
  derived and/or modified sequence opt5 from hemagglutinin__InfluenzaA__AIT38344
augaagaucaaacugcucauucugcuuugcaccuucacagccacguacgcugacaccaucuguauuggcuaucacgccaacaauagcacagauaccguggacacaguccuggagaagaacguuaccgugacacauuccgugaaucuccuggaagauucucacaacgggaaacuuugccugcucagaggaaucgcgccccugcagcugggcaauuguagcgucgcuggguggauucucggaaacccugagugcgaaucccugaucucuaaggagagcugguccuacaucguggaaaaaccgaaucccgagaacggcaccuguuauccuggguacuuugccgacuaugaggaacuucgggagcaacugucuagcguuuccagcuucgaacgcuuugagauuuuccccaaggagucuuccuggccuaaucauacggugaccggagucagcgccucuugcuccuacaacggcaagggcaauuuuuauaaaaaccuccuguggcuuacaagaaagaaugggcuguaccccaaccucagcaaaucuuacaccaauaacaaggaaaaagaggugcugauccuguggggaguucaccauccuuccaacauuaaggaucagcggacacucuaucacaccgaaaaugcuuacgugagcgucguguccucucacuauagccgcagauucacgccggagaucacaaagcggcccaaagugcgcgaccaggaaggcagaauuaacuacuauuggacccugcuugagccuggggauacaaucauuuuugaggccaauggaaaccugaucgcucccugguacgccuucgcgcucucccggggcuuugggagcggaaucauuaccucuaaugccccuauggacgaaugugaggcuaagugccagacaccccgcggcgccaucaacuccagccugccguuccaaaauguccauccuguuaccauuggcgaaugucccaaauaugugagaucugcuaaacuucggauggugacggggcugcgcaacaucccuagcauucaguccagaggacucuuuggcgccaucgcgggguucaucgagggaggcuggaccgggaugauugauggaugguacggcuaccaccaucagaaugaacagggcucuggguaugccgcugacaaggagagcacacaaaacgccaucaauggaauuaccaacaaggucaauuccgugaucgagaaaaugaacacacaguuuaccacgguuggcaaggaguucaauaagcuggaacggcgcauggaaaaccugaacaaaaagguggaugacggguuccucgauauuuggacauacaaugcugagcugcuuguccugcucgaaaacgagagaacccuggacuuucacgacagcaaugugaaaauccuuuaugagaagguuaaaucucagcugaagaacaaugccaaggaaaucggaaacggcugcuucgaguuuuaccacaaauguaauaacgaaugcauggaguccgugaagaaugggaccuaugauuaccccaaauauagcgaggaaucuaagcucaaccgggagaaaauugacggcgucaagcuggaauccaugggaguguaccagauccuggccauuuacagcacagucgcuuccucucucgugcugcuuguuagccugggcgcgaucuccuucuggaugugcucuaaugggagccuccaauguagaauuugcaucuga

SEQ ID NO: 195799 - RNA, 1698 nt, Artificial Sequence
  derived and/or modified sequence opt5 from hemagglutinin__InfluenzaA__AIT38360
augaagaucaaacugcucauucugcuuugcaccuucacagccacguacgcugacaccaucuguauuggcuaucacgccaacaauagcacagauaccguggacacaguccuggagaagaacguuaccgugacacauuccgugaaucuccuggaagauucucacaacgggaaacuuugccugcucaagggaaucgcgccccugcagcugggcaauuguagcgucgcuggguggauucucggaaacccugagugcgaaucccugaucucuaaagagagcugguccuacaucguggaaaagccgaaucccgagaacggcaccuguuauccuggguacuuugccgacuaugaggaacuuagagagcaacugucuagcguuuccagcuucgaacgguuugagauuuuccccaaggagucuuccuggccuaaucauacggugaccggagucagcgccucuugcuccuacaacggcaaaggcaauuuuuauaagaaccuccuguggcuuacacgcaaaaaugggcuguaccccaaccucagcaagucuuacaccaauaacaaagaaaaggaggugcugauccuguggggaguucaccauccuuccaacauugaagaucagagaacacucuaucacaccgagaaugcuuacgugagcgucguguccucucacuauagccggcgcuucacgccggaaaucacaaagagacccaaagugcggggccaggaggggcgcauuaacuacuauuggacccugcuugagccuggagacacaaucauuuuugaagccaauggcaaccugaucgcucccugguacgccuucgcgcucuccagagggcugggaagcggcaucauuaccucuaaugccccuauggaugagugugaagcuaagugccagacaccccggggcgccaucaacuccagccuuccguuucaaaauguccauccuguuaccauuggggagugucccaaauaugugcgcucugcuaagcugagaauggugacgggacuccggaacaucccuagcauucagucccgcggccuguucggggccaucgcgggauuuaucgaaggcggguggaccggaaugauugacggcugguacggcuaccaccaucagaaugagcaggggucuggauaugccgcugauaaagagagcacacaaaacgccaucaauggcauuaccaacaaggucaauuccgugaucgagaaaaugaacacacaguucaccacgguugggaaggaauuuaauaagcuggaaagacggauggagaaccucaacaaaaagguggacgauggauuccuggacauuuggacauacaaugcugaacuucugguccuccuggagaacgagcgcacccuugauuuccacgacagcaaugugaaaaaccuguaugaaaagguuaaaucucagcucaagaauaacgccaaggagaucggcaaugggugcuuugaguucuaccacaaauguaacaaugaaugcauggaguccgugaagaacggcaccuaugacuaccccaaauauagcgaagagucuaagcugaauagagagaaaaucgauggagucaagcuggaauccaugggcguguaccagauucucgccaucuacagcacagucgcuuccucucuggugcuucugguuagccucggggcgauuuccuuuuggaugugcucuaacggaagccugcaaugucggaucugcauuuga

SEQ ID NO: 195800 - RNA, 1701 nt, Artificial Sequence; identical to SEQ ID NO: 193064
  derived and/or modified sequence opt5 from hemagglutinin__InfluenzaA__AIT93147

SEQ ID NO: 195801 - RNA, 1701 nt, Artificial Sequence; identical to SEQ ID NO: 185693
  derived and/or modified sequence opt5 from hemagglutinin__InfluenzaA__AIU39700

SEQ ID NO: 195802 - RNA, 1701 nt, Artificial Sequence
  derived and/or modified sequence opt5 from hemagglutinin__InfluenzaA__AIU39702
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacgagcuuccccuuucagaauauucacccgaucacaauuggcaagugcccuaaguaugugaaaucuaccaagcucagacuggcuacagggcuucggaacauccccagcauucagucccgcggacuguucggcgccaucgccggguuuaucgagggaggcuggaccgggaugguugacggaugguacggcuaucaucaccagaaugaacaaggcucuggguacgcugcggaucucaaaagcacacagaacgccauugacgagaucaccaauaaggugaacuccgucauugagaaaaugaauacgcaguucacagcugugggaaaggaguucaaccaccuggagaagagaaucgaaaaucuuaacaaaaagguugaugacggcuuucuggauauuuggaccuacaaugccgagcuccuggugcugcucgaaaacgagcggacccuggacuaucaugauagcaaugucaaaaaccuuuacgagaaggugcgcucucagcugaaaaacaaugccaaggaaaucgggaacggauguuucgaguuuuaucacaagugcgacaauacauguauggaauccgucaaaaacggcaccuacgauuauccuaaguacagcgaggaagcuaaacucaauagagaggagaucgacggggugaagcuggaaucuacacggauuuaucaaauccuugccauuuacuccacgguugcgagcucccuggugcucgucgugucucugggcgcuaucagcuucuggaugugcuccaacggaucucugcagugccgcauuuguaucuga

SEQ ID NO: 195803 - RNA, 1701 nt, Artificial Sequence; identical to SEQ ID NO: 189933
  derived and/or modified sequence opt5 from hemagglutinin__InfluenzaA__AIU39704

SEQ ID NO: 195804 - RNA, 1704 nt, Artificial Sequence
  derived and/or modified sequence opt5 from hemagglutinin__InfluenzaA__AIU46609
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggagaaaacacacaaugggaagcucugugaucugaacggagugaaaccccuuauccugaaggacugcagcguugcgggcuggcuccuggggaauccuaugugugaugaguucaucagagugccggaaugguccuauauugucgagcgggcuaaccccgccaaugaccugugcuacccuggaaaccucaaugauuaugaggaacugaagcaucuucugucucgcaucaaccacuuugagaaaauucucaucauucccaagagcuccuggaccaaucaugaaacaucucugggcgugagcgccgcuuguccuuaccaggggacccccuccuucuuuagaaacguuguguggcuuaucaaaaagaaugacgccuauccuacaauuaaaaucagcuacaacaauaccaaccaggaggaucugcucauccuguggggcauucaccacucuaacaaugcugccgagcaaacgaaccuguauaagaauccgaccacauacaucuccgucggaaccagcacacucaaccagcggcuggugcccaagauugcgacccgcucucaggugaauggccagagagggcggauggacuucuuuuggacgauccuuaaaccuaacgaugccauucauuucgaauccaauggaaacuuuaucgcucccgaguacgccuauaagaucgucaaaaagggcgacagcacaauuaugaaaucugaaguugaguacgggcacugcaauaccaagugucaaacaccuaucggagcuauuaacuccagcaugcccuuccauaauauccacccgcugaccauuggcgaaugcccuaaauaugugaaguccaacaagcucgugcuggccaccgggcuucgcaauucuccccugagagagaaacggcgcaagagaggacucuuuggcgcgaucgccggcuucaucgaagggggauggcagggcauggucgaugggugguacggauaucaccauagcaacgaacagggcuccggguacgcugccgacaaagagagcacacagaaggcuauugacggagugacgaauaaaguuaacucuaucauugauaagaugaacacccaauuugaagccgugggccgggaguucaauaaccuggaacgcagaaucgagaaucugaacaagaaaauggaggacggcuuucucgaugucuggacauauaaugccgaacugcuugugcugauggagaacgaacggacccucgacuuccacgauuccaauguuaagaaccuguacgacaaagugcgccuucagcugagagauaaugcuaaggagcucgggaacggauguuucgaauuuuaccauaaaugcgacaaugaguguauggagagcguccggaacggcacauaugauuacccucaguauucugaagaggcgagacugaagcgcgaagagauuagcggggugaagcuggaguccaucggaaccuaccaaauucucucuaucuauagcacggucgccuccagccuggcucuugccaucauuguggccggccugucucucuggaugugcuccaaugggagccugcagugccggaucuguauuuga

SEQ ID NO: 195805 - RNA, 1689 nt, Artificial Sequence
  derived and/or modified sequence opt5 from hemagglutinin__InfluenzaA__AIU46714
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucagagugcccgaauggucuuacaucauggagaaagagaacccuaaguauagccugugcuaccccggguccuuuaaugauuaugaagaacuuaagcaucugcucucuagcgucaaacacuucgaaaaggugaaaauucugccuaaggacggauggacacaacauaaaaccgauggcggcuccaaggccugugccguuucugggaagcagagcuuuuuccggaacaugguguggcuuaccaaaaagggacagaauuaccccgucgcuaaacgcuccuauaacaauaccagcggcgagcagaugcugaucauuuggggagugcaccacccuaacgacgaggaggagcaaagagcccucuaccagaagguugggacguacgugucugcuuccaccagcacacugaauaaacggucuaccccggaaaucgccgcgcgccccgaggucaacggccugggguccagaauggaauuuagcuggacacuccuggaugugugggacaccauuaauuucgagucuacgggaaaccuuguggccccugaguauggcuuuaagaucuccaaacggggcagcuccgggaucauuaagacagaaggaacccugggcaacugcgagacaaagugucagacaccccucggggcuaucaauaccacacugccuuuccauaacguccacccccuuacgauuggagaaugcccgaaauacguuaagucugagaaacuggugcucgccaccggccugcgcaaugugccucagaucgaaagcagagggcuguuuggagcuauugccggcuucaucgagggcggguggcaaggaauggucgauggcugguauggguaccaucacuccaacgaccagggaagcggcuaugcggccgauaaggagucuacacagaaggcuuuugaccggaucaccaauaaagugaacuccguuauugaaaagaugaauacacaguucgaggccguggggaaagaauuuagcaaccucgagcgcagacuggaaaaucuuaacaagaaaauggaggacggcuuccuggaugucuggaccuacaaugcugagcuccuggugcuuauggaaaacgagcggacgcuggacuuccacgauucuaauguuaagaaccucuaugacaaagugcgcaugcaacugagagauaaugucaaggaacugggaaacggcuguuuugaguucuaccauaagugcgacaacgaguguaugaauagcgugaaaaacgggacauacgauuaucccaaguacgaagaggaauccaaacucaagcggaaugagaucaaaggagucaagcugucuagcaugggcguguaucagauucuugccaucuacgccaccguugcugggucccugagccucgcgauuaugaucgccggaaucucuuuuuggaugugcuccaacggcagccugcagugcagaauuuguaucuga

SEQ ID NO: 195806 - RNA, 1701 nt, Artificial Sequence
  derived and/or modified sequence opt5 from hemagglutinin__InfluenzaA__AIV09219
augaaggccauccuggugguccuccuguacaccuucgcuacaacgaacgccgacauucuuugcaucggcuaucacgcgaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacauugccggguggauccugggaaauccugagugugaacuccugucuacaaccagcuccuggucuuacauuguggagacgagcuccucugacaacgggaccugcuauccgggcgauuuuaucgacuacgaagaacuucgggagcagcugagcuccgucagcucuuucgaacgcuuugagaucuuccccaagacauccagcuggccugaucacgacucuaauaagggagugaccgccgcuuguccccaugccggcgcuggcuccuuuuauaaaaaccucauuuggcugguuaagaaagggaauagcuacccuaaacuuucuaaguccuauaucaacgauaagggaaaggaagugcugguccucuggggcauucaccaucccccuacaagcgccgaccaacagagacuguaccagaaugcggaugccuacguguucguggggaccucccgguauucuaaaaaguuuaaaccggagaucgcuauucgccccaaggucagagaccaggagggacggaugaacuacuauuggacgcugguugaaccuggcgauaaaaucacauucgaggccaccgggaaucucguggugccccgcuacgcuuuugccauggaaagaaacgcgggaagcggcauuaucacauccgacaccccuguccacgacugcaacaccacaugucaaacgcccaagggcgccaucaauaccagccugccguuccagaacauucacccuaucacaauugggaaaugccccaaguaugugaagucuaccaaacuucggcuggcuacaggacuccgcaauguuccuuccauccagagcagaggccuguuuggggccauugcuggauucaucgagggcggguggaccggaaugguggauggcugguacggcuaucaucaccagaacgaacaagggucuggauacgccgccgaccuuaagagcacgcagaaugcuaucgaugagauuacaaacaaagucaauuccgugaucgacaagaugaacacccaguuuaccgcgguuggcaaagaguucaaucaccuggaaaagcggauugagaaccucaauaagaaaguggaugacggguuccuggauaucuggacauacaacgccgaacugcucguccugcuugagaaugaacgcacccuggacuaucaugauucuaacgugaagaaucucuacgagaaagucagaagccagcugaagaacaacgcuaaagagauuggaaauggcuguuuugaguucuaucacaagugcgacaacacauguauggaguccgugaagaaugggacguacgauuaucccaaauacagcgaagaggccaaacuuaaccgggaagagaucgacggcguuaagcuggagucuacccgcaucuaucaaauucucgccaucuacuccacaguggcuagcucucugguccuggugguuucccucggagccauuagcuuuuggaugugcuccaauggcucucugcagugcagaaucuguauuuga

SEQ ID NO: 195807 - RNA, 1701 nt, Artificial Sequence
  derived and/or modified sequence opt5 from hemagglutinin__InfluenzaA__AIW60689
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccgacuguuacccuuaugaugugcccgacuacgcuucucugagaagccuuguugccuccagcgggacgcuggaguuuaccaaugaaggauucaacuggacaggcguggcucaggauggcaccucuuaugccugcaagcggggguccgucaagagcuuuuucucucgccucaauuggcugcacaaacuugaguacaaguauccugcgcugaacgugacaaugcccaauaacgacaaauuugauaagcucuacauuuggggaguucaucacccuuccaccgacagcgaccaaacgucuaucuacgugcaggccuccggcagagucacagugagcaccaaacggucccagcagacagugauuccgaauaucgggucucgccccugggucagaggaauuagcucccggaucagcauuuauuggaccaucguuaagccuggcgauauccugcugauuaacucuaccgggaaucucaucgcuccccgcggauacuucaagauuagauccggcaaaagcucuaucaugcggagcgacgccccuauuggcaacuguaacuccgagugcaucacacccaaugggucuaucccgaacgauaagccuuuucaaaaugugaaccgcauuacguauggagcuugucccagauacgugaaacagaauacccugaagcuggccacaggcaugcggaacgucccugaaaaacagacccgcgggaucuucggagcgauugccggcuuuaucgagaaugggugggaaggaaugguggacggcugguauggcuucagacaccagaacuacgaggggacaggacaagcugccgaucuuaagagcacccaggcugccauuaaucagaucaacggcaaacucaaucggcugaucgagaagacgaacgaaaaguuucaucaaauugagaaagaguucuccgaaguugaagggagaauccaggaccuugagaaguauguggaggauacaaaaauugaccuguggagcuacaaugccgaacuccuggucgcucuggagaaccagcacaccaucgaucucaccgacucugaaaugaauaagcuguucgagcgcacacggaaacagcuuagagaaaacgcggaggauaugggaaacggcugcuuuaagauuuaccauaagugugacaaugccugcaucggguccauucgcaacggcaccuaugaccacgaugcuuaccgggacgaggcccugaauaacagauuccaaaucaaaggaguggaacucaagagcggcuauaaagauuggauccuguggauuucuuuugccaucuccugcuuccuucuguguguugugcuccugggguuuauuaugugggcuugccagaagggaaauauccgcuguaacauuugcaucuga

SEQ ID NO: 195808 - RNA, 1701 nt, Artificial Sequence
  derived and/or modified sequence opt5 from hemagglutinin__InfluenzaA__AIW60690
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccgacuguuacccuuaugaugugcccgacuacgcuucucugagaagccuuguugccuccagcgggacgcuggaguuuaccaaugaaggauucaacuggacaggcguggcucaggauggcaccucuuaugccugcaagcggggguccgucaagagcuuuuucucucgccucaauuggcugcacaaacuugaguacaaguauccugcgcugaacgugacaaugcccaauaacgacaaauuugauaagcucuacauuuggggaguucaucacccuuccaccgacagcgaccaaacgucucuguacgugcaggccuccggcagagucacagugagcaccaaacggucccagcagacagugaucccgaauauugggucucgccccugggucagaggaguuagcucccggaucagcauuuauuggaccaucgugaagccuggcgauauucugcucaucaacucuaccgggaaucugaucgcuccccgcggauacuucaagauuagauccggcaaaagcucuaucaugcggagcgacgccccuauuggcaacuguaacuccgagugcaucacacccaaugggucuauuccgaacgauaagccuuuucaaaaugugaaccgcaucacguauggagcuugucccagauacgucaaacagaauacccuuaagcuggccacaggcaugcggaacgugccugaaaaacagacccgcgggaucuucggagcgauugccggcuuuaucgagaaugggugggaaggaaugguugacggcugguauggcuucagacaccagaacuacgaggggacaggacaagcugccgaucucaagagcacccaggcugccauuaaucagaucaacggcaaacugaaucggcuuauugagaagacgaacgaaaaguuucaucaaaucgagaaagaguucuccgaaguggaagggagaauccaggaccuggagaaguaugucgaggauacaaaaauugaccucuggagcuacaaugccgaacugcugguggcucucgagaaccagcacaccaucgaucugaccgacucugaaaugaauaagcuguucgagcgcacacggaaacagcugagagaaaacgcggaggauaugggaaacggcugcuuuaagauuuaccauaagugugacaaugccugcaucggguccauucgcaacggcaccuaugaccacgaugcuuaccgggacgaggcccucaauaacagauuccaaaucaaaggaguugaacuuaagagcggcuauaaagauuggauucuuuggaucucuuuugccaucuccugcuuccugcucugugugguccugcugggguuuauuaugugggcuugccagaagggaaauauccgcuguaacauuugcaucuga

SEQ ID NO: 195809 - RNA, 1701 nt, Artificial Sequence
  derived and/or modified sequence opt5 from hemagglutinin__InfluenzaA__AIW60691
augaagaccaucauugcccugagcuacauccucugccugguguucgcucagaaacuucccggcaacgacaauuccacagccacgcugugucucgggcaccaugcggucccuaacggaacccugguuaaggcuauuacaaaugaucaaaucgaggugaccaacgccacagaacuugugcagucuagcuccaccggcagaauuugcgacucuccgcaccggauccuggaugggaaaaauuguacacucaucgacgcccugcugggagauccccauugcgacggcuuucagaacaaggagugggaucucuucgucgaacgcagcaaggcuuauuccgacuguuacccuuaugaugugcccgacuacgccucucugagaagccuuguugcuuccagcgggacccuggaguuuacgaaugaaggauucaacuggaccggcguggcccaggauggcacaucuuaugcgugcaagcggggguccgucaagagcuuuuucucucgccucaauuggcugcacaaacuugaguacaaguauccugcccugaacgugaccaugcccaauaacgacaaauuugauaagcucuacauuuggggaguucaucacccuuccacagacagcgaccaaaccagacuguacgugcaggcuucuggccgggucacgguguccacaaaacgcagccagcagaccgugaucccgaauauuggguccagacccuggguccggggaaucucuagccgcauuuccaucuauuggacaauuguuaagccuggcgauauccugcucaucaacagcaccgggaaucugauugcccccagaggauacuucaagauccggucuggcaaauccagcauuaugcgcucugacgcuccuaucggcaacuguaacagcgagugcauuacccccaauggguccaucccgaacgauaagccuuuucaaaaugugaacagaaucacauauggagccuguccccgguacgugaaacagaauacgcuuaagcuggcgaccggcaugcgcaacgucccugaaaaacagacaagagggauuuucggagccaucgcuggcuuuauugagaaugggugggaaggaaugguggacggcugguauggcuuccggcaccagaacucugaggggaccggacaagccgcugaucucaagagcacacaggccgccaucaaucagauuaacggcaaacugaauagacuuaucgagaagaccaacgaaaaguuucaucaaaucgagaaagaguucuccgaaguugaagggcgcauucaggaccuggagaaguacguggaggauacgaaaaucgaccucuggagcuauaaugcugaacugcuggucgcgcucgagaaccagcacacaauugaucugaccgacucugaaaugaauaaacuuuucgagcggaccagaaaacagcugcgcgaaaacgccgaggauaugggaaacggcugcuuuaagaucuaccauaagugugacaaugcuugcauuggguccauccggaacggcacauacgaccacgauguguauagagacgaggcccucaauaaccgcuuccaaauuaaaggaguugaacuuaagagcggcuacaaagauuggauccuguggaucucuuuugccauuuccugcuuccugcucugugugguccugcugggguuuaucaugugggcuugccagaagggaaauauucgguguaacaucugcauuuga

SEQ ID NO: 195810 - RNA, 1701 nt, Artificial Sequence
  derived and/or modified sequence opt5 from hemagglutinin__InfluenzaA__AIW60692
augaagaccaucauugcccugagcuacauccucugccugguguucgcucagaaacuucccggcaacgacaauuccacagccacgcugugucucgggcaccaugcggucccuaacggaacccugguuaaggcuauuacaaaugaucaaaucgaggugaccaacgccacagaacuugugcagucuagcuccaccggcagaauuugcgacucuccgcaccggauccuggaugggaaaaauuguacacucaucgacgcccugcugggagauccccauugcgacggcuuucagaacaaggagugggaucucuucgucgaacgcagcaaggcuuauuccgacuguuacccuuaugaugugcccgacuacgccucucugagaagccuuguugcuuccagcgggacccuggaguuuacgaaugaaggauucaacuggaccggcguggcccaggauggcacaucuuaugcgugcaagcggggguccgucaagagcuuuuucucucgccucaauuggcugcacaaacuugaguacaaguauccugcccugaacgugaccaugcccaauaacgacaaauuugauaagcucuacauuuggggaguucaucacccuuccacagacagcgaccaaaccucucuguacgugcaggcuuccggcagagucacggugagcacaaaacggucccagcagaccgugaucccgaauauugggucucgccccugggucagaggaaucagcucccggauuagcaucuauuggacaauuguuaagccuggcgauauccugcucaucaacucuaccgggaaucugauugcccccagaggauacuucaagaucagauccggcaaaagcucuauuaugcggagcgacgcuccuaucggcaacuguaacuccgagugcauuacccccaaugggucuaucccgaacgauaagccuuuucaaaaugugaaccgcaucacauauggagccugucccagauacgugaaacagaauacgcuuaagcuggcgaccggcaugcggaacgucccugaaaaacagacacgcgggauuuucggagccaucgcuggcuuuauugagaaugggugggaaggaaugguggacggcugguauggcuucagacaccagaacagcgaggggaccggacaagccgcugaucucaaguccacacaggccgccaucaaucagauuaacggcaaacugaaucggcuuaucgagaagaccaacgaaaaguuucaucaaaucgagaaagaguucagcgaaguugaagggcgcauucaggaccuggagaaguacguggaggauacgaaaaucgaccucuggucuuauaaugcugaacugcuggucgcgcucgagaaccagcacacaauugaucugaccgacuccgaaaugaauaaacuuuucgagcgcacccggaaacagcugagagaaaacgccgaggauaugggaaacggcugcuuuaagaucuaccauaagugugacaaugcuugcauugggagcauccgcaacggcacauacgaccacgauguguaucgggacgaggcccucaauaacagauuccaaauuaaaggaguugaacugaagucuggcuacaaagauuggauccuuuggaucuccuuugccauuagcugcuuccugcucugugugguccugcugggguuuaucaugugggcuugccagaagggaaauauucgcuguaacaucugcauuuga

SEQ ID NO: 195811 - RNA, 1701 nt, Artificial Sequence
  derived and/or modified sequence opt5 from hemagglutinin__InfluenzaA__AIW60693
augaagaccaucauugcccugagcuacauccucugccugguguucgcucagaaacuucccggcaacgacaauuccacagccacgcugugucucgggcaccaugcgguccugaacggaacccuuguuaagacaauuaccaaugaucaaaucgaggugacaaacgcuaccgaacuggugcaaaauucuagcacaggcagaauuugcgacuccccucaccagauccucgauggggagaacuguacccugaucgacgcccugcucggagauccgcauugcgacggcuuucagaauaaagaaugggaucuguucgucgagcggucuaaggccuauagcaacuguuaccccuaugacgugccugauuacgcuucccuucgcucucugguugccagcuccgggacgcucgaauuuaauaacgagagcuucaauuggaccggaguggcucagaacggcacaucuuccgccugcaaaagacggagcauuaaguccuuuuucucucgccugaauuggcuucaccagcugaaguauaaauaccccgcgcucaacgucaccaugccuaauaacgagaaguuugacaaacuguauaucuggggcgugcaucaccccagcacagauucugaccagaccuccauuuacgcccaggcuagcgggagaguuacgguguccacaaagcggucucaacagaccgucaucccuaacauuggaagccgcccgugggugagaggcguguccagcaucauuucuaucuacuggacaaucgucaaacccggggauauucugcucaucaauuccaccggaaaccugauugccccucggggcuauuucaagauccgcagcgggaagucuagcauuaugagauccgacgcucccaucggaaaauguaauucugaaugcaucaccccuaacggcagcauucccaaugacaagccguuucagaacguuaaucggaucacauacggcgccuguccucgcuaugugaaacagaacacgcuuaagcuggcgaccgggaugagaaaugugcccgagaaacaaacacggggaauuuucggcgccaucgcuggguuuauugaaaacggaugggagggcauggucgaugggugguacggauuccgccaccaaaauuccgagggcaccggccaggccgcugaccucaagagcacacaggccgccaucaaccagaucaaugggaaacugaacagacuuauugaaaagaccaaugagaaguuucaucagaucgaaaaagaguucucugaaguggagggacggauucaggaucuggagaaguauguugaagacacgaaaaucgaucucugguccuacaacgcugagcugcugguggcgcucgaaaaccaacacacaauugaccugaccgauagcgagaugaauaaacuuuucgaaagaacccgcaagcagcugcgggagaacgccgaggacaugggcaaugggugcuuuaagaucuaucauaagugugauaacgcuugcauuggaucuaucagaaauggcacauacgaccacgaugucuaccgcgacgaagcccucaacaaucgguuccagaucaaagggguggagcugaaguccggcuauaaagacuggauucuuuggaucagcuuugccauuuccugcuuccugcucuguguugugcugcugggauuuaucaugugggcuugccagaagggcaacauuagauguaauaucugcaucuga

SEQ ID NO: 195812 - RNA, 1701 nt, Artificial Sequence
  derived and/or modified sequence opt5 from hemagglutinin__InfluenzaA__AIW60694
augaagaccaucauugcccugagcuacauccucugccugguguucgcucagaaacuucccggcaacgacaauuccacagccacgcugugucucgggcaccaugcgguccugaacggaacccuuguuaagacaauuaccaaugaucaaaucgaggugacaaacgcuaccgaacuggugcaaaauucuagcacaggcagaauuugcgacuccccucaccagauccucgauggggagaacuguacccugaucgacgcccugcucggagauccgcauugcgacggcuuucagaauaaagaaugggaucuguucgucgagcggucuaaggccuauagcaacuguuaccccuaugacgugccugauuacgcuucccuucgcucucugguugccagcuccgggacgcucgaauuuaauaacgagagcuucaauuggaccggaguggcucagaacggcacaucuuccgccugcaaaagacggagcauuaagagcuuuuucucccgccugaauuggcuucaccagcugaaguauaaauaccccgcgcucaacgucaccaugccuaauaacgagaaguuugacaaacuguauaucuggggcgugcaucaccccagcacagauucugaccagaccucccuguacgcccaggcuagcgggagaguuacgguguccacaaagcggucucaacagaccgucauuccuaacaucggaagccgcccgugggugagaggcguguccagccggauuucuaucuacuggacaauugucaaacccggggauauccuccugaucaauuccaccggaaaccuuauugccccucgcggcuauuucaagaucagaagcgggaagucuagcauuaugcgguccgacgcucccaucggaaaauguaauucugaaugcauuaccccuaacggcagcauccccaaugacaagccguuucagaacguuaaucgcaucacauacggcgccuguccuagauaugugaaacagaacacgcugaagcucgcgaccgggaugcggaaugugcccgagaaacaaacacgcggaauuuucggcgccaucgcuggguuuauugaaaacggaugggagggcauggucgaugggugguacggauucagacaccaaaauuccgagggcaccggccaggccgcugaccugaagucuacacaggccgccaucaaccagauuaaugggaaacuuaaccggcugaucgaaaagaccaaugagaaguuucaucagaucgaaaaagaguucucugaaguggagggacgcauucaggaucucgagaaguauguugaagacacgaaaaucgaucugugguccuacaacgcugagcugcucguggcgcuggaaaaccaacacacaauugaccuuaccgauagcgagaugaauaagcuguucgaaagaacccggaaacagcucagagagaacgccgaggacaugggcaaugggugcuuuaagaucuaucauaagugugauaacgcuugcauuggaucuauccgcaauggcacauacgaccacgaugucuaccgggacgaagcccugaacaauagauuccagauuaaagggguggagcuuaaguccggcuauaaagacuggauccuguggaucagcuuugccauuuccugcuuccuccuguguguugugcugcucggauuuaucaugugggcuugccagaagggcaacauucgcuguaauaucugcauuuga

SEQ ID NO: 195813 - RNA, 1701 nt, Artificial Sequence
  derived and/or modified sequence opt5 from hemagglutinin__InfluenzaA__AIW60695
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaagaaugggaucucuucgucgagagaagcaaggccuauuccaauuguuacccuuaugacgugcccgauuacgcuucucugcggagccuuguugccuccagcggaacgcuggaauuuaacaaugagucuuucaacuggaccggcguggcucaaaauggcacauccagcgccugcaaacgcagaucuaacaaguccuuuuucagccggcucaauuggcugcaccagcuuaacuauaaguacccugcgcugaaugucaccaugcccaacaacgagaaauuugacaagcucuauauuuggggagugcaucacccuucuacagauuccgaccagaucagcauuuacgcccaggcuccggggcgcguuaccguguccacgaaaagaucucaacagacagucauccccaauauuggcagccggccuugggugcgcgggguguccagcaucauuucuaucuacuggaccaucgucaagcccggagauauucugcugaucaacuguacaggcaaucucauugccccuagaggguauuucaaaauccgguccggaaagagcucuauuaugcgcagcgacgcuuccaucggcaagugcaacucugaauguaucacccccaauggcagcauuccgaacgacaaaccuuuucagaauguuaacagaaucaccuacggggccugcccccgguaugugaagcagaauacacugaaacuugcgacgggaaugcgcaacgugccugagaagcaaaccagaggcauuuucggggccaucgcuggauuuauugaaaauggcugggaggggauggucgauggaugguacggcuuccggcaccagaacuccgagggcacagggcaggccgcugaccugaaaagcacccaagccgccaucaaucagaucaacggaaagcucaaucgccugauugagaaaacaaacgaaaaguuucaucagaucgaaaaggaguucucugaaguggagggccggauucaggaucuugagaaauauguugaagacaccaagaucgaucugugguccuacaacgcugagcuccugguggcgcuggaaaaucaacacacgauugaccucacagauagcgagaugaacaaacuguucgaaagaaccaagaaacagcuuagagagaaugccgaggacauggggaacggauguuuuaagaucuaucauaagugcgauaaugcuugcauuggcucuauccgcaacgggaccuacgaccacgaugucuaccgggacgaagcccugaauaacagauuccagaucaaaggcguggagcucaaguccggauauaaagacuggauucuguggaucagcuuugccauuuccuguuuccuucugugcguugugcuccugggcuuuaucaugugggcuugucagaaggggaauauucgcugcaacaucuguaucuga

SEQ ID NO: 195814 - RNA, 1701 nt, Artificial Sequence
  derived and/or modified sequence opt5 from hemagglutinin__InfluenzaA__AIW60696
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaagaaugggaucucuucgucgagagaagcaaggccuauuccaauuguuacccuuaugacgugcccgauuacgcuucucugcggagccuuguugccuccagcggaacgcuggaauuuaacaaugagucuuucaacuggaccggcguggaccaaaauggcacauccagcgcuugcaaacgcagaucuaacaaguccuuuuucagccggcucaauuggcugcaccagcuuaaguauaaauacccugcccugaacgucgcgaugcccaauaacgagaaguuugauaaacucuauauuuggggagugcaucacccuucuaccgacuccgaucagaucagccuguacgcccaggcuccggggcgcguuacaguguccaccaagagaucucaacagacggucauucccaacaucggcagccggccuugggugcgcgggguguccagcagaauuucuaucuacuggacaauugucaaacccggagacauccugcucaucaauuguaccggcaaccugauugccccucggggguauuucaagauccgcuccggaaagagcucuauuaugagaagcgacgcuuccaucggcaaaugcaauucugaauguauuacacccaacggcagcaucccgaaugauaagccuuuucagaacguuaaucggaucaccuacggggccugcccccgcuaugugaaacagaacacccuuaagcuggcgacaggaaugagaaaugugccugagaaacaaacgcggggcauuuucggggccaucgcuggauuuauugaaaacggcugggaggggauggucgacggaugguacggcuuccgccaccaaaauuccgagggcaccgggcaggccgcugaucucaagagcacacaggccgccaucaaccagauuaauggaaaacugaacagacuuaucgaaaagaccaaugagaaguuucaucagaucgaaaaagaguucucugaaguggagggccggauucaggaccuggagaaguauguugaagauacaaaaaucgaccucugguccuacaacgcugagcugcugguggcgcucgaaaaccaacacaccauugaucugacggacagcgagaugaauaaacuuuucgaaagaacaaagaagcagcugcgcgagaacgccgaggauauggggaauggauguuuuaagaucuaucauaaaugcgacaacgcuugcauuggcucuauccggaaugggaccuacgaucacgacgucuacagagacgaagcccucaacaaucgcuuccagauuaagggcguggagcugaaauccggauauaaggauuggauccuuuggaucagcuuugccauuuccuguuuccugcucugcguugugcugcugggcuuuaucaugugggcuugucagaaagggaacauucggugcaauaucuguauuuga

SEQ ID NO: 195815 - RNA, 1701 nt, Artificial Sequence
  derived and/or modified sequence opt5 from hemagglutinin__InfluenzaA__AIW60697
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgaucaugcuucucuccggagccugguugccuccagcggaacgcuugaguuuaacaaugaaucuuucgacuggaccggcgugacacagaacggcaccuccagcucuugcaagcgcagauccaauaagagcuuuuucucucggcugaacuggcucacacaccugaaauacaaguauccugcucuuaaugucaccaugcccaacaaugagaaauuugauaagcuguacaucuggggagugcaucacccugacacggauuccguucagauuagccucuaugcccaggcguccgggcgcaucacagugucuaccaaaagaagccaacagacagucauuccgaacaucggcucccggccccgcgugagagacauuagcucucggaucuccaucuacuggaccauugugaagccuggggacauccugcugauuaacagcaccggaaaucucaucgcuccccgcggcuacuucaagauuagaucugggaaaagcuccaucaugcggucugaugccccuaucggaaaguguaacagcgagugcauuacacccaauggcuccaucccgaacgacaaaccuuuucagaaugucaaccgcauuacguauggcgccugucccagauacguuaagcagaauacccugaaacuugcuacagggaugcggaacgugccugaaaagcaaacccgcggaaucuucggcgccauugcgggguuuaucgagaauggaugggaaggcaugguggaugggugguauggauucagacaccagaacagcgagggcacaggccaggccgcugaccugaaaucuacccaagccgcuaucaaucagauuaacgggaagcucaaucggcugaucggaaagacgaacgagaaauuucaucagauugaaaaggaguucuccgaagucgagggcagaauccaggaucuugaaaaauacguggaggacacaaagauugaucuguggagcuauaaugccgagcuccugguugcccuggaaaaccaacacaccaucgaccucaccgauucugagaugaacaaacuguucgaacgcacaaagaagcagcuucgggagaaugcugaagacauggggaacggaugcuuuaaaauuuaccauaagugugauaaugcgugcaucggcuccaucagaaacgggaccuaugaccacgacguguaccgcgaugaggcccugaauaaccgguuccagauuaaaggcgucgagcucaagagcggauacaaagacuggauccuguggauuuccuuugcuaucucuugcuuccuucuguguguggcccuccugggcuuuauuaugugggccugccagaaggggaauaucagauguaacaucugcauuuga

SEQ ID NO: 195816 - RNA, 1701 nt, Artificial Sequence
  derived and/or modified sequence opt5 from hemagglutinin__InfluenzaA__AIW60698
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgaucaugcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaccugaaauacaaguauccugcccuuaaugucaccaugcccaacaaugagaaauuugauaagcuguacaucuggggagugcaucacccugggacggacucugaucagauuucccucuaugcgcaggccagcggccgcaucacaguuuccaccaaaagaucucaacagacagugauuccgaacaucgggagccggccccgcgucagagacauuuccagccggaucucuaucuacuggaccauugugaagccuggagacauccugcugauuaacuccaccggcaaucucaucgcuccccgcggguacuucaagauuagaagcggaaaaucuagcaucaugcgguccgaugccccuaucggcaaguguaacucugagugcauuacacccaauggcagcaucccgaacgacaaaccuuuucagaaugugaaccgcauuacguauggggcuugucccagauacgucaagcagaauacccugaaacuugccacaggaaugcggaacguuccugaaaagcaaacccgcggcaucuucggggcgauugccggauuuaucgagaauggcugggaagggaugguggauggaugguauggcuucagacaccagaacuccgagggcacagggcaggcugccgaccugaaaagcacccaagcugccaucaaucagauuaacggaaagcucaaucggcugaucggcaagacgaacgagaaauuucaucagauugaaaaggaguucucugaaguggaggggagaauccaggaucuugaaaaauacgucgaggacacaaagauugaucugugguccuauaaugccgagcuccugguggcucuggaaaaccaacacaccaucgaccucaccgauagcgagaugaacaaacuguucgaacgcacaaagaagcagcuucgggagaaugcggaagacaugggaaacggcugcuuuaaaauuuaccauaagugugauaaugccugcaucgggucuaucagaaacggcaccuaugaccacgacguuuaccgcgaugaggcucugaauaaccgguuccagauuaaaggaguggagcucaaguccggcuacaaagacuggauccuguggauuagcuuugccaucuccugcuuccuucugugugucgcccuccugggguuuauuaugugggcuugccagaagggaaauaucagauguaacaucugcauuuga

SEQ ID NO: 195817 - RNA, 1701 nt, Artificial Sequence
  derived and/or modified sequence opt5 from hemagglutinin__InfluenzaA__AIW60699
augaagaccaucauugcccugagcuacauccucugccugguguucgcucagaaacuucccggcaacgacaauuccacagccacgcuguguauugggcaccaugcggucccuaacggaaccaucguuaagacaauuaccaaugaucaaaucgaggugacaaacgcuaccgaacucgugcagucuagcuccacaggcgggaucugcgacucuccgcaccagauucuggauggagagaauuguacccuuaucgacgcccugcucggcgauccccagugcgacggguuucaaaacaaaaagugggaucuguucgucgaaagaagcaaagccuauuccaauuguuacccuuaugacgugcccgauuacgcuucucugcggagccucauugccuccagcggaacgcuggaguuuaacaaugaaucuuucaacuggaccggcguuacacagaauggcaccuccagcgcuugcaagcgcagaucuaacaauuccuuuuucagccggcuuaacuggcugacacaucucaaguuuaaauauccugcccugaaugugaccaugcccaacaacgaggaguucgacaagcuguacaucuggggaguccaccauccugugacggauaaugaccagauuucucuguaugcgcaggccuccgggaaaaucacaguuagcaccaagcgcucccaacagacagugauuccgaacaucggcucuagaccccggguccgcgauaucccuagcagaauuuccaucuacuggaccauugugaaacccggggacauccuccugauuaagagcaccggaaaucugaucgcuccucggggcuacuuuaagauccgcucugggaaauccagcauuaugagaucugacgcccccaucggaaaguguaacagcgaaugcauuacaccgaauggcuccaucccuaacgauaaacccuuccagaaugugaaccggauuacguauggcgcuuguccucgcuacgucaagcagaauacccucaaacuggccacagggaugagaaacguucccgagaagcaaacccggggaaucuuuggcgcgaucgccggguucauugaaaauggaugggagggcaugguggacgggugguauggauuucgccaccagaacucugagggcaucggccaggcugccgaucuuaaaagcacacaagcugccauugaccagaucaaugggaagcugaacagacucauuggaaagaccaaugaaaaauuccaccagaucgagaaggaguucuccgaaguggaaggccggauucaggaucuggagaaauacgucgaggacacgaagaucgaucuuuggagcuauaacgccgaacugcucguggcucuggagaaccaacauacaaucgaccugaccgauucugaaaugaauaaacucuuugaggaaaccaagaagcagcugagagagaacgcggaggacauggggaauggaugcuucaaaauuuaccacaagugugauaacgccugcaucggcuccauucgcaaugggacauaugaccaugacguuuaccgggaugaagcucuuaacaauagauuucagaucaaaggcguggagcuuaagagcggauacaaagacuggauucucuggaucucuuucgccaucuccugcuuucugcuuugugucgcccugcucggcuucauuaugugggcuugccagaaggggaacauccgcuguaauauuugcaucuga

SEQ ID NO: 195818 - RNA, 1701 nt, Artificial Sequence
  derived and/or modified sequence opt5 from hemagglutinin__InfluenzaA__AIW60700
augaagaccaucauugcccugagcuacauccucugccugguguucgcucagaaacuucccggcaacgacaauuccacagccacgcuguguauugggcaccaugcggucccuaacggaaccaucguuaagacaauuaccaaugaucaaaucgaggugacaaacgcuaccgaacucgugcagucuagcuccacaggcgggaucugcgacucuccgcaccagauucuggauggagagaauuguacccuuaucgacgcccugcucggcgauccccagugcgacggguuucaaaacaaaaagugggaucuguucgucgaaagaagcaaagccuauuccaauuguuacccuuaugacgugcccgauuacgcuucucugcggagccucauugccuccagcggaacgcuggaguuuaacaaugaaucuuucaacuggaccggcguuacacagaauggcaccuccagcgcuugcaagcgcagaucuaacaauuccuuuuucagccggcuuaacuggcugacacaucucaaguuuaaauauccugcccugaaugugaccaugcccaacaacgaggaguucgacaaacuuuacaucuggggaguccaccauccugggacggauaaugaccagauuucucuguaugcgcaggccuccggcaagaucacagugagcaccaagcgcucccaacagacaguuauuccgaacaucgggucuagaccccgggugcgcgauaucccuagcagaauuuccaucuacuggaccauugucaaacccggagacauccuccugauuaauagcaccggcaaccugaucgcuccucggggguacuuuaagauccgcucuggaaaguccagcauuaugagaucugacgcccccaucggcaaauguaauagcgaaugcauuacaccgaacggcuccaucccuaaugauaagcccuuccagaacgugaaucggauuacguauggggcuuguccucgcuacgugaaacagaacacccucaagcuggccacaggaaugagaaauguccccgagaaacaaacccggggcaucuuuggggcgaucgccggauucauugaaaacggcugggaggggaugguugacggaugguauggcuuucgccaccaaaauucugagggcaucgggcaggcugccgaucuuaagagcacacaggcugccauugaccagaucaacggaaaacugaauagacucauuggcaagaccaacgaaaaguuccaccagaucgagaaagaguucuccgaaguggaagggcggauucaggaucuggagaaguacguggaggacacgaaaaucgaucuuuggagcuauaacgccgaacugcucgucgcucuggagaaucaacauacaaucgaccugaccgauucugaaaugaacaagcucuuugaggaaaccaaaaagcagcugagagagaaugcggaggacaugggaaacggcugcuucaagauuuaccacaaaugugauaaugccugcaucggguccauucgcaacggcacauaugaccaugacguguaccgggaugaagcucuuaauaacagauuucagaucaagggaguugagcugaaaagcggcuacaaggacuggauucucuggaucucuuucgccaucuccugcuuucugcuuuguguggcccugcucggguucauuaugugggcuugccagaaaggaaauauccgcuguaacauuugcaucuga

SEQ ID NO: 195819 - RNA, 1701 nt, Artificial Sequence
  derived and/or modified sequence opt5 from hemagglutinin__InfluenzaA__AIW60701
augaagaccaucauugcccugagcuacauccucugccugguguucacacagaaacuucccggcaacgacaauuccacggcuacccugugucucgggcaccaugccgucccuaacggaacaauuguuaagaccaucacaaaugaucaaauugaggugaccaacgcgacagaacuggugcagucuagcuccaccggcgagaucugcgacucuccgcaccagauccuugauggggaaaauuguacgcugauugacgcucuccugggagauccccagugcgacggcuuucaaaacaaaaagugggaucuguucgucgagagaagcaaagccuauuccaauuguuacccuuaugacgugcccgauuacgccucucuccggagccugguugcuuccagcgggacccuugaauuuaacaaugagucuuucaacuggacaggagugacccagaauggcacauccagcgccugcauccgcagaucuaacaauuccuuuuucagccggcugaacuggcucacccaucugaaguuuaaguauccugcucuuaaugucacgaugcccaacaacgagaaauucgacaagcuguacauuuggggcgugcaccauccugggacagauaaugaccagaucuuuccguaugcccaggcgucuggacgcauuaccguuuccacaaaaagaagccaacagaccgugauccccaacauuggcucccggccucgcgucagaaauauccccucucggaucagcauuuacuggaccaucgugaagccuggggauauucuccugaucaacuccacaggaaaucugauugcuccccgcggcuacuucaaaaucagaagcgggaagucuuccaucaugcggagcgacgccccgauuggaaaguguaacucugaaugcaucacgccuaauggcagcauucccaacgacaaaccuuuucagaaugugaaccgcaucaccuauggcgccugucccagauacgucaagcagaauacacucaaacuggcuaccgggaugcggaacguucccgagaagcaaacacgcggaauuuucggcgccaucgcgggguuuaucgaaaauggaugggagggcaugguggaugggugguauggauucagacaccagaacuccgagggcauuggccaggccgcugaccuuaaaucuacccaagccgcuaucgaucagauuaaugggaagcugaaccggcucaucggaaaaacgaacgaaaaguuccaccagauugagaaggaauuuagcgagguggaaggcagaauccaggaccuggagaaauacgucgaggauacaaagauugaccuuugguccuauaaugccgaacugcucguggcccuggagaaccaacauaccaucgaucugaccgacagcgaaaugaauaaacucuucgagaagaccaaaaagcagcugcgcgaaaacgcugaggauauggggaauggaugcuuuaagaucuaccacaaaugugacaacgcgugcauuggcucuauccggaaugggacauaugaucaugacguuuacagagacgaggcccuuaacaaucgcuuccagauuaagggcguggaacugaaauccggauacaaggauuggauccucuggauuagcuuugcuaucucuugcuuccugcuuugugucgcccugcucggcuuuaucaugugggccugccagaaagggaacauucgguguaauaucugcauuuga

SEQ ID NO: 195820 - RNA, 1701 nt, Artificial Sequence
  derived and/or modified sequence opt5 from hemagglutinin__InfluenzaA__AIW60702
augaagaccaucauugcccugagcuacauccucugccugguguucacacagaaacuucccggcaacgacaauuccacggcuacccugugucucgggcaccaugccgucccuaacggaacaauuguuaagaccaucacaaaugaucaaauugaggugaccaacgcgacagaacuggugcagucuagcuccaccggcgagaucugcgacucuccgcaccagauccuugauggggaaaauuguacgcugauugacgcucuccugggagauccccagugcgacggcuuucaaaacaaaaagugggaucuguucgucgagagaagcaaagccuauuccaauuguuacccuuaugacgugcccgauuacgccucucuccggagccugguugcuuccagcgggacccuugaauuuaacaaugagucuuucaacuggacaggagugacccagaauggcacauccagcgccugcauccgcagaucuaacaauuccuuuuucagccggcugaacuggcucacccaucugaaguuuaaguauccugcucuuaaugucacgaugcccaacaacgagaaauucgacaagcuguacauuuggggcgugcaccauccugggacagauaaugaccagaucuuucucuaugcccaggcgucuggacgcauuaccguuuccacaaaaagaagccaacagaccgugaucccgaacauuggcucccggccccgcgucagaaauaucccuucucggaucagcauuuacuggaccaucgugaagcccggggauauucugcugaucaacuccacaggaaaucucauugccccucgcggcuacuucaaaaucagaagcgggaagucuuccaucaugcggagcgacgcucccauuggaaaguguaacucugaaugcaucacgccgaauggcagcauuccuaacgacaaacccuuucagaaugugaaccgcaucaccuauggcgccuguccuagauacgucaagcagaauacacugaaacuugcuaccgggaugcggaacguucccgagaagcaaacacgcggaauuuucggcgccaucgcgggguuuaucgaaaauggaugggagggcaugguggaugggugguauggauucagacaccagaacuccgagggcauuggccaggccgcugaccugaaaucuacccaagccgcuaucgaucagauuaaugggaagcucaaccggcugaucggaaaaacgaacgaaaaguuccaccagauugagaaggaauuuagcgagguggaaggcagaauccaggaccuugagaaauacgucgaggauacaaagauugaccugugguccuauaaugccgaacuccugguggcccuggagaaccaacauaccaucgaucucaccgacagcgaaaugaauaaacuguucgagaagaccaaaaagcagcuucgcgaaaacgcugaggauauggggaauggaugcuuuaagaucuaccacaaaugugacaacgcgugcauuggcucuauccggaaugggacauaugaucaugacguuuacagagacgaggcccugaacaaucgcuuccagauuaagggcguggaacucaaauccggauacaaggauuggauccuguggauuagcuuugcuaucucuugcuuccuucugugugucgcccuccugggcuuuaucaugugggccugccagaaagggaacauucgguguaauaucugcauuuga

SEQ ID NO: 195821 - RNA, 1701 nt, Artificial Sequence; identical to SEQ ID NO: 195565
  derived and/or modified sequence opt5 from hemagglutinin__InfluenzaA__AIZ07211

SEQ ID NO: 195822 - RNA, 1701 nt, Artificial Sequence
  derived and/or modified sequence opt5 from hemagglutinin__InfluenzaA__AIZ07212
augaagaccaucauggcccugagcuacauucucugccugguguucgcucagaaacuucccggcaacgacaauuccacagccacgcugugucucgggcaccaugcggucccuaacggaaccaucguuaagacaauuaccaaugauagaaucgaggugacaaacgcuaccgaacuggugcaaaauucuagcauuggcgagaucugcgacuccccgcaccagauccuugauggggaaaacuguacacugauugacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcaucagaggcagcaauucuuccuuuuucagccggcugaacuggcucacacauucuaauuuuaaguauccugcgcugaacgucaccaugcccaacaaugagcaguucgacaaacuuuacauuuggggagugcaccauccugggacagauaaggaccagaucuuucuguaugcccaguccagcggccgcauuaccguuuccacgaagagaucucaacaggcugugaucccgaacauugggagccggccccgcaucagaaauaucccuucccggauuagcaucuacuggacaauugucaaacccggagauauccuccugauuaacucuaccggcaaucugaucgccccucgcggguacuucaagaucagauccggaaaaagcucuauuaugcggagcgacgcucccaucggcaaguguaaguccgaaugcauuacaccgaacggcucuaucccuaaugacaaacccuuucagaacgugaaucgcauuaccuauggggccuguccuagauacgugaagcagagcacccucaaacuggcgacaggaaugcggaacguccccgagaagcaaacgcgcggcaucuucggggccaucgcuggauuuauugaaaauggcugggaggggaugauggauggaugguauggcuucagacaccagaacuccgagggccgggggcaggccgcugaccuuaaaagcacccaagccgccaucgaucagauuaauggaaagcugaacagacucaucggcaaaacaaaugaaaaguuccaccagauugagaaggaauuuucugagguugaagggcgcauccaggaccuggagaaauacguggaggauaccaagauugaccuuugguccuauaacgcugaacugcucguggcgcuggagaaccaacauacaaucgaucugaccgacagcgaaaugaauaaacucuucgagaagacgaaaaagcagcugcgggaaaacgccgaggauaugggaaauggcugcuuuaagaucuaccacaaaugugacaacgcuugcauugggucuaucagaaauggcacauaugaucaugacgucuaccgcgacgaggcccuuaacaaucgguuccagauuaagggaguggaacugaaauccggcuacaaggauuggauccucuggauuagcuuugccaucuccugcuuccugcuuuguguugcucugcucggguuuaucaugugggccugccagaaaggaaacauuagauguaauaucugcauuuga

SEQ ID NO: 195823 - RNA, 1683 nt, Artificial Sequence
  derived and/or modified sequence opt5 from hemagglutinin__InfluenzaA__AJD78175
auggagaccgccagccugaucacaauucuccugguggucacgguuuccaacgcugacaagaucugcauuggcuaccagucuaccaauagcacagaaaccguggauacacuuaccgagaacaaugugcccgucacacacgccaaggaacugcuccauaccgagcacaacgggaugcugugugcgacgucccuuggacaaccucugauccucgauaccugcacaauugaaggccugaucuaugggaauccgucuugugaccugcuccugggaggcagagaguggagcuacaucguggagcggcccuccgcugccaacgggcuuugcuauccuggaaauguugaaaaccuggaggaacuccgcucucuguucagcuccgccagaagcuaccagcggauucagaucuuucccgacaccauuuggaaugugucuuauuccggcacaagcaaggcuuguucugauuccuucuaccgcagcaugagauggcuuacccagaaagacaacacguauccuauccaagaugcccaguacacaaauaaccagggcaagaauauucuguuuaugugggggaucaaccaucccccuaccgacacagcucagaccaaucucuacacccggacagauacgaccacaucugucgccaccgaggagauuaaccgcacauucaaaccgcugaucggacccagaccucuggugaacggccucauggggcggaucaauuauuacugguccguucugaagcccggacaaacccuucgcauuaagagcaacggcaaucugaucgcgccuugguaugggcacauucucuccggagaaucucauggcagaauccugaaaacggaccuuaagcggggcagcugcacagugcagugucagaccgagaaagggggacugaacaccacacuccccuuucagaaugucuccaaguacgccuucggcaacugcagcaaauauauugggaucaagucucugaagcuggcugugggacuccgcaaugugccguccagaagcucucggggccuguuuggggccaucgcuggauucauugaaggcggcuggagcgggcuugucgccggaugguacggcuuucaacacuccaacgaucaggggguuggaauggcggccgaccgcgauucuacccagaaagcuaucgacaagauuacaagcaaagugaauaacaucguggacaagaugaauaaacaauaugagauuaucgaucacgaguucaacgaagucgagacgagacugaauaugaucaacaauaagauugacgaucagauccaggacauuugggccuacaacgcugaacuccuggugcuucuggagaaccagaaaacccucgaugaacaugacgccaauguuaacaaucuguacaacaaggugaagcgggcccugggcuccaaugcugucgaggaugggaaaggcuguuuugaacucuaucacaagugcgacgaucaauguauggagacaaucagaaacggaaccuacaaucgccggaaauaucaggaggaaagcaagcuggagagacagaaaauugaaggcgugaaacuugagucugaagggacauacaagauccugaccauuuauuccacgguugcgagcucucucgugaucgccaugggauucgcugccuuucuguucugggccauguccaacggcagcugccgcugcaauaucuguauuuga

SEQ ID NO: 195824 - RNA, 1683 nt, Artificial Sequence
  derived and/or modified sequence opt5 from hemagglutinin__InfluenzaA__AJD78187
auggagaccgccagccugaucacaauucuccugguggucacgguuuccaacgcugacaagaucugcauuggcuaccagucuaccaauagcacagaaaccguggauacacuuaccgagaacaaugugcccgucacacacgccaaggaacugcuccauaccgagcacaacgggaugcugugugcgacgucccuuggacauccucugauccucgauaccugcacaauugaaggccugaucuaugggaauccgucuugugaccugcuccugggaggcagagaguggagcuacaucguggagcggcccuccgcuguuaacgggcuuugcuauccuggaaauguggaaaaccuggaggaacuccgcucucuguucagcuccgccagaagcuaccaacggauucagaucuuucccgacaccauuuggaaugucucuuauuccggcacaagcaagaccuguucugauuccuucuaccgcagcaugagauggcuuacgcagaaagacaacgccuauccuauccaggaugcucaauacacaaauaaccagggcaagaauauucuguuuaugugggggaucaaccaucccccuaccgacacaacccagaccaaucucuacacacggacggauaccacaaccucuguggccacagaggagauuaaccgcaccuucaaaccgcugaucggacccagaccucugguuaacggccucauggggcggaucaauuauuacugguccgugcugaagcccggacagacgcuucgcauuaagagcaacggcaaucugaucgcuccuugguaugggcacauucucuccggagaaucucacggcagaauccugaaaacagaccuuaagcggggcagcugcaccguccaaugucagaccgagaaagggggacugaacacaacccuccccuuucagaauguguccaaguacgccuucggcaacugcagcaaauauauugggaucaagucucugaagcuggcggugggacuccgcaaugucccguccagaagcucucggggccuguuuggggccaucgcuggauucauugaaggcggcuggagcgggcuuguugccggaugguacggcuuucagcacuccaacgaucaaggggugggaauggcugccgaccgcgauucuacacagaaagcgaucgacaagauuacgagcaaagugaauaacaucgucgacaagaugaauaaacaguaugagauuaucgaucaugaguucuccgaaguggagaccagacugaacaugaucaauaacaagauugacgaucaaauccaggacauuugggccuacaaugcugaacuccugguucuucuggagaaccagaaaacacucgaugaacacgacgccaacgugaauaaccuguacaauaaggucaagcgggcucugggcagcaacgccguggaggaugggaaaggcuguuuugaacucuaucauaagugcgacgaucaguguauggagaccaucagaaauggaacauacaaccgccggaaauaucaagaggaaucuaagcuggagagacagaaaauugaaggcguuaaacuugaguccgaagggaccuacaagauccugacgauuuauagcaccguggccucuucccucgucaucgcuaugggauucgcggccuuucuguucugggcuaugagcaauggcuccugccgcugcaacaucuguauuuga

SEQ ID NO: 195825 - RNA, 1683 nt, Artificial Sequence
  derived and/or modified sequence opt5 from hemagglutinin__InfluenzaA__AJD78199
auggagaccgugagccugaucacaauucuccuggucgccacgguuuccaacgcugacaagaucugcauuggcuaccagucuaccaauagcacagaaaccguggauacacuuaccgagaacaaugugcccgucacacacgccaaagaacugcuccauaccgagcacaacgggaugcugugugcgacgucccuuggacaaccucugauccucgauaccugcacaauugaaggccugaucuaugggaauccgucuugugaccugagccucgagggaagagagugguccuacaucguggaacggcccucugcuguuaacggccugugcuauccugggaauguggagaaccuugaggaacugcgcagccucuucuccagcgccagaucuuaccagcggauucagaucuuucccgacaccauuuggaaugucuccuaugauggaacaagcaccgccuguucuggcuccuucuaccgcagcaugagauggcugacgcggaagaacggcgacuauccuauccaggaugcucaauacacaaauaaccaggggaaaaauauucuuuuuauguggggaaucaaccaucccccuaccgacacaacccagcgcgaucuguacaccagaacagacacgaccacaucuguggccaccgaggaaauuaaucggaucuucaagccgcucaucggcccccgcccucugguuaacgggcugaugggaagaauugauuauuacugguccgugcucaaacccggccagacacugcggaucaagagcgacgggaaccuuauugcuccuugguauggacacauccuguccggcgagucucauggccgcauucucaagaccgaucugaaaagagggagcugcacgguccaaugucagacagaaaagggaggccuuaauaccacccugcccuuucagaacguguccaaauacgccuucgggaauugcagcaaguauaucggaaucaaaucucucaagcuggcggugggccugcggaacgucccgucccgcagcucuagagggcucuuuggagccauugcuggcuucaucgagggcggguggagcggacugguugccggcugguacggguuucagcacuccaaugaccaaggagugggcauggcugccgaccgggauucuacacagaaggcgauugacaaaaucaccagcaaggugaacaauauugucgauaaaaugaacaagcaguaugaaaucaucgaccacgaguucuccgagguggaaacaagacuuaauaugauuaacaauaaaaucgaugaccaaauucaggauaucugggccuacaacgcugagcugcucguucugcuugaaaaucagaagacgcuggacgagcaugaugccaacgugaauaaccucuacaacaaagucaagcgcgcucuggggagcaaugccguggaagacggcaagggauguuuugagcuguaucacaaaugcgaugaccaguguauggagaccauucggaacggcacauacaauagacgcaaguaucaagaagagucuaaacucgaacggcagaagaucgaggggguuaaacuggaauccgagggaaccuacaagauucuuacaaucuauagcaccguggccucuucccuggucaucgcuaugggcuucgcggccuuucucuucugggcuaugagcaacggguccugcagaugcaauauuuguaucuga

SEQ ID NO: 195826 - RNA, 1683 nt, Artificial Sequence
  derived and/or modified sequence opt5 from hemagglutinin__InfluenzaA__AJD78211
auggagaccgugagccugaucacaauucuccuggucgccacgguuuccaacgcugacaagaucugcauuggcuaccagucuaccaauagcacagaaaccguggauacacuuaccgagaacaaugugcccgucacacacgccaaagaacugcuccauaccgagcacaacgggaugcugugugcgacgucccuuggacaaccucugauccucgauaccugcacaauugaaggccugaucuaugggaauccgucuugugaccugagccucgagggaagagagugguccuacaucguggaacggcccucugcuguuaacggccugugcuauccugggaauguggagaaccuugaggaacugcgcagccucuucuccagcgccagaucuuaccagcggauucagaucuuucccgacaccauuuggaaugucuccuaugauggaacaagcaccgccuguucuggcuccuucuaccgcagcaugagauggcugacgcggaagaacggcgacuauccuauccaggaugcucaauacacaaauaaccaggggaaaaauauucuuuuuauguggggaaucaaccaucccccuaccgacacaacccagcgcgaucuguacaccagaacagacacgaccacaucuguggccaccgaggaaauuaaucggaucuucaagccgcucaucggcccccgcccucugguuaacgggcugaugggaagaauugauuauuacugguccgugcucaaacccggccagacacugcggaucaagagcgacgggaaccuuauugcuccuugguauggacacauccuguccggcgagucucauggccgcauucucaagaccgaucugaaaagagggagcugcacgguccaaugucagacagaaaagggaggccuuaauaccacccugcccuuucagaacguguccaaauacgccuucgggaauugcagcaaguauaucggaaucaaaucucucaagcuggcggugggccugcggaacgucccgucccgcagcagacgggggcucuuuggagccauugcuggcuucaucgagggcggguggucuggacugguugccggcugguacggguuucagcacagcaaugaccaaggagugggcauggcugccgacagagauuccacacagaaggcgauugacaaaaucaccucuaaggugaacaauauugucgauaaaaugaacaagcaguaugaaaucaucgaccacgaguucagcgagguggaaacacgccuuaauaugauuaacaauaaaaucgaugaccaaauucaggauaucugggccuacaacgcugagcugcucguucugcuugaaaaucagaagacgcuggacgagcaugaugccaacgugaauaaccucuacaacaaagucaagcgggcucugggguccaaugccguggaagacggcaagggauguuuugagcuguaucacaaaugcgaugaccaguguauggagaccauuagaaacggcacauacaaucgccggaaguaucaagaagagagcaaacucgaaagacagaagaucgaggggguuaaacuggaaucugagggaaccuacaagauucuuacaaucuauuccaccguggccagcucucuggucaucgcuaugggcuucgcggccuuucucuucugggcuauguccaacgggagcugccgcugcaauauuuguaucuga

SEQ ID NO: 195827 - RNA, 1689 nt, Artificial Sequence
  derived and/or modified sequence opt5 from hemagglutinin__InfluenzaA__AJI76401
auggccaucauuuaccugauccuccuguucgcuaccgugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucagagugcccgaauggucuuacaucauggagaaagagaacccucgguauagccugugcuaccccgggucccuuaaugauuaugaagaacugaagcaucuccugucuagcgucaagcacuuugaaaaagugcgcauucuuccuaaggacagauggacaaaccauaccacaaccggaggcuccaaagccugugccguuucuggcaagcccagcuucuuucggaauaugguguggcugacgaaaaaggggccuaacuacccggucgcuaagggauccuauaauaacaccagcggcgagcaaaugcucaucauuuggggagugcaccaccccaucgaugaggccgaacagcgcgcucuguaccagaauguugggacauacgugucugccuccaccagcacacuguauaaaagaucuauuccugagaucgcggcccggcccgaagucaacggccucgggucccgcauggaguucagcuggacccugcuugacgugugggauacgaucaauuuugaaucuacaggaaaccugguggcuccugaguacggcuucaagauuuccaaaagaggcagcuccgggaucaugaagaccgagggaacacucggcaacugcgaaaccaaaugucagacaccccugggggccauuaauaccacgcuuccguuucauaacguccacccucugaccaucggagagugccccaaguauguuaaaucugaaaagcucgugcuggcuacaggccugcggaaugugccucaaauugagagccgcggacucuucggggccaucgcgggcuuuaucgaaggcggguggcagggaauggucgacggcugguacggguaucaucacuccaacgaucagggaagcggcuacgccgcugacaaggagucuacccagaaagccuucgaugggauuacaaauaaggugaacuccguuaucgagaaaaugaauacccaauuugaagcugugggcaaggaguucaacaaucuggagaaaagacuugagaaccugaauaagcggauggaagacggauuucucgacgucuggacguauaacgccgagcugcuugugcugauggagaaugaacgcacacucgauuuccacgacagcaacguuaagaaucuguacgagaaagugagaaugcagcugcgggauaacgucagagaacucggcaacggguguuucgaguuuuaccauaagugcgacgaugaguguaugaacucugugaaaaauggaaccuaugacuaccccaaguaugaagaggaaagcaaacugaagcgcaaugagauuaagggcgucaaacuuuccucuauggggguguaccagauccuggccauuuaugcuaccguugcgggaagccucucccuggccaucaugguggcuggcaucagcuucuggaugugcucuaacgggucccugcagugccggauuuguaucuga

SEQ ID NO: 195828 - RNA, 1701 nt, Artificial Sequence; identical to SEQ ID NO: 195089
  derived and/or modified sequence opt5 from hemagglutinin__InfluenzaA__AJI80137

SEQ ID NO: 195829 - RNA, 1701 nt, Artificial Sequence; identical to SEQ ID NO: 195089
  derived and/or modified sequence opt5 from hemagglutinin__InfluenzaA__AJI80149

SEQ ID NO: 195830 - RNA, 1701 nt, Artificial Sequence; identical to SEQ ID NO: 193064
  derived and/or modified sequence opt5 from hemagglutinin__InfluenzaA__AJI80161

SEQ ID NO: 195831 - RNA, 1701 nt, Artificial Sequence
  derived and/or modified sequence opt5 from hemagglutinin__InfluenzaA__AJI80172
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguucucugaucgacgcccuccugggagauccccagugcgacggcuuucagaauaaaaagugggaucuguucgucgagcggagcaaagccuauuccaacuguuacccuuaugacgugcccgauuacgcuucucuccgcagccugguugccuccagcgggacacuugaauuuaauaacgagucuuucaauugggcuggagugacccaaaacggcacguccagcgccugcauuagaggcucuaauuccagcuuuuucucucggcugaacuggcucacccaucugaauuuuaaguauccugcgcuuaacgucacaaugcccaacaaugagcaguucgacaagcuguacaucuggggagugcaccauccugggaccgauaaagaccagauuuuucucuaugcccaguccagcggccgcaucacaguuuccaccaagagaucucaacaggcugugauuccgaacaucgggagccggccccgcaucagaaauauuccuucccggaucagcauuuacuggacgaucgucaaacccggagauauucugcugaucaacucuacaggcaaucucaucgccccucgcggguacuucaagauuagauccggaaaaagcucuaucaugcggagcgacgcucccauuggcaaguguaaguccgaaugcaucaccccgaacggcucuauuccuaaugacaaacccuuucagaacgugaaucgcaucacauauggggccuguccuagauacgugaagcagagcacccugaaacuugcgaccggaaugcggaacguccccgagaagcaaacacgcggcaucuucggggccauugcuggauuuaucgaaaauggcugggaggggaugguugauggaugguauggcuucagacaccagaacuccgagggccgggggcaggccgcugaccugaaaagcacgcaagccgccauugaucagaucaauggaaagcucaacagacugauuggcaaaaccaaugaaaaguuccaccagaucgagaaggaauuuucugagguggaagggcgcauucaggaccuugagaaauacguggaggauacaaagaucgaccugugguccuauaacgcugaacuccuggucgcgcuggagaaccaacauaccaucgaucucacagacagcgaaaugaauaaacuguucgagaagaccaaaaagcagcuucgggaaaacgccgaggauaugggaaauggcugcuuuaagauuuaccacaaaugugacaacgcuugcaucgggucuauuagaaauggcacguaugaucaugacguguaccgcgacgaggcccugaacaaucgguuccagaucaagggaguugaacucaaauccggcuacaaggauuggauucuguggaucagcuuugccaucuccugcuuccuucuguguguggcucuccugggguuuauuaugugggccugccagaaaggaaacaucagauguaauauuugcaucuga

SEQ ID NO: 195832 - RNA, 1701 nt, Artificial Sequence
  derived and/or modified sequence opt5 from hemagglutinin__InfluenzaA__AJI80196
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaagagugggaucuguucgucgaacggucuaaggccuauagcaacuguuacccuuaugacgugcccgauuacgcuucccuccgcucucugguugccagcuccgggacccuugaguuuaauaacgagagcuucaauugggcuggagugacgcaaaacggcaccucuuccgccugcauuagaggcagcaauucuuccuuuuucagccggcugaacuggcucacacaucugaauuuuaaauauccugcgcuuaacgucaccaugcccaacaaugaacaguucgacaagcuguacaucuggggagugcaccauccugggacagauaaggaccagauuuuucucuaugcccagucuuccggccgcaucaccguuagcacgaaaagaucccaacaggcugugauuccgaacaucgggucucggccccgcaucagaaauauuccuagccggaucuccauuuacuggacaaucgucaagcccggagauauucugcugaucaacagcaccggcaaucucaucgccccucgcggguacuucaaaauuagaucuggaaaguccagcaucaugcggucugacgcucccauuggcaaauguaagagcgagugcaucacaccgaacggcuccauuccuaaugacaagcccuuucagaacaucaaucgcaucaccuauggggccuguccuagauacgugaaacagucuacccugaaacuugcgacaggaaugcggaacgugcccgaaaaacaaacgcgcggcauuuucggggccaucgcuggauuuauugagaauggcugggaggggauggucgauggaugguauggcuucagacaccagaacagcgaaggccgggggcaggccgcugaccugaaguccacccaagccgccaucgaucagauuaauggaaaacucaacagacugaucggcaagacaaaugagaaauuccaccagauugaaaaggaguuuagcgaaguugaggggcgcauccaggaccuugagaaguacguggaagauaccaaaaucgaccuguggucuuauaacgcugaguuccucguggcgcuggaaaaccaacauacaauugaucugaccgacuccgagaugaauaagcucuuugaaaagacgaagaaacagcugcgggagaacgccgaggauaugggaaauggcugcuucaagaucuaccacaagugugacaacgcuugcauugggagcaucagaaauggcacauaugaucaugacgucuaccgcgacgaagcccuuaacaaucgguuucagauuaaaggaguggagcugaagucuggcuacaaagauuggauccucuggaucuccuucgccauuagcugcuuucugcuuuguguugcucugcucggguucaucaugugggccugccagaagggaaacauuagauguaauaucugcauuuga

SEQ ID NO: 195833 - RNA, 1701 nt, Artificial Sequence; identical to SEQ ID NO: 195639
  derived and/or modified sequence opt5 from hemagglutinin__InfluenzaA__AJI80208

SEQ ID NO: 195834 - RNA, 1701 nt, Artificial Sequence; identical to SEQ ID NO: 193018
  derived and/or modified sequence opt5 from hemagglutinin__InfluenzaA__AJI80220

SEQ ID NO: 195835 - RNA, 1701 nt, Artificial Sequence; identical to SEQ ID NO: 195831
  derived and/or modified sequence opt5 from hemagglutinin__InfluenzaA__AJI80232

SEQ ID NO: 195836 - RNA, 1701 nt, Artificial Sequence; identical to SEQ ID NO: 193018
  derived and/or modified sequence opt5 from hemagglutinin__InfluenzaA__AJI80244

SEQ ID NO: 195837 - RNA, 1701 nt, Artificial Sequence; identical to SEQ ID NO: 192882
  derived and/or modified sequence opt5 from hemagglutinin__InfluenzaA__AJI80256

SEQ ID NO: 195838 - RNA, 1701 nt, Artificial Sequence; identical to SEQ ID NO: 193018
  derived and/or modified sequence opt5 from hemagglutinin__InfluenzaA__AJI80268

SEQ ID NO: 195839 - RNA, 1701 nt, Artificial Sequence
  derived and/or modified sequence opt5 from hemagglutinin__InfluenzaA__AJI80280
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcaaaaucugcgacuccccgcaccagauucuugauggggagaacuguacacugaucgacgcccuccugggagauccccagugcgacggcuuucagaauaaggaaugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugguugauggaugguauggcuucagacaccagaacagcgagggccgggggcaggccgcugaccugaaauccacccaagccgccauugaucagaucaauggaaagcucaacagacugauuggcaaaacaaaugaaaaguuccaccagaucgagaaggaauuuagcgagguggaagggcgcauucaggaccuugagaaauacguggaggauaccaagaucgaccuguggucuuauaacgcugaacuccuggucgcgcuggagaaccaacauacaaucgaucucaccgacuccgaaaugaauaaacuguucgagaagacgaaaaagcagcuucgggaaaacgccgaggauaugggaaauggcugcuuuaagauuuaccacaaaugugacaacgcuugcaucgggagcauuagaaauggcacauaugaucaugacguguaccgcgacgaggcccugaacaaucgguuccagaucaagggaguugaacucaaaucuggcuacaaggauuggauucuguggaucuccuuugccaucagcugcuuccuucuguguguggcucuccugggguuuauuaugugggccugccagaaaggaaacaucagauguaauauuugcaucuga

SEQ ID NO: 195840 - RNA, 1701 nt, Artificial Sequence; identical to SEQ ID NO: 195611
  derived and/or modified sequence opt5 from hemagglutinin__InfluenzaA__AJI80292

SEQ ID NO: 195841 - RNA, 1701 nt, Artificial Sequence; identical to SEQ ID NO: 195639
  derived and/or modified sequence opt5 from hemagglutinin__InfluenzaA__AJI80303

SEQ ID NO: 195842 - RNA, 1701 nt, Artificial Sequence; identical to SEQ ID NO: 195611
  derived and/or modified sequence opt5 from hemagglutinin__InfluenzaA__AJI80315

SEQ ID NO: 195843 - RNA, 1701 nt, Artificial Sequence
  derived and/or modified sequence opt5 from hemagglutinin__InfluenzaA__AJI80326
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaaaagaaugccgggagcggaaucauuaucucugacacccccguccaugauugcaacaccacaugucagacgccugagggcgcuaucaauaccucccuccccuuccagaacauucacccgaucacaauuggcaaaugcccuaaguauguuaagagcaccaaacugcgccuugccacagggcugagaaaugugcccucuauccagagccggggacucuuuggcgcuauugccggguucaucgaaggaggcuggaccgggaugguggacggaugguacggcuaucaucaccaaaacgagcagggcuccggguacgccgcugaccugaagucuacgcagaaugcgaucgauaaaauuacaaacaaggucaauagcgugaucgagaaaaugaacacccaguuuaccgccguuggaaaggaguucaaucaccuugagaagcgcauugaaaaccugaauaaaaagguggacgauggcuuccucgacaucuggacauacaacgcugagcugcugguccuccuggaaaaugagagaacccuugauuaucaugacuccaacgugaaaaaccuguacgagaagguccggaaucaacucaaaaacaaugccaaggaaauugggaacggauguuuugaguucuaucacaagugcgauaauacauguauggaaagcgugaaaaacggcacguacgacuauccuaaguacucugaggaagccaaacugaaucgcgagaagaucgaugggguuaaacuugaguccaccagaaucuaucagauucuggcuaucuacagcacaguggccucuucccucguccuggugguuagccugggcgcgauuuccuuuuggaugugcucuaacggaagccuccagugccggaucuguauuuga

SEQ ID NO: 195844 - RNA, 1701 nt, Artificial Sequence
  derived and/or modified sequence opt5 from hemagglutinin__InfluenzaA__AJI80337
augaaggccauccuggugguccuccuguacaccuucgcuacagccaacgcggacacgcuuugcauuggcuaucacgcuaauaacagcaccgauacaguugacaccgugcuggagaagaaugugacagucacccauuccaucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucaauuacgaagaacugcgggagcagcuuuccagcgugucuuccuucgaacgcuuugagauguuccccaagaccagcucuuggccuaaccacgacuccaauaagggagucacagccgcuuguccccaugccggcgcgaaaucuuuuuauaagaaccugaucuggcucgugaaaaagggcaauagcuacccuaaacuguccaagagcuauauuaacgauaaggggaaagaaguucuugugcuguggggaauccaccaccccuccaccacagccgaccaacagucucucuaccagaaugcuaacgccuacgucuucgugggcaccagcaaguauuccaaaaaguuuaaaccugagauugcuaucagaccgaaggugcgggaucaggaggggcgcaugaacuacuauuggacgcugauugaacccggagacaaaaucacauucgaggccaccggcaaucuggucguuccuagauacgcguuugccauggaacggaacgcugggagcggaauuaucaucucugauacacccgugcaugacugcaauaccaccugucaaacaccugagggcgccauuaacacgucccuccccuuccagaauauccacccgauuaccaucggcaagugcccuaaguaugugaaaagcacaaagcugcgccuugcuaccgggcugagaaacauucccucuauccagagccggggacucuuuggcgccaucgccggguucauugaaggaggcuggacagggauggucgauggaugguacggcuaucaucaccagaaugagcaaggcuccggguacgcugcggaccugaaaucuacccagaacgccaucgacaagauuacgaauaaagugaacagcguuaucgagaagaugaauacacaguuuaccgcugugggaaaggaguucaaccaccuugagaaacgcauugaaaaucugaacaagaaagucgaugacggcuuccucgauaucuggaccuacaaugccgagcugcuggugcuccuggaaaacgagagaacacuugacuaucaugauuccaacguuaagaaucuguacgagaaagugcggaaccagcucaagaauaacgccaaggaaaucgggaauggauguuuugaguucuaucacaaaugcgacaacaccuguauggaaagcgucaagaauggcacauacgauuauccuaaauacucugaggaagcuaagcugaaccgcgagaaaauugacggggugaaacuugaguccacgagaaucuaucaaauucuggccaucuacagcaccgucgcgucuucccucgugcugguugugagccugggcgcuauuuccuuuuggaugugcucuaauggaagccuccagugccggaucuguauuuga

SEQ ID NO: 195845 - RNA, 1701 nt, Artificial Sequence; identical to SEQ ID NO: 193018
  derived and/or modified sequence opt5 from hemagglutinin__InfluenzaA__AJI80348

SEQ ID NO: 195846 - RNA, 1701 nt, Artificial Sequence; identical to SEQ ID NO: 192882
  derived and/or modified sequence opt5 from hemagglutinin__InfluenzaA__AJI80360

SEQ ID NO: 195847 - RNA, 1701 nt, Artificial Sequence; identical to SEQ ID NO: 192882
  derived and/or modified sequence opt5 from hemagglutinin__InfluenzaA__AJI80372

SEQ ID NO: 195848 - RNA, 1701 nt, Artificial Sequence; identical to SEQ ID NO: 193064
  derived and/or modified sequence opt5 from hemagglutinin__InfluenzaA__AJI80384

SEQ ID NO: 195849 - RNA, 1701 nt, Artificial Sequence; identical to SEQ ID NO: 193064
  derived and/or modified sequence opt5 from hemagglutinin__InfluenzaA__AJI80395

SEQ ID NO: 195850 - RNA, 1701 nt, Artificial Sequence; identical to SEQ ID NO: 193064
  derived and/or modified sequence opt5 from hemagglutinin__InfluenzaA__AJI80406

SEQ ID NO: 195851 - RNA, 1701 nt, Artificial Sequence; identical to SEQ ID NO: 193064
  derived and/or modified sequence opt5 from hemagglutinin__InfluenzaA__AJI80417

SEQ ID NO: 195852 - RNA, 1701 nt, Artificial Sequence; identical to SEQ ID NO: 193064
  derived and/or modified sequence opt5 from hemagglutinin__InfluenzaA__AJI80428

SEQ ID NO: 195853 - RNA, 1701 nt, Artificial Sequence; identical to SEQ ID NO: 193018
  derived and/or modified sequence opt5 from hemagglutinin__InfluenzaA__AJI80439

SEQ ID NO: 195854 - RNA, 1701 nt, Artificial Sequence; identical to SEQ ID NO: 193018
  derived and/or modified sequence opt5 from hemagglutinin__InfluenzaA__AJI80462

SEQ ID NO: 195855 - RNA, 1701 nt, Artificial Sequence
  derived and/or modified sequence opt5 from hemagglutinin__InfluenzaA__AJI80474
augaaggccauccuggugguccuccuguacaccuucgcuacagccaacgcggacacgcuuugcauuggcuaucacgcuaauaacagcaccgauacaguugacaccgugcuggagaagaaugugacagucacccauuccaucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucaauuacgaagaacugcgggagcagcuuuccagcgugucuuccuucgaacgcuuugagaucuuccccaagaccagcucuuggccuaaccacgacuccaauaagggagucacagccgcuuguccccaugccggcgcgaaaucuuuuuauaagaaccugauuuggcucgugaaaaagggcaauagcuacccuaaacugucccaaagcuauaucaacgauaaggggaaggaaguucuugugcuguggggcauucaccaccccuccaccacagccgaccagcagucucucuaccagaaugcugaugccuacgucuucgugggaaccagcagauauuccaaaaaguuuaaaccugagaucgcuauucggccgaaggugcgcgaccaagaggggagaaugaacuacuauuggacgcuggucgaacccggagauaaaaucacauucgaggccaccggcaaccugguugugccucgguacgcguuuacaauggaacgcaaugccgggagcggaauuaucaucucugacacccccgugcaugauugcaacaccacaugucagacgccugagggcgcuauuaauaccucccuccccuuccagaacauccacccgauuacaaucggcaagugcccuaaauaugucaagagcaccaagcugagacuugccacagggcugcggaaugugcccucuauucagagccgcggacucuuuggcgcuaucgccggguucaucgaaggaggcuggaccgggaugguugacggaugguacggcuaucaucaccaaaacgagcagggcuccggguacgccgcugaccugaaaucuacgcagaaugcgauugauaagaucacaaacaaagugaauagcgucauugagaagaugaacacccaguuuaccgccgugggaaaagaguucaaucaccuugagaagagaaucgaaaaccugaauaagaaaguugacgauggcuuccucgacauuuggacauacaacgcugagcugcuggugcuccuggaaaaugagcggacccuugauuaucaugacuccaacgucaagaaccuguacgagaaagugcgcaaucaacucaagaacaaugccaaagaaaucgggaacggauguuuugaguucuaucacaagugcgauaauacauguauggaaagcgucaagaacggcacguacgacuauccuaaauacucugaggaagccaagcugaauagagagaaaaucgauggggugaaacuugaguccacccggauuuaucagauccuggcuauuuacagcacaguugccucuucccucgugcuggucgugagccugggcgcgaucuccuuuuggaugugcucuaacggaagccuccagugccgcauuuguaucuga

SEQ ID NO: 195856 - RNA, 1701 nt, Artificial Sequence; identical to SEQ ID NO: 195855
  derived and/or modified sequence opt5 from hemagglutinin__InfluenzaA__AJI80485

SEQ ID NO: 195857 - RNA, 1701 nt, Artificial Sequence; identical to SEQ ID NO: 193064
  derived and/or modified sequence opt5 from hemagglutinin__InfluenzaA__AJI80496

SEQ ID NO: 195858 - RNA, 1701 nt, Artificial Sequence; identical to SEQ ID NO: 195667
  derived and/or modified sequence opt5 from hemagglutinin__InfluenzaA__AJI80507

SEQ ID NO: 195859 - RNA, 1701 nt, Artificial Sequence; identical to SEQ ID NO: 193064
  derived and/or modified sequence opt5 from hemagglutinin__InfluenzaA__AJI80518

SEQ ID NO: 195860 - RNA, 1701 nt, Artificial Sequence; identical to SEQ ID NO: 191156
  derived and/or modified sequence opt5 from hemagglutinin__InfluenzaA__AJJ98765

SEQ ID NO: 195861 - RNA, 1701 nt, Artificial Sequence
  derived and/or modified sequence opt5 from hemagglutinin__InfluenzaA__AJJ98777
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuuuuagcacaggcgagaucugcaauuccccgcaccagauccuugacggggaaaacuguacccugauugaugcccuccugggagacccccagugcgauggcuuccaaaauaaaaagugggaccuguuugucgagagaucuaaagccuauagcaacuguuacccuuaugaugugcccgacuacgcuucccuccggucucugguugccagcuccgggacgcuugaauuuaauaacgagagcuucaauuggaccggagugacacagaacggcaccucuuccgcuugcauccgcagaagcaauaacucuuucuuuucccggcugaauuggcucacacaucugaaguucaaguauccugcccuuaacgucaccaugcccaacaaugaggaauuugauaaacuguacauuuggggcgugcaccauccugggacggacaacgaucagaucuuccucuaugcgcaggccagcggacgcauuacaguuucuaccaagagaucccaacagacagugaucccgaauauuggcagccggccccgcgucagaaacaucccuucccggaucucuauuuacuggaccaucgugaaacccggggacauucugcugaucaauagcaccggaaaccucauugcuccucgcggcuacuuuaagaucagauccgggaaaagcucuaucaugcgguccgaugcccccauuggaaaguguaauagcgagugcaucacaccgaacggcucuauuccuaaugacaagcccuuccagaacgugaaucgcaucacguauggcgcuuguccuagauacgucaaacagaacacccugaaacuugccacagggaugcggaauguucccgaaaaacaaacccgcggaauuuuuggcgcgaucgccggguucaucgagaacggaugggagggcaugguggacgggugguauggauucagacaccagaauagcgaaggcauuggccaggcugccgaucugaaguccacacaagcugccaucgaccagauuaacgggaaacucaaccggcugaucggaaagaccaaugagaaauuucaccagauugaaaaggaguucucugaaguggagggcagaauccaggaucuugagaaguacgucgaagacacgaaaauugaucuguggagcuauaacgccgagcuccugguggcucuggaaaaucaacauacaaucgaccucaccgauuccgagaugaacaagcuguuugaaaagaccaagaaacagcuucgcgagaaugcggaggacauggggaacggaugcuucaagaucuaccacaagugugauaaugccugcauuggcagcauccggaacgggacauaugaccaugauguuuacagagacgaagcucugaauaaccgcuuucagauuaaaggcguggagcucaagucuggauacaaagacuggauccuguggauuuccuucgccaucagcugcuuucuucugugugucgcccuccugggcuucaucaugugggcuugccagaaggggaauauucgguguaacaucugcauuuga

SEQ ID NO: 195862 - RNA, 1701 nt, Artificial Sequence; identical to SEQ ID NO: 192477
  derived and/or modified sequence opt5 from hemagglutinin__InfluenzaA__AJJ98789

SEQ ID NO: 195863 - RNA, 1701 nt, Artificial Sequence
  derived and/or modified sequence opt5 from hemagglutinin__InfluenzaA__AJJ98801
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagagaaacaaagccuauucuaauuguuacccuuaugacgugcccgauuacgcuagccuccggucccugguugccucuagcgggacccuugaauuuaacaaugaguccuucaacuggacgggagugacccagaauggcacaagcucugcuugcauucgcagauccaacaauagcuuuuucucucggcugaacuggcucacccaucugaacuuuaaguauccugcccuuaaugucacaaugcccaacaaugagcaguucgacaagcuguacaucuggggcgugcaccauccugggaccgauaaagaccagauuuuucucuaugcgcaauccagcggacgcaucacgguuucuacaaagagaucccagcaggccgugauuccgaacaucggcagccggccccgcaucagaaauauuccuucccggaucucuauuuacuggaccaucgucaaacccggggauauucugcugaucaacagcacaggaaaucucaucgcuccucgcggcuacuucaagauuagauccgggaaaagcucuaucaugcgguccgacgcccccauuggaaaguguaagagcgaaugcaucaccccgaacggcucuauuccuaaugacaaacccuuucagaacgugaaucgcaucaccuauggcgcuuguccuagauacgugaagcaaagcacacugaaacuugccacggggaugcggaacguccccgagaagcagacccgcggaaucuucggcgcgauugccggguuuaucgaaaauggaugggagggcaugguugaugggugguauggauucagacaccagaacuccgagggccggggccaagcugccgaccugaaaucuacacaggcugccauugaucagaucaaugggaagcucaacagacugauuggaaaaaccaacgaaaaguuccaccagaucgagaaggaauuuagcgagguggaaggccgcauucaagaccuugagaaauacguggaggauacaaagaucgaccugugguccuauaaugccgaacuccuggucgcucuggagaaccagcauaccaucgaucucacggacagcgaaaugaauaaacuguucgagaagaccaaaaagcagcuucgggaaaacgcggaggauauggggaauggaugcuuuaagauuuaccacaaaugugacaacgccugcaucggcucuauuagaaaugggacauaugaucaugacguguaccgcgacgaggcucugaacaaucgguuccagaucaagggcguugaacucaaauccggauacaaggauuggauucuguggaucagcuuugccaucucuugcuuccuucuguguguggcccuccugggcuuuauuaugugggcuugccaaaaagggaacaucagauguaauauuugcaucuga

SEQ ID NO: 195864 - RNA, 1701 nt, Artificial Sequence
  derived and/or modified sequence opt5 from hemagglutinin__InfluenzaA__AJJ98813
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccguggucccgaacauuggcucucgccccagaauccggaauaucccuagccgcauuuccaucuacuggaccauugugaaacccggggauauccugcugauuaacagcacaggaaaucucaucgcuccuagaggcuacuucaagauccggucugggaaauccagcauuaugcgcucugacgcccccaucggaaaguguaagagcgaaugcauuaccccgaacggcuccaucccuaaugacaaacccuuucagaacgugaauagaauuaccuauggcgcuuguccucgguacgucaagcagucuacacugaaacuugccacggggaugcgcaacguucccgagaagcaaaccagaggaaucuucggcgcgaucgccggguuuauugaaaauggaugggagggcaugguggaugggugguauggauuccggcaccagaacagcgagggcagaggccaggcugccgaccugaaauccacacaagcugccaucgaucagauuaaugggaagcucaaccgccugaucggaaaaaccaaugaaaaguuccaccagauugagaaggaauuuagcgagguggaaggccggauccaggaccuugagaaauacgucgaggauacaaagauugaccuguggucuuauaacgccgaacuccugguggcucuggagaaccaacauaccaucgaucucacggacuccgaaaugaauaaacuguucgagaagaccaaaaagcagcuuagagaaaacgcggaggauauggggaauggaugcuuuaagaucuaccacaaaugugacaacgccugcauuggcagcauccgcaaugggacauaugaucaugacguuuaccgggacgaggcucugaacaauagauuccagauuaagggcguggaacucaaaucuggauacaaggauuggauccuguggauuuccuuugccaucagcugcuuccuucugugugucgcccuccugggcuuuaucaugugggcuugccagaaagggaacauucgcuguaauaucugcauuuga

SEQ ID NO: 195865 - RNA, 1701 nt, Artificial Sequence
  derived and/or modified sequence opt5 from hemagglutinin__InfluenzaA__AJJ98825
augaagaccaucauugcccugagcuacauccucugccugguguucgcucaggagcuucccggcaacgacaauuccacagccacgcugugucucgggcaccaugcggucccuaacggaaccauuguuaaaacaaucaccaaugauagaauugaagugacaaacgcuaccgagcuggugcaaaauucuagcaucggcgaaaucugcgacuccccgcaccagauucuugauggggagaacuguacacugaucgacgcccuccugggagauccccagugcgacggcuuucagaauaagaaaugggaucuguucgucgaacggucuaaggccuauagcaacuguuacccuuaugacgugcccgauuacgcuucccuccgcucucugguugccagcuccgggacccuugaguuuaauaacgagagcuucaauuggacgggagugacccaaaacggcacaucuuccgcuugcauuagacggagcaauaacagcuuuuucucccgccugaauuggcucacccaucugaacuuuaaauauccugcccuuaacgucacaaugcccaauaacgaacaguucgacaagcuguacaucuggggcgugcaccauccugggaccgauaaggaccagauuuuucucuaugcgcagagcucuggaagaaucacgguuuccacaaaacggagccaacaggccgugauuccgaauaucggcucccgccacagaauccggaacauucccucucgcaucagcauuuacuggaccaucgucaagccuggggauauucugcugaucaauuccacaggaaaccucaucgcucccagaggcuacuucaaaauucggagcgggaagucuuccaucaugcgcagcgacgccccuauuggaaaauguaagucugagugcaucacccccaauggcagcauuccgaacgacaagccuuuucagaaugugaacagaaucaccuauggcgcuuguccccgguacgugaaacaguccacacugaaacuugccacggggaugcgcaaugucccugaaaaacaaaccagaggaaucuucggcgcgauugccggguuuaucgagaacggaugggagggcaugguugaugggugguauggauuccggcaccaaaauucugaaggcagaggccaggcugccgaccugaagucuacacaggcugccauugaucagaucaacgggaaacucaaucgccugauuggaaagaccaacgagaaauuccaucagaucgaaaaggaguuuuccgaaguggagggccggauucaggaccuugagaaguacguggaagauacaaaaaucgaccuguggagcuauaacgccgagcuccuggucgcucuggaaaaucaacacaccaucgaucucacggacucugagaugaacaagcuguucgaaaagacaaagaaacagcuuagagagaaugcggaggauauggggaacggaugcuuuaagauuuaccauaagugugacaaugccugcaucggcuccauucgcaacgggaccuaugaucacgacguguaccgggacgaagcucugaauaacagauuccagaucaaaggcguugagcucaagagcggauacaaagauuggauucuguggaucucuuuugccaucuccugcuuccuucuguguguggcccuccugggcuuuauuaugugggcuugccagaaggggaauauccgcuguaacauuugcaucuga

SEQ ID NO: 195866 - RNA, 1701 nt, Artificial Sequence
  derived and/or modified sequence opt5 from hemagglutinin__InfluenzaA__AJJ98837
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccaccaagagaagccagcaggcugugaucccgaauauuggcucccggccccgcgucagaaacaucccuucucgggugagcaucuauuggacaauugugaaacccggggacauccugcugauuaauuccaccggaaaccucaucgccccucgcggcuacuucaagauuagaagcgggaaaucuuccaucaugcggagcgaugcucccaucggaaaguguaauucugccugcauuaccccgaacggcagcaucccuaaugacaagcccuuucagaacgucaaucgcauuacauacggcgcguguccuagauauguuaaacaauccacgcugaaacuugccaccgggaugcggaacgugcccgaaaaacagacacgcggaaucuucggcgcuauugccggguuuaucgagaauggaugggaaggcaugguggacgggugguacggauucagacaccagaacucugagggccggggccaagcugccgaucucaagagcacccaggccgcuaucgaccagauuaaugggaaacugaacagacugaucggaaagacaaacgagaaauuccaucagauugaaaaggaguuuuccgaagucgagggccgcauccaagaucuugaaaaguauguggaggacaccaaaauugaucuguggagcuacaaugcggagcuccugguugcccuggaaaaccagcacacgaucgaccucacagauucugagaugaauaagcuguucgaaaagaccaagaaacagcuucgggagaacgcugaagacauggggaauggaugcuuuaagauuuaucauaagugugauaacgccugcaucggcuccaucagaaaugggaccuacgaccacgauguguaucgcgacgaggcccugaacaaucgguuccagauuaaaggcgucgagcucaagagcggauacaaagacuggauccuguggauuucuuuugcuaucuccugcuuccuucuguguguggcccuccugggcuuuauuaugugggcgugccaaaaggggaacaucagauguaauaucugcauuuga

SEQ ID NO: 195867 - RNA, 1701 nt, Artificial Sequence
  derived and/or modified sequence opt5 from hemagglutinin__InfluenzaA__AJJ98849
augaagaccaucauugcccugagcuacauccucugccugguguucgcucaggagcuucccggcaacgacaauuccacagccacgcugugucucgggcaccaugcggucccuaacggaaccauuguuaaaacaaucaccaaugaucaaauugaagugacaaacgcuaccgagcuggugcagucuagcuccacaggcgaaaucugcaauucuccgcaccagauccuugacggggagaacuguacccugauugaugcccuccugggagacccccagugcgauggcuuucaaaauaagaaaugggaccuguucgucgaaagaagcaaggcccauuccaacuguuauccuuacgaugugcccgacuaugcuucucuccggagccugguugccuccagcgggacgcuugaguuuaauaacgagucuuucaauuggaccggagugacacagaacggcaccuccagcgcuugcauccgcagaucuaauaacuccuuuuucagccggcugaauuggcucacacaccugaacuuuaaauacccugcccuuaacgucaccaugcccaauaacgaacaguucgauaagcuguauauuuggggcgugcaucacccugggacggacaaggaucagaucuuucucuacgcgcaagccucuggacgcauuacaguuuccaccaaaagaagccagcaggcugugaucccgaauauuggcucccggcugcgcgucagaaacauccccucucgggugagcaucuauuggacaauugugaagccuggggacauccugcucauuaauuccaccggaaaccugaucgcuccccgcggcuacuucaaaauuagaagcgggaagucuuccaucaugcggagcgaugccccuaucggaaaauguaauucugccugcauuacccccaacggcagcaucccgaaugacaagccuuuucagaacgucaaucgcauuacauacggcgcgugucccagauauguuaagcaaaacacgcuuaaacuggccaccgggaugcggaaugugccugagaagcagacacgcggaaucuucggcgcuauugccggguuuaucgaaaacggaugggagggcaugguggacgggugguacggauucagacaccaaaauuccgagggccggggccaggcugccgaucucaaaucuacccaggccgcuaucgaccagauuaacgggaagcugaacagacuuaucggaaaaacaaaugaaaaguuccaucagauugagaaagaauuuagcgaggucgaaggccgcauccaagaucuggagaaguauguggaggacaccaagauugaucucugguccuacaacgcggaacugcugguugcccucgagaaucagcacacgaucgaccugacagauagcgaaaugaacaaacuuuucgagaagaccaaaaagcagcugcgggaaaaugcugaggacauggggaacggaugcuuuaaaauuuaucauaagugugauaaugccugcaucggcucuaucagaaacgggaccuacgaccacgauguguaucgcgacgaggcccucaauaaccgguuccagauuaagggcgucgaacugaaauccggauacaaggacuggauccuuuggauuagcuuugcuaucucuugcuuccugcucuguguggcccugcugggcuuuauuaugugggcgugccaaaaagggaauaucagauguaacaucugcauuuga

SEQ ID NO: 195868 - RNA, 1701 nt, Artificial Sequence
  derived and/or modified sequence opt5 from hemagglutinin__InfluenzaA__AJJ98861
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgagaucugcgacuccccgcaccagauucuugauggggaaaauuguacccugaucgacgcccuccugggagauccccagugcgacggcuuucaaaacaaaaagugggaucuguucgucgagagaucuaaagccuauagcaauuguuacccuuaugacgugcccgauuacgcuucccuccggucucugguugccagcuccgggacgcuugaauuuaacaaugagagcuucaacuggaccggagugacacagaauggcaccucuuccgcuugcauucgcagaagcaacaauuccuuuuucucucggcugaacuggcucacacaucugaaguuuaaguauccugcccuuaaugucaccaugcccaacaacgagcaguucgacaaacuguacaucuggggcgugcaccauccugggacggauaaugaccagauuuuucucuaugcgcaagccagcggacgcaucacaguuucuaccaagagaucccagcagacagugauuccgaacaucggcagccggccccgcgucagaaauaucccuucccggauuucuaucuacuggaccauugugaaacccggggauauccugcugauuaacagcaccggaaaucucaucgcuccucgcggcuacuucaagaucagauccgggaaaagcucuauuaugaaguccgacgcccccaucggaaaguguaacagcgaaugcauuacaccgaauggcucuaucccuaacgacaaacccuuucagaaugugaaccggauuacguauggcgcuuguccucgcuacgucaagcaaaauacccugaaacuugccacagggaugagaaacguucccgagaagcagacccggggaaucuucggcgcgaucgccggguuuauugaaaauggaugggagggcaugguggaugggugguauggauuccgccaccagaacagcgagggcagaggccaagcugccgaccugaaauccacacaggcugccaucgaucagauuaaugggaagcucaaccggcugaucggaaaaaccaacgaaaaguuccaccagauugagaaggaauuuucugagguggaaggcagaauccaagaccuugagaaauacgucgaggauacgaagauugaccuguggagcuauaaugccgaacuccugguggcucuggagaaccagcauacaaucgaucucaccgacuccgaaaugaauaaacuguucgagaagaccaaaaagcagcuucgcgaaaacgcggaggauauggggaauggaugcuuuaagaucuaccacaaaugugacaacgccugcauuggcagcauccggaaugggacauaugaucaugacguuuacagagacgaggcucugaacaaucgcuuccagauuaagggcguggaacucaaaucuggauacaaggauuggauccuguggauuuccuuugccaucagcugcuuccuucugugugucgcccuccugggcuuuaucaugugggcuugccaaaaagggaacauucgguguaauaucugcauuuga

SEQ ID NO: 195869 - RNA, 1701 nt, Artificial Sequence
  derived and/or modified sequence opt5 from hemagglutinin__InfluenzaA__AJJ98873
augaagaccaucauugcccugagcuacucccucugccugguguucgcucagaaacuucccggcaacgacaauucuacagccacgcugugucucgggcaccaugcggucccuaacggaaccaucguuaagacaauuaccaaugaucaaaucgaggugacaaacgcuaccgaacuggugcagagcuccucuacaggcgagauuugcgacagcccgcaccagauccuugauggggaaaauuguacccugaucgacgcccuccugggagauccccagugcgacggcuuucaaaacaaaaagugggaucuguucgucgagagauccaaagccuauucuaauuguuacccuuaugacgugcccgauuacgcuagccuccggucccugguugccagcucugggacgcuugaauuuaacaaugaguccuucaacuggaccggagugacacagaauggcaccagcucugcuugcauucgcaaguccaacaauagcuuuuucucuagacugaacuggcucacacaucugaaguuuaaauauccugcccuuaaugucaccaugcccaacaacgagcaguucgacaagcuguacaucuggggcgugcaccauccugggacggauaaugaccagauuuuucucuaugcgcaagccuccggacggaucacaguuagcaccaaacgcucccagcagacagugauuccgaacaucggcucuagaccccggguccgcaauauuccuagcagaaucuccaucuacuggaccauugugaagcccggggauauccugcugauuaacagcaccggaaaucucaucgcuccucggggcuacuucaaaauucgcucugggaaguccagcaucaugagaucugacgcccccaucggaaaguguaacagcgaaugcauuacaccgaauggcuccaucccuaacgacaaacccuuucagaaugugaaccggauuacguauggcgcuuguccucgcuacgucaagcaaaauacccugaaacuugccacagggaugagaaacguucccgagaagcagacccggggaaucuucggcgcgauugccggguuuaucgaaaauggaugggagggcaugguggaugggugguauggauuccgccaccagaacucugagggcagaggccaagcugccgaccugaaaagcacacaggcugccaucgaucagauuaaugggaagcucaaccggcugaucggaaaaaccaacgaaaaguuccaccagauugagaaggaauuuuccgagguggaaggcagaauccaagaccuugagaaauacgucgaggauacgaagauugaccuguggagcuauaaugccgaacuccugguggcucuggagaaccagcauacaaucgaucucaccgacucugaaaugaauaaacuguucgagaagaccaaaaagcagcuucgcgaaaacgcggaggauauggggaauggaugcuuuaagauuuaccacaaaugugacaacgccugcaucggcuccauccggaaugggacauaugaucaugacguuuacagagacgaggcucugaacaaucgcuuccagauuaagggcguggaacucaaaagcggauacaaggauuggauccuguggauuucuuuugccaucuccugcuuccuucugugugucgcccuccugggcuuuauuaugugggcuugccaaaaagggaacauccgguguaauaucugcauuuga

SEQ ID NO: 195870 - RNA, 1701 nt, Artificial Sequence
  derived and/or modified sequence opt5 from hemagglutinin__InfluenzaA__AJJ98885
augaagaccaucauugcccugagcaacauccucugccugguguucgcucagaaacuucccggcaaugacaacuccacagccacgcugugucucgggcaccaugcggucccuaauggaaccauuguuaagacaaucaccaacgaucaaauugaggugacaaaugcuaccgaacuggugcagucuagcuccacaggcgagaucugcgacucuccgcaccagauccuugauggggaaaacuguacccugauugacgcccuccugggagauccccagugcgacggcuuucaaaauaaaaagugggaucuguucgucgagagaagcaaagccuacuccaacuguuauccuuacgacgugcccgauuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaucugaaguuuaaguacccugcccuuaacgucaccaugcccaacaaagagaaguucgacaaacuguauauuuggggcgugcaccauccugggacggauaaugaccagaucuuucucuacgcgcaggccucuggacgcauuacaguuuccaccaagagaagccaacagacagugaucccgaacauuggcucccggccccgcgucagaaauaucccuucucggaucagcauuuauuggaccaucgugaaacccggggauauucugcugaucaacuccaccggaaaucucauugcuccucgcggcuacuucaagaucagaagcgggaagucuuccaucaugcggagcgacgcccccauuggaaaauguaacucugaaugcaucacaccgaauggcagcauuccuaacgacaagcccuuucagaaugugaaccgcaucacguacggcgcuuguccuagauaugucaaacagaauacccugaaacuugccacagggaugcggaacguucccgagaagcaaacccgcggaauuuucggcgcgaucgccggguuuaucgaaaauggaugggagggcaugguggaugggugguacggauucagacaccagaacuccgagggcauuggccaggcugccgaccugaagucuacacaagcugccaucgaucagauuaaugggaaacucaaccggcugaucggaaagaccaacgaaaaguuccaccagauugagaaagaauuuagcgagguggaaggcagaauccaggaccuugagaaguaugucgaggauacgaaaauugaccugugguccuacaaugccgaacuccugguggcucuggagaaccaacauacaaucgaucucaccgacagcgaaaugaauaagcuguucgagaaaaccaagaagcagcuucgcgaaaacgcggaggauauggggaauggaugcuuuaaaaucuaucacaagugugacaacgccugcauuggcucuauccggaaugggacauacgaucaugacguuuauagagacgaggcucugaacaaucgcuuccagauuaaaggcguggaacucaaguccggauacaaagauuggauccuguggauuagcuuugccaucucuugcuuccuucugugugucgcccuccugggcuuuaucaugugggcuugccagaaggggaacauucgguguaauaucugcauuuga

SEQ ID NO: 195871 - RNA, 1701 nt, Artificial Sequence
  derived and/or modified sequence opt5 from hemagglutinin__InfluenzaA__AJJ98897
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacuccagcuuuuucucucggcugaauuggcucacacaucugaaguuuaaguauccugcccuuaacgucaccaugcccaauaacgagaaauucgacaagcuguacauuuggggcgugcaccauccugggacggauaacgaccagaucuuucucuaugcgcaggccuccggacgcauuacaguuagcaccaaaagaucccaacagacagugaucccgaauauuggcucucggccccgcgucagaaacaucccuagccggaucuccauuuacuggaccaucgugaagcccggggauauucugcugaucaauagcaccggaaaccucauugcuccucgcggcuacuucaaaaucagaucugggaaguccagcaucaugcggucugacgcccccauuggaaaguguaauagcgaaugcaucacaccgaacggcuccauuccuaaugacaaacccuuucagaacgugaaucgcaucacguauggcgcuuguccuagauacgucaagcagaacacccugaaacuugccacagggaugcggaauguucccgagaagcaaacccgcggaauuuucggcgcgaucgccggguuuaucgaaaacggaugggagggcaugguggaugggugguauggauucagacaccaaaauucugagggcauuggccaggcugccgaccugaaaagcacacaggcugccaucgaucagauuaacgggaagcucaaucggcugaucggaaaaaccaacgaaaaguuccaccagauugagaaggaauuuuccgagguggaaggcagaauccaggaccuugagaaauacgucgaggauacgaagguggaccuguggagcuauaacgccgaacuccugguugcucuggagaaucaacauacaauugaucucaccgacucugaaaugaacaaacuguucgagaagaccaaaaagcagcuucgcgaaaaugcggaggauauggggaacggaugcuuuaagaucuaccacaaaugugacaaugccugcaucggcuccauucggaacgggacauaugaucaugacguguacagagacgaggcucugaauaaccgcuuccagaucaagggcgucgaacucaaaagcggauacaaggauuggauucuguggaucucuuuugccauuuccugcuuccuucuguguguggcccuccugggcuuuaucaugugggcuugccagaaagggaauauccgguguaacauuugcaucuga

SEQ ID NO: 195872 - RNA, 1701 nt, Artificial Sequence; identical to SEQ ID NO: 194794
  derived and/or modified sequence opt5 from hemagglutinin__InfluenzaA__AJJ98909

SEQ ID NO: 195873 - RNA, 1701 nt, Artificial Sequence
  derived and/or modified sequence opt5 from hemagglutinin__InfluenzaA__AJJ98921
augaagaccaucauugcccugagcuacauccucugccugguguucgcucagaaacuucccggcaaggacaacuccacagccacgcugugucucgggcaccaugcggucccuaauggaaccauuguuaaaacaaucaccaacgaucaaauugaggugacaaaugcuaccgaacuggugcagucuagcuccacaggcgagaucugcaacucuccgcaccagauccuugacggggaaaauuguacccugauugaugcccuccugggagacccccagugcgauggcuuucaaaacaagaaaugggaccuguucgucgagagaagcaaggccuauuccaauuguuacccuuaugaugugcccgacuacgcuucucuccggagccugguugccuccagcgggacgcuugaauuuaacaaugagucuuucaacuggaccggagugaagcagaauggcacauccagcgcuugcauccgcagaucuaacuccagcuuuuucucucggcugaauuggcucacccaucugaacuuuaaauauccugcccuuaaugucacaaugcccaacaacgagcaguucgauaagcuguacauuuggggcgugcaccauccugggaccgacaaagaucagaucuuucucuaugcgcaauccagcggacgcauuacgguuuccacaaagagaucucagcaggccgugaucccgaauauuggcagccggccccgcaucagaaacaucccuucccggauuagcaucuacuggaccauugucaaacccggggacauccugcugauuaauucuacaggaaaccucaucgcuccucgcggcuacuucaagaucagauccggaaagagcucuauuaugcggagcgaugcccccaucgggaaauguaauuccgaaugcauuaccccgaacggcucuaucccuaaugacaagcccuuucagaacgugaaucgcauuaccuauggcgcuuguccuagauacgugaaacaaagcacacugaagcuggccacggggaugcggaacguccccgagaaacagacccgcggaaucuucggcgcgaucgccggguuuauugaaaauggaugggagggcaugguugacgggugguauggauucagacaccagaacuccgagggccggggccaagcugccgaucuuaagagcacacaggcugccaucgaccagauuaaugggaaacucaacagacugaucggaaagaccaaugaaaaguuccaccagauugagaaagaauuuucugagguggaaggccgcauccaagaucuugagaaguacguggaggacacaaaaauugaucugugguccuauaacgccgaacuccuggucgcucuggagaaccagcauaccaucgaccucacggauagcgaaaugaauaagcuguucgagaaaacaaagaagcagcuucgggaaaacgcggaggacauggggaauggaugcuuuaaaaucuaccacaagugugauaacgccugcauuggcucuaucagaaaugggaccuauaaccaugacguguaccgcgaugaggcucugaauaaccgguuccagauuaaaggcguugaacucaaguccggauacaaagacuggauccuguggauuagcuuugccaucuccugcuuccuucuguguguggcccuccugggcuuuaucaugugggcuugccaaaaggggaauauuagauguaacaucugcauuuga

SEQ ID NO: 195874 - RNA, 1701 nt, Artificial Sequence; identical to SEQ ID NO: 192477
  derived and/or modified sequence opt5 from hemagglutinin__InfluenzaA__AJJ98933

SEQ ID NO: 195875 - RNA, 1701 nt, Artificial Sequence; identical to SEQ ID NO: 190006
  derived and/or modified sequence opt5 from hemagglutinin__InfluenzaA__AJJ98945

SEQ ID NO: 195876 - RNA, 1701 nt, Artificial Sequence
  derived and/or modified sequence opt5 from hemagglutinin__InfluenzaA__AJJ98957
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacauucuaaguuuaaguauccugcccugaaugucaccaugcccaacaacgagcaguucgacaaacuuuacauuuggggcgugcaccauccugggacggauaaugaccagaucuuucuguaugcgcaagccuccggacgcauuacaguuagcaccaagagaucccagcagacagugaucccgaacauuggcucucggccccgcgucagaaauaucccuagccggaucuccauuuacuggaccaucgugaaacccggggauauucuccugaucaacagcaccggaaaucugauugcuccucgcggcuacuucaagaucagaucugggaaauccagcaucaugcggucugacgcccccauuggaaaguguaacagcgaaugcaucacaccgaauggcuccauuccuaacgacaagcccuuucagaaugugaaccgcaucacguauggcgcuuguccuagauacgucaaacaaaauacccucaagcuggccacagggaugcggaacguucccgagaaacagacccgcggaauuuucggcgcgaucgccggguuuaucgaaaauggaugggagggcaugguggaugggugguauggauucagacaccagaacucugagggccggggccaagcugccgaccuuaagagcacacaggcugccauugaucagaucaaugggaaacugaacagacucauuggaaagaccaacgaaaaauuccaccagaucgagaaggaauuuuccgagguggaaggccgcauucaagaccuggagaaguacgucgaggauacgaaaaucgaccuuuggagcuauaaugccgaacugcucguggcucuggagaaccagcauacaauugaucugaccgacucugaaaugaauaagcuguucgagaaaaccaagaaacagcugcgggaaaacgcggaggauauggggaauggaugcuuuaagaucuaccacaagugugacaacgccugcaucggcuccauuagaaaugggacauaugaucaugacguuuaccgcgacgaggcucuuaacaaucgguuccagaucaaaggcguggaacucaagagcggauacaaagauuggauucucuggaucucuuuugccauuuccugcuuccugcuuugugucgcccugcucggcuuuaucaugugggcuugccaaaaggggaacaucagauguaauauuugcaucuga

SEQ ID NO: 195877 - RNA, 1701 nt, Artificial Sequence; identical to SEQ ID NO: 185458
  derived and/or modified sequence opt5 from hemagglutinin__InfluenzaA__AJJ98969

SEQ ID NO: 195878 - RNA, 1701 nt, Artificial Sequence
  derived and/or modified sequence opt5 from hemagglutinin__InfluenzaA__AJJ98981
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccauauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccagaacggcacaucuuccgcuugcauuagacggagcaauucuuccuuuuucagccgccugaacuggcucacccaccugaauuuuaaguauccugcccuuaacgucacaaugcccaacaaugagcaauucgacaagcuguacaucuggggcgugcaucacccugggaccgauaaagaccagauuuuucucuaugcgcagucuuccggaagaaucacgguuagcacaaagcggucccagcaagccgugauuccgaacaucggcucucgccccagaauccggaaugucccuagccgcauuuccaucuacuggaccauugugaaacccggggauauccugcugauuaacagcacaggaaaucucaucgcuccuagaggcuacuucaagauccggucugggaaauccagcauuaugcgcucugacgcccccaucggaaaguguaagagcgaaugcauuaccccgaacggcuccaucccuaaugacaaacccuuucagaacgugaauagaauuaccuauggcgcuuguccucgguacgucaagcagucuacacugaaacuugccacggggaugcgcaacguucccgagaagcagaccagaggaaucuucggcgcgaucgccggguuuauugaaaauggaugggagggcaugguggaugggugguauggauuccggcaccaaaacagcgagggcagaggccaggcugccgaccugaaauccacacaggcugccaucgaucaaauuaaugggaagcucaaccgccugaucggaaaaaccaaugaaaaguuccaucagauugagaaggaauuuagcgagguggaaggccggauccaggaccuugagaaauacgucgaggauacaaagauugaccuguggucuuauaacgccgaacuccugguggcucuggagaaccagcacaccaucgaucucacggacuccgaaaugaauaaacuguucgagaagaccaaaaagcaacuuagagaaaacgcggaggauauggggaauggaugcuuuaagaucuaccauaaaugugacaacgccugcauuggcagcauccgcaaugggacauaugaucacaacguuuaccgggacgaggcucugaauaacagauuccagauuaagggcguggaacucaaaucuggauacaaggacuggauccuguggauuuccuuugccaucagcugcuuccuucugugugucgcccuccugggcuuuaucaugugggcuugccagaaagggaauauucgcuguaacaucugcauuuga

SEQ ID NO: 195879 - RNA, 1701 nt, Artificial Sequence
  derived and/or modified sequence opt5 from hemagglutinin__InfluenzaA__AJJ98993
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcaucggcgagaucugcgacaacccgcaccagauucuugauggggaaaauuguacacugaucgacgcccuccugggagauccccagugcgacggcuuucagaacaaaaagugggaucuguucgucgagagauccaaagccuauucuaauuguuacccuuaugacgugcccgauuacgcuagccuccggucccugguugccucuagcgggacccuugaauuuaacaaugaguccuucaacuggacgggagugacccagaauggcacaagcucugcuugcaugcgcagauccaacagcuccuuuuucucucggcugaauuggcucacccaucugaacuuuaaguauccugcccuuaacgucacaaugcccaauaacgagcaguucgacaagcuguacauuuggggcgugcaccauccugggaccgauaaagaccagaucuuucucuaugcgcaaagcucuggacgcauuacgguuuccacaaagagaagccagcaggccgugaucccgaauauuggcucccggccccgcaucagaaacaucccuucucggauuagcaucuacuggaccauugucaaacccggggauauccugcugauuaauuccacaggaaaccucaucgcuccucgcggcuacuucaagaucagaagcgggaaaucuuccauuaugcggagcgacgcccccaucggaaaguguaauucugaaugcauuaccccgaacggcagcaucccuaaugacaagcccuuucagaacgugaaucgcauuaccuauggcgcuuguccuagauacgugaaacaauccacacugaagcuggccacggggaugcggaacguccccgagaaacagacccgcggaaucuucggcgcgaucgccggguuuauugaaaauggaugggagggcaugguugaugggugguauggauucagacaccagaacucugagggccggggccaagcugccgaccuuaagagcacacaggcugccaucgaucagauuaaugggaaacucaacagacugaucggaaagaccaacgaaaaauuccaccagauugagaaggaauuuuccgagguggaaggccgcauccaagaccuugagaaguacguggaggauacaaaaauugaccuguggagcuauaaugccgaacuccuggucgcucuggagaaccagcauaccaucgaucucacggacucugaaaugaauaagcuguucgagaaaacaaagaaacagcuucgggaaaacgcggaggauauggggaauggaugcuuuaagaucuaccacaagugugacaacgccugcauuggcuccaucagaaaugggaccuaugaucaugacguguaccgcgacgaggcucugaacaaucgguuccagauuaaaggcguugaacucaagagcggauacaaagauuggauccuguggauuucuuuugccaucuccugcuuccuucuguguguggcccuccugggcuuuaucaugugggcuugccaaaaggggaacauuagauguaauaucugcauuuga

SEQ ID NO: 195880 - RNA, 1701 nt, Artificial Sequence
  derived and/or modified sequence opt5 from hemagglutinin__InfluenzaA__AJJ99005
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaucggagugacccagaacggcacauccagcgcuugcauucgcagaucuaauaacuccuuuuucagccggcugaauuggcucacccaccugaacuuuaaguacccugcccuuaacgucacaaugcccaauaacgagcaguucgauaagcuguauaucuggggcgugcaucacccugggaccgacaaagaucagauuuuucucuacgcgcaagccucuggacgcaucacgguuuccacaaagagaagccagcaggcugugauuccgaauaucggcucccggccccgcgucagaaacaucccuucucgggugagcauuuauuggaccaucgugaaacccggggacauucugcugaucaauuccacaggaaaccucauugccccucgcggcuacuucaagaucagaagcgggaaaucuuccaucaugcggagcgaugcucccauuggaaaguguaauucugccugcaucaccccgaacggcagcauuccuaaugacaagcccuuucagaacgucaaucgcaucaccuacggcgcguguccuagauauguuaaacaaaacacacugaaacuugccacggggaugcggaaugugcccgaaaaacagacccgcggaauuuucggcgcuaucgccggguuuaucgagaacggaugggaaggcaugguggacgggugguacggauucagacaccaaaauuccgagggccggggccaggcugccgaucugaagucuacacaggccgcuauugaccagaucaacgggaaacucaacagacugauuggaaagaccaaugagaaauuccaucagaucgaaaaggaguuuagcgaagucgagggccgcauucaagaucuugaaaaguauguggaggacacaaaaaucgaucugugguccuacaacgcggagcuccugguugcccuggaaaaucagcacaccauugaccucacggauagcgagaugaacaagcuguucgaaaagacaaagaaacagcuucgggagaaugcugaagacauggggaacggaugcuuuaagaucuaucauaagugugauaaugccugcaucggcucuauuagaaacgggaccuacgaccacgauguguaucgcgacgaggcccugaauaaccgguuccagaucaaaggcgucgagcucaaguccggauacaaagacuggauucuguggaucagcuuugcuauuucuugcuuccuucuguguguggcccuccugggcuuuaucaugugggcgugccaaaaggggaauaucagauguaacauuugcaucuga

SEQ ID NO: 195881 - RNA, 1701 nt, Artificial Sequence; identical to SEQ ID NO: 186435
  derived and/or modified sequence opt5 from hemagglutinin__InfluenzaA__AJJ99017

SEQ ID NO: 195882 - RNA, 1701 nt, Artificial Sequence
  derived and/or modified sequence opt5 from hemagglutinin__InfluenzaA__AJJ99029
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucaucgagagaagcaaagccuauuccaauuguuacccuuaugacguccccgauuacgcuucucuccggagccugguggccuccagcgggacgcuugaauuuaacaaugagucuuucaacuggaccggaguuacacagaauggcaccuccagcucuugcauucgcagauccaacaauagcuuuuucucucggcugaacuggcucacacaucugaaguuuaaguauccugcucuuaaugugaccaugcccaacaacgagcaguucgacaaacuguacaucuggggcguccaccauccugggacggauaaugaccagauuuuucucuaugcccaagcguccggacgcaucacagugagcaccaagagaucccagcagacaguuauuccgaacaucggcucucggccccgcgugagaaauaucccuagccggauuuccaucuacuggaccauugucaaacccggggauauccugcugauuaacagcaccggaaaucucaucgccccucgcggcuacuucaagaucagaucugggaaauccagcauuaugcggucugacgcucccaucggaaaguguaacagcgaaugcauuacaccgaauggcuccaucccuaacgacaagcccuuucagaaugugaaccgcauuacguauggcgccuguccuagauacgugaaacaaaauacccugaagcuggcuacagggaugcggaacguccccgagaaacagacccgcggaaucuucggcgccaucgcgggguuuauugaaaauggaugggagggcaugguugaugggugguauggauucagacaccagaacucugagggccggggccaagccgcugaccuuaagagcacacaggccgcuaucgaucagauuaaugggaaacucaacagacugaucggaaagaccaacgaaaaauuccaccagauugagaaggaauuuuccgagguggaaggccgcauccaagaccuugagaaguacguggaggauacgaaaauugaccuguggagcuauaaugccgaacuccuggucgcccuggagaaccagcauacaaucgaucucaccgacucugaaaugaauaagcuguucgagaaaaccaagaaacagcuucgggaaaacgcugaggauauggggaauggaugcuuuaagaucuaccacaagugugacaacgcgugcauuggcuccaucagaaaugggacauaugaucauaacguguaccgcgacgaggcccugaauaaccgguuccagauuaaaggcguugaacucaagagcggauacaaagacuggauccuguggauuucuuuugcuaucuccugcuuccuucuguguguggcccuccugggcuuuaucaugugggccugccaaaaggggaauauuagauguaacaucugcauuuga

SEQ ID NO: 195883 - RNA, 1701 nt, Artificial Sequence
  derived and/or modified sequence opt5 from hemagglutinin__InfluenzaA__AJJ99041
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcaagcgcggcucugacaacuccuuuuucagcagacugaauuggcucacacaucugaaguuuaaauauccugcccuuaacgucaccaugcccaauaacgagaaguucgauaaacuguacaucuggggagugcaccauccugggacggacaacgaucagauuuuuccguaugcgcaggccucuggccggaucacaguuuccaccaagcgcagccaacagacagugauucccaauaucggguccagaccucggguccgcaacauucccucuagaaucagcaucuacuggaccauugugaaaccuggagacauccuccugauuaauuccaccggcaaccugaucgcuccccggggguacuucaagauucgcagcggaaagucuuccaucaugagaagcgacgccccgaucggcaaauguaauucuggcugcauuacaccuaacgggagcauccccaaugauaagccuuuucagaacgugaaucggauuacguauggagcuuguccccgcuacgucaaacaguccacccucaagcuggccacaggcaugagaaacguucccgaaaaacaaacccgggggaucuucggagcgauugccggcuuuaucgagaaugggugggaaggaaugguggacggcugguauggcuuccgccaccagaacucugaggggaucggacaggcugccgaucuuaagagcacacaagcugccauuaaucagaucaacggcaaacugaauagacucauugggaagaccaacgagaaguuccaccagaucgaaaaagaguuuuccgaaguggagggacggauucaggaccuggaaaaguacgucgaggauacgaaaaucgaccuuuggagcuauaacgccgagcugcucguggcucuggaaaaucaacauacaauugaucugaccgacucugagaugaacaaacucuucgaaagaaccaagaagcagcugcgcgagaaugcggaagauaugggcaacgggugcuuuaagaucuaccacaaaugugacaaugccugcaucggcuccauucggaacggaacauaugaucaugacguuuacagagacgaggcucuuaauaaccgcuuccagaucaagggcguggagcugaaaagcggguacaaggauuggauucucuggaucucuuuugccauuuccugcuuccugcuuugugucgcccugcucggauuuaucaugugggcuugccagaaaggcaauauccgguguaacauuugcaucuga

SEQ ID NO: 195884 - RNA, 1701 nt, Artificial Sequence; identical to SEQ ID NO: 192882
  derived and/or modified sequence opt5 from hemagglutinin__InfluenzaA__AJJ99053

SEQ ID NO: 195885 - RNA, 1701 nt, Artificial Sequence; identical to SEQ ID NO: 192882
  derived and/or modified sequence opt5 from hemagglutinin__InfluenzaA__AJJ99065

SEQ ID NO: 195886 - RNA, 1701 nt, Artificial Sequence
  derived and/or modified sequence opt5 from hemagglutinin__InfluenzaA__AJJ99089
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggaacaaagccuauucuaauuguuacccuuaugacgugcccgauuacgcuagccuccgcucccugguugccucuagcgggacccuugaauuuaacaaugaguccuucaacuggacgggagugacccaaaauggcacaagcucugcuugcauuagacgguccaacagcuccuuuuucucucgccugaauuggcucacccaucugaacuuuaaguauccugcccuuaacgucacaaugcccaauaacgagcaguucgacaagcuguacaucuggggcgugcaccauccugggaccgauaaagaccagauuuuucucuaugcgcagagcucuggaagaaucacgguuuccacaaagcggagccaacaggccgugauuccgaauaucggcucccgccccagaauccggaacauuccuucucgcaucagcauuuacuggaccaucgucaaacccggggauauucugcugaucaauuccacaggaaaccucaucgcuccuagaggcuacuucaagauucggagcgggaaaucuuccaucaugcgcagcgacgcccccauuggaaaguguaagucugaaugcaucaccccgaauggcagcauuccuaacgacaaacccuuucagaaugugaacagaaucaccuauggcgcuuguccucgguacgugaagcaguccacacugaaacuugccacggggaugcgcaauguccccgagaagcaaaccagaggaaucuucggcgcgauugccggguuuaucgaaaacggaugggagggcaugguugaugggugguauggauuccggcaccaaaauucugagggcagaggccaggcugccgaccugaaaagcacacaggcugccauugaucagaucaacgggaagcucaaucgccugauuggaaaaaccaacgaaaaguuccaccagaucgagaaggaauuuuccgagguggaaggccggauucaggaccuugagaaauacguggaggauacaaagaucgaccuguggagcuauaacgccgaacuccuggucgcucuggagaaucaacauaccaucgaucucacggacucugaaaugaacaaacuguucgagaagaccaaaaagcagcuuagagaaaaugcggaggauauggggaacggaugcuuuaagauuuaccacaaaugugacaaugccugcaucggcuccauucgcaacgggacauaugaucaugacguguaccgggacgaggcucugaauaacagauuccagaucaagggcguugaacucaaaagcggauacaaggauuggauucuguggaucucuuuugccaucuccugcuuccuucuguguguggcccuccugggcuuuauuaugugggcuugccagaaagggaauauccgcuguaacauuugcaucuga

SEQ ID NO: 195887 - RNA, 1701 nt, Artificial Sequence; identical to SEQ ID NO: 192572
  derived and/or modified sequence opt5 from hemagglutinin__InfluenzaA__AJJ99101

SEQ ID NO: 195888 - RNA, 1701 nt, Artificial Sequence; identical to SEQ ID NO: 192477
  derived and/or modified sequence opt5 from hemagglutinin__InfluenzaA__AJJ99113

SEQ ID NO: 195889 - RNA, 1701 nt, Artificial Sequence
  derived and/or modified sequence opt5 from hemagglutinin__InfluenzaA__AJJ99125
augaagaccaucauugcccugagcuacauccucugcaugguguucgcucagaaacugcccggcaacgacaauuccacagccacgcuuugucuggggcaccaugcggucccuaacggaaccauuguuaagacaaucaccaaugaucaaauugaggugacaaacgcuaccgaacucgugcagucuagcuccacaggcgagaucugcaauucuccgcaccagauccuggacggggaaaacuguacccuuauugaugcccugcucggagacccccagugcgauggcuuucaaaauaaaaagugggaccuguucgucgagagaagcaaagcccauuccaacuguuauccuuacgaugugcccgacuaugcuucucugcggagccucguugccuccagcgggacgcuggaauuuaauaacgagucuuucaauuggaccggagugacacagaacggcaccuccagcgcuugcauccgcagaucuuccaauagcuuuuucucucggcuuaacuggcugacacaccucaauuuuaaguacccugcccugaacgucaccaugcccaacaaugagcaguucgauaagcuguauauuuggggcgugcaucacccugggacggacaaagaucagaucuuucuguacgcgcaagccuccggacgcauuacaguuagcaccaagagaucccagcaggcugugaucccgaacauuggcucucggccccgcgucagaaauaucccuagccggguguccaucuauuggacaauugugaaacccggggacauccuccugauuaacagcaccggaaaucugaucgccccucgcggcuacuucaagauuagaucugggaaauccagcaucaugcggucugaugcucccaucggaaaguguaacagcgccugcauuaccccgaauggcuccaucccuaacgacaagcccuuucagaaugucaaccgcauuacauacggcgcguguccuagauauguuaaacaaaauacgcucaagcuggccaccgggaugcggaacgugcccgaaaaacagacacgcggaaucuucggcgcuauugccggguuuaucgagaauggaugggaaggcaugguggacgggugguacggauucagacaccagaacucugagggccggggccaagcugccgaucuuaagagcacccaggccgcuaucgaccagauuaaugggaaacugaacagacucaucggaaagacaaacgagaaauuccaucagauugaaaaggaguuuuccgaagucgagggccgcauccaagaucuggaaaaguauguggaggacaccaaaauugaucuuuggagcuacaaugcggagcugcucguugcccuggaaaaccagcacacgaucgaccugacagauucugagaugaauaaacucuucgaaaagaccaagaaacagcugcgggagaacgcugaagacauggggaauggaugcuuuaagauuuaucauaagugugauaacgccugcaucggcuccaucagaaaugggaccuacgaccacgauguguaucgcgacgaggcccuuaacaaucgguuccagauuaaaggcgucgagcuuaagagcggauacaaagacuggauccucuggauuucuuuugcuaucuccugcuuccugcuuuguguggcccugcucggcuuuauuaugugggcgugccaaaaggggaacaucagauguaauaucugcauuuga

SEQ ID NO: 195890 - RNA, 1701 nt, Artificial Sequence
  derived and/or modified sequence opt5 from hemagglutinin__InfluenzaA__AJJ99137
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccaccaagagaagccagcaggcugugaucccgaauauuggcucccggccccgcgucagaaacaucccuucucgggugagcaucuauuggacaauugugaaacccggggacauccugcugauuaauuccaccggaaaccucaucgccccucgcggcuacuucaagauuagaagcgggaaaucuuccaucaugcggagcgaugcucccaucggaaaguguaauucugccugcauuaccccgaacggcagcaucccuaaugacaagcccuuucagaacgucaaucgcauuacauacggcgcguguccuagauauguuaaacaaaacacgcugaaacuugccaccgggaugcggaaugugcccgaaaaacagacacgcggaaucuucggcgcuauugccggguuuaucgagaacggaugggaaggcaugguggacgggugguacggauucagacaccaaaauuccgagggccggggccaggcugccgaucugaagucuacccaggccgcuaucgaccagauuaacgggaaacucaacagacugaucggaaagacaaaugagaaauuccaucagauugaaaaggaguuuagcgaagucgagggccgcauccaagaucuugaaaaguauguggaggacaccaaaauugaucugugguccuacaacgcggagcuccugguugcccuggaaaaucagcacacgaucgaccucacagauagcgagaugaacaagcuguucgaaaagaccaagaaacagcuucgggagaaugcugaagacauggggaacggaugcuuuaagauuuaucauaagugugauaaugccugcaucgugucuaucagaaacggcaccuacgaccacgaugucuaucgcgacgaggcccugaauaaccgguuccagauuaaagggguggagcucaaguccggcuacaaagacuggauccuguggauuagcuuugcuaucucuugcuuccuucuguguguugcccuccugggauuuauuaugugggcgugccaaaagggcaauaucagauguaacaucugcauuuga

SEQ ID NO: 195891 - RNA, 1701 nt, Artificial Sequence
  derived and/or modified sequence opt5 from hemagglutinin__InfluenzaA__AJJ99149
augaagaccaucauugcccugagcuacauccucugccugguguucgcucagaaauuucccggcaacgacaauuccacagccacgcuuugucuggggcaccaugcggucccuaacggaaccauuguuaagacaaucaccaaugaucaaauugaggugacaaacgcuaccgaacucgugcagucuagcuccacaggcgagaucugcgacucuccgcaccagauccuggaugggaaaaauuguacccuuauugacgcccugcucggagauccccagugcgacggcuuccaaaacaagaaaugggaucuguuugucgaaagaagcaaggccuauuccaauuguuacccuuaugacaugcccgauuacgcuucucugcggagccucguggccuccagcgggacgcuggaguucaacaaugaaucuuuuaacuggaccggaguuacacagaauggcaccuccagcgcuugcauccgcagaucuaacuccagcuucuuuucucggcuuaauuggcugacacaucucaacuucaaguaucaggcccugaaugugaccaugccuaacaacgagcaguuugacaaacuuuacauuuggggcguccaccaucccgggacggauaaggaccaaaucuuccuguaugcgcaggccuccggacgcauuacagugagcaccaaaagaucccagcagacaguuaucccuaauauuggcucucggccgcgcgugagaaacauccccagccggaucuccauuuacuggaccaucgucaagccuggggauauucuccugaucaauagcaccggaaaccugauugcuccccgcggcuacuuuaaaauccaaucugggaaguccagcaucaugagaucugacgccccuauuggaaaguguaauagcgagugcaucacacccaacggcuccauuccgaaugacaaaccuuuccagaacgugaaucggaucacguauggcgcuuguccccgcuacgugaagcagaacacccucaaacuggccacagggaugagaaaugucccugaaaagcaaacccggggaauuuuuggcgcgaucgccggguucaucgagaacggaugggaaggcaugguugaugggugguauggauuccgccaccaaaauucugagggcagaggccaggcugccgaccuuaaaagcacacaggcugccauugaucagaucaacgggaagcugaaucggcucauuggaaaaaccaacgagaaguuucaccagaucgaaaaggaguucuccgaaguggagggccgcauucaggaccuggaaaaauacguggaggauacgaagaucgaccuuuggagcuauaacgccgagcugcucgucgcucuggaaaaucagcauacaauugaucugaccgacucugagaugaacaaacucuuugaaaagaccaaaaagcaacugagagagaaugcggaagauauggggaacggaugcuucaagaucuaccacaaaugugacaaugccugcaucggcuccauucggaacgggacauaugaucaugacguguacagagacgaggcucuuaauaaccgcuuucagaucaagggcguugagcugaaaagcggauacaaggauuggauucucuggaucucuuucgccauuuccugcuuucugcuuuguguggcccugcucggcuucaucaugugggcuugccagaaagggaauauccgguguaacauuugcaucuga

SEQ ID NO: 195892 - RNA, 1701 nt, Artificial Sequence
  derived and/or modified sequence opt5 from hemagglutinin__InfluenzaA__AJJ99161
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggccccgcgucagagauaucccuucucggaucagcauuuacuggaccaucgugaaacccggggacauucugcugaucaauuccaccggaaaccucauugcuccucgcggcuacuucaagaucagaagcgggaaaucuuccaucaugcggagcgacgcccccauuggaaaguguaauucugaaugcaucacaccgaacggcagcauuccuaaugauaagcccuuucagaacgugaaucgcaucacguauggcgcuuguccuagauacgucaaacaaaacacccugaaacuugccacagggaugcggaauguucccgagaagcagacccgcggaauuuucggcgcgaucgccggguuuaucgaaaacggaugggagggcaugguggacgggugguauggauucagacaccaaaauuccgagggccggggccaggcugccgaucugaagucuacacaggcugccauugaccagaucaacgggaaacucaauagacugauuggaaagaccaacgaaaaauuccaccagaucgagaaggaauuuagcgagguggaaggccgcauucaagaucuugagaaguacgucgaggacacgaaaaucgaucugugguccuauaacgccgaacuccugguggcucuggagaaucagcauacaauugaccucaccgauagcgaaaugaacaagcuguucgagaaaaccaagaaacagcuucgggaaaaugcggaggacauggggaacggaugcuuuaagaucuaccacaagugugauaaugccugcaucggcucuauuagaaacgggacauaugaccaugacguuuaccgcgaugaggcucugaauaaccgguuccagaucaaaggcguggaacucaaguccggauacaaagacuggauucuguggaucagcuuugccauuucuugcuuccuucugugugucgcccuccugggcuuuaucaugugggcuugccaaaaggggaauaucagauguaacauuugcaucuga

SEQ ID NO: 195893 - RNA, 1701 nt, Artificial Sequence
  derived and/or modified sequence opt5 from hemagglutinin__InfluenzaA__AJJ99173
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagccuauuccaacuguuacccuuaugaugugcccgacuacgcuucucuccggagccugguugccuccagcgggacgcuugaauuuaauaacgagucuuucaauuggaccggagugacacagaacggcaccuccagcgcuugcauccgcagaucuaauuccagcuuuuucucucggcugaacuggcucacacaucugaaguuuaaguauccugcccuuaaugucaccaugcccaacaacgagcaguucgauaaacuguacauuuggggcgugcaccauccugggacggacaaugaucagaucuuucucuaugcgcaagccuccggacgcauuacaguuagcaccaagagaucccagcagacagugaucccgaacauuggcucucggccccgcgucagaaauaucccuagccggaucuccauuuacuggaccaucgugaaacccggggacauucugcugaucaacagcaccggaaaucucauugcuccucgcggcuacuucaagaucagaucugggaaauccagcaucaugcggucugaugcccccauuggaaaguguaacagcgaaugcaucacaccgaauggcuccauuccuaacgacaagcccuuucagaaugugaaccgcaucacguauggcgcuuguccuagauacgucaaacaaaauacccugaagcuggccacagggaugcggaacguucccgagaaacagacccgcggaauuuucggcgcgaucgccggguuuaucgaaaauggaugggagggcaugguggacgggugguauggauucagacaccagaacucugagggccggggccaagcugccgaucuuaagagcacacaggcugccauugaccagaucaaugggaaacucaacagacugauuggaaagaccaacgaaaaauuccaccagaucgagaaggaauuuuccgagguggaaggccgcauucaagaucuugagaaguacgucgaggacacgaaaaucgaucuguggagcuauaaugccgaacuccugguggcucuggagaaccagcauacaauugaccucaccgauucugaaaugaauaagcuguucgagaaaaccaagaaacagcuucgggaaaacgcggaggacauggggaauggaugcuuuagaaucuaccacaagugugauaacgccugcaucggcuccauucgcaaugggacauaugaccaugauguuuaccgggacgaggcucugaacaauagauuccagaucaagggcguggaacucaaaagcggauacaaggacuggauucuguggaucucuuuugccauuuccugcuuccuucugugugucgcccuccugggcuuuaucaugugggcuugccaaaaagggaacauccgcuguaauauuugcaucuga

SEQ ID NO: 195894 - RNA, 1701 nt, Artificial Sequence
  derived and/or modified sequence opt5 from hemagglutinin__InfluenzaA__AJJ99185
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcaagucuaacaauuccuuuuucagcagacugaacuggcucacacaucugaaguuuaaauauccugcccuuaaugucaccaugcccaacaacgagcaguucgacaagcuguacauuuggggcgugcaccauccugggacggauaaugaccagaucuuucucuaugcgcaagccucuggacggauuacaguuuccaccaaacgcagccagcagacagugaucccgaacauuggcuccagaccccggguccgcaauaucccuucuagaaucagcauuuacuggaccaucgugaagcccggggauauucugcugaucaacuccaccggaaaucucauugcuccucggggcuacuucaaaauccgcagcgggaagucuuccaucaugagagccgacgcucccauuggaaaguguaacagcgaaugcaucacaccgaauggcucuauuccuaacgacaaacccuuucagaaugugaaccggaucacguauggcgccuguccucgcuacgucaagcaaaauacccugaaacuugcgacagggaugagaaacguucccgagaagcagacccggggaauuuucggcgccaucgcuggguuuaucgaaaauggaugggagggcaugguggaugggugguauggauuccgccaccagaacagcgagggcagaggccaagccgcugaccugaaauccacacaggccgccauugaucagaucaaugggaagcucaaccggcugauuggaaaaaccaacgaaaaguuccaccagaucgagaaggaauuuucugagguggaaggccgcauucaagaccuugagaaauacgucgaggauacgaagaucgaccuguggagcuauaaugcugaacuccugguggcgcuggagaaccagcauacaauugaucucaccgacuccgaaaugaauaaacuguucgagaagaccaaaaagcagcuuagagaaaacgccgaggauauggggaauggaugcuuuaagaucuaccacaaaugugacaacgcuugcaucggcagcauucggaaugggacauaugaucaugacguuuacagagacgaggcccugaacaaucgcuuccagaucaagggcguggaacucaaaucuggauacaaggauuggauucuguggaucuccuuugccauuagcugcuuccuucugugugucgcucuccugggcuuuaucaugugggccugccaaaaagggaacauccgguguaauauuugcaucuga

SEQ ID NO: 195895 - RNA, 1701 nt, Artificial Sequence; identical to SEQ ID NO: 191832
  derived and/or modified sequence opt5 from hemagglutinin__InfluenzaA__AJJ99197

SEQ ID NO: 195896 - RNA, 1701 nt, Artificial Sequence
  derived and/or modified sequence opt5 from hemagglutinin__InfluenzaA__AJJ99209
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcaagucugacaacuccuuuuucagcagacugaauuggcucacacaucugaaauuuaaguauccugcccuuaacgucaccaugcccaauaacgaggaguucgauaaacuguacaucuggggagugcaccauccugggacggacaacgaucagauuuuucucuaugcgcaggccucuggccggaucacaguuuccaccaagcgcagccaacagacagugauuccgaauaucggguccagaccccggguccgcaacauuccuucuagaaucagcaucuacuggaccauugugaaacccggagacauccugcugauuaauuccaccggcaaccucaucgcuccucggggguacuucaagauucgcagcggaaagucuuccaucaugagaagcgacgcccccaucggcaaauguaauucugaaugcauuacaccgaacggcagcaucccuaaugauaagcccuuucagaacgugaaucggauuacguauggggcuuguccucgcuacgucaaacaguccacccugaagcuggccacaggaaugagaaacguucccgagaaacaaacccggggcaucuucggggcgauugccggauuuaucgaaaauggcugggaggggaugguggacggaugguauggcuuccgccaccagaacucugagggcaucgggcaggcugccgaucuuaagagcacacaagcugccauuaaucagaucaacggaaaacucaauagacugauuggcaagaccaacgaaaaguuccaccagaucgagaaagaauuuuccgagguggaagggcggauucaggaccuugagaaguacgucgaggauacgaaaaucgaccuguggagcuauaacgccgaacuccugguggcucuggagaaucaacauacaauugaucucaccgacucugaaaugaacaagcuguucgagagaaccaaaaagcagcuucgcgaaaaugcggaggauaugggaaacggcugcuuuaagaucuaccacaaaugugacaaugccugcaucggguccauucggaacggcacauaugaucaugacguuuacagagacgaggcucugaauaaccgcuuccagaucaagggaguggaacucaaaagcggcuacaaggauuggauucuguggaucucuuuugccauguccugcuuccuucugugugucgcccuccugggguuuauuaugugggcuugccagaaaggaaauauccgguguaacaucugcauuuga

SEQ ID NO: 195897 - RNA, 1701 nt, Artificial Sequence
  derived and/or modified sequence opt5 from hemagglutinin__InfluenzaA__AJJ99221
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacuccagcuuuuucucucggcugaauuggcucacacaucugaaguuuaaguauccugcccuuaacgucaccaugcccaauaacgagaaauucgacaagcuguacauuuggggcgugcaccauccugggacggauaacgaccagaucuuucucuaugcgcaggccuccggacgcauuacaguuagcaccaaaagaucccaacagacagugaucccgaauauuggcucucggccccgcgucagaaacaucccuagccggaucuccauuuacuggaccaucgugaagcccggggauauucugcugaucaauagcaccggaaaccucauugcuccucgcggcuacuucaaaauccagucugggaaguccagcaucaugagaucugacgcccccauuggaaaguguaauagcgaaugcaucacaccgaacggcuccauuccuaaugacaaacccuuucagaacgugaaucggaucacguauggcgcuuguccucgcuacgucaagcaaaacacccugaaacuugccacagggaugagaaauguucccgagaagcagacccggggaauuuucggcgcgaucgccggguuuaucgaaaacggaugggagggcaugguggaugggugguauggauuccgccaccaaaauucugagggcauuggccaggcugccgaccugaaaagcacacaggcugccaucgaucagauuaacgggaagcucaauagacugaucggaaaaaccaacgaaaaguuccaccagauugagaaggaauuuuccgagguggaaggccggauccaagaccuugagaaauacgucgaggauacgaagauugaccuguggagcuauaacgccgaacuccugguggcucuggagaaucagcauacaaucgaucucaccgacucugaaaugaacaaacuguucgagaagaccaaaaagcagcuuagagaaaaugcggaggauauggggaacggaugcuuuaagaucuaccacaaaugugacaaugccugcauuggcuccauccgcaacgggacauaugaucaugacguuuaccgggacgaggcucugaauaacagauuccagauuaagggcguggaacucaaaagcggauacaaggauuggauccuguggauuucuuuugccaucuccugcuuccuucugugugucgcccuccugggcuuuaucaugugggcuugccaaaaagggaauauucgcuguaacaucugcauuuga

SEQ ID NO: 195898 - RNA, 1701 nt, Artificial Sequence; identical to SEQ ID NO: 184939
  derived and/or modified sequence opt5 from hemagglutinin__InfluenzaA__AJJ99233

SEQ ID NO: 195899 - RNA, 1701 nt, Artificial Sequence
  derived and/or modified sequence opt5 from hemagglutinin__InfluenzaA__AJJ99244
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaaaugcaacaucgccggguggauucugggaaauccugagugugaaucucugagcacagccuccucuuggagcuacaucguggagaccuccggcucugacaacgggacgugcuauccgggagauuuuauugacuacgaggagcuccgggagcagcugagcuccgucagcucuuucgaacgcuuugagaucuuccccaagaccuccagcuggccuaaucacgauucuaacaagggcgugacagccgcuuguccccaugccggcgcgaaaggguuuuauaagaaucuuaucuggcugguuaaaaagggaaacuccuacccuaaacucagcaagucuuauauuaaugacaagggcaaagaagugcugguccuuugggggauccaccaccccuccaccacagccgaucaacagagccuguaccagaacgcugacaccuacguguucgugggaacguccagauauucuaagaaauuuaagccugagauugccauccggccgaaaguccgcgaucaggagggcagaaugaauuacuauuggacacucguugaacccggggacaagauuaccuucgaggcuacaggaaaccugguggugccucgguacgccuuugcgauggaacgcaacgccggcagcggcaucauuaucuccgauacccccguccaugacugcaauaccacaugucaaacgccuaaaggggcuaucaacaccagccugcccuuccagaauauucacccgaucacaauuggaaagugcccuaaguaugugaaaucuaccaagcucagacuggccacaggccuucggaacguucccuccauccagagccgcgggcuguuuggagcuauugccggcuucaucgaagggggauggaccggcaugguggacggcugguacggguaucaucaccagaaugaacaaggaucuggcuacgccgcugaucucaaaagcacgcagaacgcgaucgacaagauuacaaauaaagucaacuccgugaucgagaagaugaauacccaguuuaccgccguugggaaggaguucaaccaccuggaaaagagaauugagaaucuuaacaagaaaguggaugacggauuccuggauaucuggacauacaaugcugaacuccugguccugcucgagaacgaacggacccuggacuaucaugauucuaaugugaagaaccuuuacgagaaaguccgcaaccagcugaagaauaacgccaaggagauuggcaauggguguuuugaguucuaucacaaaugcgacaacacauguauggaaagcgugaagaauggcacguacgauuauccuaaauacuccgaagaggccaagcucaacagagaagagaucgacggaguuaaacuggagagcacccggaucuaucaaauucuugcuaucuacucuacaguggccuccagccugguccucgugguuucucugggcgcgauuuccuuuuggaugugcagcaaugggucccugcagugccgcaucuguauuuga

SEQ ID NO: 195900 - RNA, 1701 nt, Artificial Sequence
  derived and/or modified sequence opt5 from hemagglutinin__InfluenzaA__AJJ99255
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaaucacaacgggaaacuuuguaagcugagaggaguugcgccccuccaucugggcaagugcaauaucgccggguggauucugggaaacccugagugugaaucucucagcacagcuuccucuuggagcuacaucguggagaccuccucuagcgacaauggcacgugcuauccgggggauuuuauuaacuacgaagaacugcgggagcagcuuuccagcgucucuuccuucgaacgcuuugagaucuuccccaaaaccagcucuuggccuaaucacgacuccaacaagggagugacagccgcuugucccagagccggcgccaagagcuuuuauaaaaaucugaucuggcucguuaagaaaggcaacucuuacccuaagcuguccaaaagcuauauuaaugauaaggggaaggaagugcuugucauguggggaauccaucaccccuccaccacagccgaccaacagucucuguaccagaacgcugaugccuacguguucgugggcaccagccgguauuccaaagaguuuaagccugagauugcuauccgcccgaaagucagagaccaggaagggcggaugaacuacuauuggacgcucguugagcccggagauaagauuacauucgaagccaccggcaaucugcuggugccucgcuacgcguuugccauggagagaaacgcugggagcggaaucauuaucucugacacacccgugcacgauugcaauaccaccugucaaacaccuaaaggcgccaucaacacgucccuccccuuccagaauauucauccgaucaccauuggcaagugcccuaaauaugucaagagcacaaagcugcggcuugcuaccgggcugcgcaacgugcccucuauccagagcagaggacucuuuggcgccauugccggguucaucgaaggaggcuggacagggaugguugacggaugguacggcuaucaccaucagaaugagcaaggcuccggguacgcugcggaccugaaaucuacccagaacgccaucgauaagauuacgaauaaagugaacagcgucaucgagaagaugaauacacaguuuaccgcugugggaaaagaguucaaccaccuugagaagcggauugaaaaucugaacaagaaaguugacgauggcuuccucgacaucuggaccuacaaugccgagcugcuggugcuccuggaaaacgagcgcacacuugauuaucacgacuccaacgucaagaaucuguacgagaaagugagaaaccagcucaagaauaacgccaaagaaauugggaauggauguuuugaguucuaucauaagugcgauaacaccuguauggaaagcgucaagaauggcacauacgacuauccuaaauacucugaggaagcuaagcugaaccgggaggagaucgauggggugaaacuugaauccacgcgcaucuaucaaauucuggccaucuacagcaccguugcgucuucccucgugcuggucgugagccugggcgcuauuuccuuuuggaugugcucuaauggaagccuccagugcagaaucuguauuuga

SEQ ID NO: 195901 - RNA, 1698 nt, Artificial Sequence
  derived and/or modified sequence opt5 from hemagglutinin__InfluenzaA__AJJ99267
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacgaucaccggaguguccgccagcugcucucauaauggcgaauccagcuuuuaucgcaaccugcuuuggcugacaggcaaaaaugggcucuaccccaaccugucuaaguccuaugcuaauaacaaagagaaggaaguucuggugcucuggggaguccaccacccuccgaacauuggcgaccagaaagcccuguaccauaccgagaaugcuuacgugagcguggucuccucucacuauagcagaaaguucacacccgaaaucgccaagcggccuaaaguucgcgaucaggaggggagaauuaacuacuauuggacccuucuggagcccggagacacgaucauuuuugaagcgaauggcaaccucaucgccccucgguacgcuuucgcccugucccgcggguuuggaagcggcauuaucaauucuaacgcucccauggauaagugugacgccaaaugccagacaccgcaaggcgcgaucaauuccagccuuccuuuccagaacgugcaucccgugaccauuggggaguguccuaaguaugucagaucugccaaacugcggauggugacaggacuccgcaauauccccagcauucaguccagaggccuguuuggggcuaucgccggauucauugaaggcggguggaccggaaugguugauggcugguacggcuaucaccaccagaacgagcaagggucuggauacgcugccgaccaaaagagcacccagaaugccaucaacggcaucacaaauaaagugaacuccgucauugaaaagaugaauacgcaguuuaccgcuguggggaaggaguucaacaaacuggagcggcgcauggaaaaccucaauaagaaaguugaugacggauucaucgauauuuggacauacaacgcggagcugcuugugcugcucgaaaaugagagaacccuggacuuucaugacagcaacgucaagaaucuuuaugaaaaagugaagucucagcugaagaacaaugccaaagagaucggcaacgggugcuucgaguuuuaccacaaguguaaugaugaaugcauggaguccgucaaaaacggcacauaugacuaccccaaguauagcgaagagucuaaacucaaucgggagaagauugauggagugaagcuggaauccaugggcguuuaccagauccuggcuaucuauagcaccguggccuccucucucguccugcuugugagccugggggccguuuccuucuggaugugcucuaacggaagccuccagugucgcgugugcauuuga

SEQ ID NO: 195902 - RNA, 1701 nt, Artificial Sequence; identical to SEQ ID NO: 190074
  derived and/or modified sequence opt5 from hemagglutinin__InfluenzaA__AJJ99278

SEQ ID NO: 195903 - RNA, 1701 nt, Artificial Sequence; identical to SEQ ID NO: 190077
  derived and/or modified sequence opt5 from hemagglutinin__InfluenzaA__AJJ99289

SEQ ID NO: 195904 - RNA, 1698 nt, Artificial Sequence
  derived and/or modified sequence opt5 from hemagglutinin__InfluenzaA__AJJ99301
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaaucccugaucucuaaagagagcugguccuacauuguggaaaagccgaaccccgagaauggcaccuguuauccugggcauuuugccgauuacgaggaacuuagagagcaacugucuagcgucuccagcuucgaacgguuugagaucuuccccaaggagucuuccuggccuaaccacacggugaccggaguuagcgccucuugcucccauaauggcgaaagcucuuuuuaucgcaaccuccuguggcuuacaggcaaaaaugggcuguaccccaaccucuccaagagcuaugcuaauaacaaagagaaggaagugcugguccuguggggagugcaccacccuccgaacaucggcgaccagaaagcccucuaccauaccgagaaugcuuacguguccgucguuucuagccacuauuccagaaaguucacacccgaaauugccaagcggccuaaagugcgcgaucaggaggggagaaucaacuacuauuggacccugcuugagcccggagacacgauuaucuuugaagcgaauggcaaccugauugccccucgguacgcuuucgcccucagccgcggguuuggaucuggcaucauuaauuccaacgcucccauggauaagugugacgccaaaugccagacaccgcaaggcgcgaucaauagcucucugccuuuccagaacgugcaucccgucaccaucggggaguguccuaaguaugugagaagcgccaaacuucggaugguuacaggacugcgcaauauucccuccauccagucuagaggccucuuuggggcuauugccggauucaucgaaggcggguggaccggaaugguggauggcugguacggcuaucaccaccagaacgagcaagggagcggauacgcugccgaccagaaguccacccagaaugccauuaacggcaucacaaauaaagucaacagcgugaucgaaaagaugaauacgcaguuuaccgcuguugggaaggaguucaacaaacuggagcggcgcauggaaaaccugaauaagaaaguggaugacggauucauugauaucuggacauacaacgcggagcuccugguccuucuggaaaaugagagaacccucgacuuucaugacucuaacgugaagaaucuguaugaaaaagucaagucccaacuuaagaacaaugccaaagagauuggcaacgggugcuucgaguuuuaccacaaguguaaugaugaaugcauggagagcgugaaaaacggcacauaugacuaccccaaguauucugaagaguccaaacugaaucgggagaagaucgauggaguuaagcucgaaagcaugggcguguaccagauucuggcuaucuauuccaccgucgccucuagccuggugcuccugguuucccuuggggccaucucuuucuggaugugcagcaacggaucccugcagugucgcauuugcaucuga

SEQ ID NO: 195905 - RNA, 1698 nt, Artificial Sequence
  derived and/or modified sequence opt5 from hemagglutinin__InfluenzaA__AJJ99324
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaaaacuccuuuuaucgcaaucugcuuuggcugacaggcaaaagcgggcucuaccccaaccugucuaaguccuaugcuaauaacaaagagaaggaagugcugguccucuggggagugcaccacccuccgaacaucgccgaccagaaaacccuguaccauacagagaaugcuuacgugagcgucguuuccucucacuauagcagaaaguucacccccgaaauugccaagcggccuaaagugcgcgaucaggagggcagaaucaacuacuauuggacgcuucuggagcccggggacacaauuaucuuugaagcgaauggaaaccucauugccccucgguacgcuuucgcccugucccgcggcuuugggagcggaaucauuaauucuaacgcucccauggauaagugugacgccaaaugccagaccccgcaaggcgcgaucaauuccagccuuccuuuccagaacgugcaucccgucacaaucggcgaguguccuaaguaugugagaucugccaaacugcggaugguuaccgggcuccgcaauauucccagcauccaguccagaggacuguuuggcgcuauugccggguucaucgaaggaggcuggaccgggaugguggauggaugguacggcuaucaccaccagaacgagcaaggcucuggguacgcugccgaccaaaagagcacacagaaugccauuaacggaaucacgaauaaagucaacuccgugaucgaaaagaugaauacccaguuuacagcuguuggcaaggaguucaacaaacuggagcggcgcauggaaaaccucaauaagaaaguggaugacggguucauugauaucuggaccuacaacgcggagcugcuuguccugcucgaaaaugagagaacacuggacuuucaugacagcaacgugaagaaucuuuaugaaaaagucaagucucagcugaagaacaaugccaaagagauuggaaacggcugcuucgaguuuuaccacaaguguaaugaugaaugcauggaguccgugaaaaacgggaccuaugacuaccccaaguauagcgaagagucuaaacucaaucgggagaagaucgauggcguuaagcuggaauccaugggaguguaccagauucuggcuaucuauagcacggucgccuccucucucgugcugcuuguuagccugggcgccaucuccuucuggaugugcucuaacgggagccuccagugucgcauuugcaucuga

SEQ ID NO: 195906 - RNA, 1701 nt, Artificial Sequence
  derived and/or modified sequence opt5 from hemagglutinin__InfluenzaA__AJJ99335
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaaacugagaggaguugcgccccuccaucugggcaagugcaacaucgccggguggauucugggaaauccugaaugugagucucucagcacagcuuccucuuggagcuacaucguggaaaccuccucuagcaacaauggcacgugcuauccgggggacuuuauugauuacgaggagcugcgggaacagcuuuccagcgucucuuccuucgagcgcuuugaaaucuuccccaaaaccagcucuuggccuaaccacgacuccaauaagggagugacagccgcuuguccccaugccggcgccaagagcuuuuauaaaaaccugaucuggcucguuaagaaaggcaauucuuacccuaagcuguccaaaagcuauauuaacgauaaggggaaggaggugcuuguccuguggggaauccaccaccccuccaccucugccgaccaacagagccucuaccagaaugcugaugccuacguguucgugggcuccagcagauauucuaaaaaguuuaaaccugagauugcuauccggccgaagguccgcgaccaggaagggagaaugaacuacuauuggacacugguugagcccggagauaaaauuaccuucgaagccacgggcaaccugguggugccucgguacgcguuugccauggagcgcaaugcuggguccggaaucauuaucagcgacacacccguccaugauugcaacaccacaugucaaaccccuaauggcgccaucaacaccucucuccccuuccacaauauucauccgaucacaauuggcaagugcccuaaauauguuaagagcacgaagcugagacuugcuaccgggcugcggaacgugcccuccauccagucucgcggacucuuuggcgccauugccggguucaucgaaggaggcuggacagggaugguggacggaugguacggcuaucaccaccagaaugagcagggcagcggguacgcugcggaccugaaauccacccaaaacgccaucgaugagauuacaaauaaggucaacagcgugaucgaaaagaugaauacccaguuuacggcuguuggaaaggaguucaaccaucuugaaaagagaauugagaaucugaacaagaagguggacgauggcuuccucgacaucuggacauacaaugccgaacugcugguccuccuggagaacgagcggacccuugauuaucacgacucuaacgugaaaaaucuguacgaaaagguccgcucccagcucaaaaacaaugccaaggagauugggaacggauguuuugaguucuaucauaaaugcgauaauaccuguauggaaagcgugaagaacggcacauacgacuauccuaaguacucugaagaggcuaaacugaauagagaggaaaucgaugggguuaaacuugaguccacccggaucuaucagauucuggccaucuacagcacaguggcguccucucucguccuggugguuagccugggcgcuauuuccuuuuggaugugcucuaacggaagccuccaaugccgcaucuguauuuga

SEQ ID NO: 195907 - RNA, 1701 nt, Artificial Sequence; identical to SEQ ID NO: 187809
  derived and/or modified sequence opt5 from hemagglutinin__InfluenzaA__AJJ99357

SEQ ID NO: 195908 - RNA, 1701 nt, Artificial Sequence; identical to SEQ ID NO: 189848
  derived and/or modified sequence opt5 from hemagglutinin__InfluenzaA__AJJ99368

SEQ ID NO: 195909 - RNA, 1701 nt, Artificial Sequence; identical to SEQ ID NO: 189459
  derived and/or modified sequence opt5 from hemagglutinin__InfluenzaA__AJJ99379

SEQ ID NO: 195910 - RNA, 1701 nt, Artificial Sequence
  derived and/or modified sequence opt5 from hemagglutinin__InfluenzaA__AJJ99390
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaagcacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcuccagcagauauucuaaaaaguuuaaaccugagauugcuauccggccgaagguccgcgaucaggaagggagaaugaauuacuauuggacacugguugagcccggagacaaaauuaccuucgaagccacgggcaaccugguggugccucgguacgcguuugccauggagcgcaacgcuggguccggaaucauuaucagcgauacacccguccaugacugcaauaccacaugucaaaccccuaagggcgccaucaacaccucucuccccuuccacaauauucauccgaucacaauuggcaaaugcccuaaguauguuaagagcacgaaacugagacuugcuaccgggcugcggaacgugcccuccauccagucucgcggacucuuuggcgccauugccggguucaucgaaggaggcuggacagggaugguggacggaugguacggcuaucaccaccagaaugagcagggcagcggguacgcugcggaucugaaguccacccaaaacgccaucgacaaaauuacaaauaaggucaacagcgugaucgagaaaaugaauacccaguuuacggcuguuggaaaggaguucaaccaucuugaaaagagaauugaaaaucugaacaaaaagguggaugacggcuuccucgauaucuggacauacaaugccgagcugcugguccuccuggaaaacgagcggacccuugacuaucacgauucuaaugugaaaaaccuguacgagaagguccgcucccagcucaaaaacaaugccaaggaaauugggaacggauguuuugaguucuaucauaagugcgacaauaccuguauggaaagcgugaaaaacggcacauacgauuauccuaaguacucugaggaagcuaaacugaauagagaggagaucgacgggguuaaacuugaauccacccggaucuaucagauucuggccaucuacagcacaguggcguccucucucguccuggugguuagccugggcgcuauuuccuuuuggaugugcucuaacggaagccuccaaugccgcaucuguauuuga

SEQ ID NO: 195911 - RNA, 1701 nt, Artificial Sequence; identical to SEQ ID NO: 187809
  derived and/or modified sequence opt5 from hemagglutinin__InfluenzaA__AJJ99401

SEQ ID NO: 195912 - RNA, 1698 nt, Artificial Sequence
  derived and/or modified sequence opt5 from hemagglutinin__InfluenzaA__AJJ99413
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaaaacuccuuuuaucgcaaucugcuuuggcugacaggcaaaaacgggcucuaccccaaucugagcaagucuuaugcuaacaacaaagagaaggaagugcugguccucuggggagugcaccacccuccgaauaucgccgaccagaaaacccuguaccauacagagaacgcuuacguguccgucguuagcucccacuauucuagaaaguucacccccgaaauugccaagcggccuaaagugcgcgaucaggagggcagaaucaauuacuauuggacgcuucuggagcccggggacacaauuaucuuugaagcgaacggaaaucucauugccccucgguacgcuuucgcccugagccgcggcuuuggguccggaaucauuaacagcaaugcuucuauggauaagugugacgccaaaugccagacaccccaaggcgcgaucaacuccagccuuccguuccagaaugugcauccugucaccaucggcgagugucccaaguaugugagaucugccaaacugcggaugguuaccgggcuccgcaacauuccuagcauccaguccagaggacuguuuggcgcuauugccggguucaucgaaggaggcuggaccgggaugguggauggaugguacggcuaucaccaccagaaugagcaaggcucuggguacgcugccgaccaaaagagcacacagaacgccauuaauggaaucacgaacaaagucaauuccgugaucgaaaagaugaacacccaguuuacagcuguuggcaaggaguucaacaaacuggagcggcgcauggaaaaucucaacaagaaaguggaugacggguucauugauaucuggaccuacaaugcggagcugcuuguccugcucgaaaacgagagaacacuggacuuucaugacagcaaugugaagaaccuuuaugaaaaagucaagucucagcugaagaauaacgccaaagagauuggaaauggcugcuucgaguuuuaccacaaguguaacgaugaaugcauggaguccgugaaaaaugggaccuaugacuaccccaaguauagcgaagagucuaaacucaaccgggagaagaucgauggcguuaagcuggaauccaugggaguguaccagauucuggcuaucuauagcacggucgccuccucucucgugcugcuuguuagccugggcgccaucuccuucuggaugugcucuaaugggagccuccagugucgcauuugcaucuga

SEQ ID NO: 195913 - RNA, 1698 nt, Artificial Sequence; identical to SEQ ID NO: 186650
  derived and/or modified sequence opt5 from hemagglutinin__InfluenzaA__AJJ99425

SEQ ID NO: 195914 - RNA, 1698 nt, Artificial Sequence
  derived and/or modified sequence opt5 from hemagglutinin__InfluenzaA__AJJ99437
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaaaacuccuuuuaucgcaaucugcuuuggcugacaggcaaaaacgggcucuaccccagccugucuaaguccuaugcuaauaacaaagagaaggaagugcugguccucuggggagugcaccacccuccgaacaucgccgaccagaaaacccuguaccauacagagaaugcuuacgugagcgucguuuccucucacuauagcagaaaguucacccccgaaauugccaagcggccuaaagugcgcgaucaggagggcagaaucaacuacuauuggacgcuucuggagcccggggacacaauuaucuuugaagcgaauggaaaccucauugccccucgguacgcuuucgcccugucccgcggcuuugggagcggaaucauuaauucuaacgcucccauggauaagugugacgccaaaugccagaccccgcaaggcgcgaucaauuccagccuuccuuuccagaacgugcaucccgucacaaucggcgaguguccuaaguaugugagaucugccaaacugcggaugguuaccgggcuccgcaauauucccagcauccaguccagaggacuguuuggcgcuauugccggguucaucgaaggaggcuggaccgggaugguggauggaugguacggcuaucaccaccagaacgagcaaggcucuggguacgcugccgaccaaaagagcacacagaaugccauuaacggaaucacgaauaaagucaacuccgugaucgaaaagaugaauacccaguuuacagcuguuggcaaggaguucaacaaacuggagcggcgcauggaaaaccucaauaagaaaguggaugacggguucauugauaucuggaccuacaacgcggagcugcuuguccugcucgaaaaugagagaacacuggacuuucaugacagcaacgugaagaaucuuuaugaaaaagucaagucucagcugaagaacaaugccaaagagauuggaaacggcugcuucgaguuuuaccacaaguguaaugaugaaugcauggaguccgugaaaaacgggaccuaugacuaccccaaguauagcgaagagucuaaacucaaucgggagaagaucgauggcguuaagcuggaauccaugggaguguaccagauucuggcuaucuauagcacggucgccuccucucucgugcugcuuguuagccugggcgccaucuccuucuggaugugcucuaacgggagccuccagugucgcauuugcaucuga

SEQ ID NO: 195915 - RNA, 1698 nt, Artificial Sequence
  derived and/or modified sequence opt5 from hemagglutinin__InfluenzaA__AJJ99449
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaagcccuguaccauaccgagaaugcuuacgugagcgucguuuccucucacuauagcagaaaguucacacccgaaauugccaagcggccuaaagugcgcgaucaggaggggagaaucaacuacuauuggacccuucuggagcccggagacacgauuaucuuugaagcgaauggcaaccucauugccccucgguacgcuuucgcccugucccgcggguuuggaagcggcaucauuaauucuaacgcucccaugggcaagugugaugccaaaugccagacaccgcaaggggcgaucaauuccagccuuccuuuccagaacgugcaucccgucaccaucggagaguguccuaaguaugugagaucugccaaacugcggaugguuacaggccuccgcaauauucccagcauccaguccagagggcuguuuggagcuauugccggcuucaucgaagggggauggaccggcaugguggacggcugguacggguaucaccaccagaacgagcaaggaucuggcuacgcugccgaucaaaagagcacccagaaugccauuaacgggaucacaaauaaagucaacuccgugaucgaaaagaugaauacgcaguuuaccgcuguuggaaaggaguucaacaaacuggagcggcgcauggaaaaccucaauaagaaaguggacgauggcuucauugacaucuggacauacaacgcggagcugcuuguccugcucgaaaaugagagaacccuggauuuucaugacagcaacgugaagaaucuuuaugaaaaagucaagucucagcugaagaacaaugccaaagagauugggaacggcugcuucgaguuuuaccacaaguguaaugacgaaugcauggaguccgugaaaaacggaacauaugauuaccccaaguauagcaaagaaucuaagcucaaucgggagaagaucgacggcguuaaacuggaguccauggggguguaccagauucuggcuaucuauagcaccgucgccuccucucucgugcugcuuguuagccugggagccaucuccuucuggaugugcucuaacggcagccuccagugucgcauuugcaucuga

SEQ ID NO: 195916 - RNA, 1698 nt, Artificial Sequence; identical to SEQ ID NO: 185512
  derived and/or modified sequence opt5 from hemagglutinin__InfluenzaA__AJJ99461

SEQ ID NO: 195917 - RNA, 1701 nt, Artificial Sequence
  derived and/or modified sequence opt5 from hemagglutinin__InfluenzaA__AJJ99483
augaaggccauccugcucgugcugcuuuacaccuucgcuacagccaacgcggacacgcugugcauuggcuaucacgcuaauaacagcaccgauacagucgacaccguucucgagaaaaaugugacagugacccauuccgucaaccugcuugaagauaagcacaaugggaaacuguguaagcucagaggaguggcuccccugcaucugggcaaaugcaacaucgccggguggauucucggaaauccugagugugaaucucugagcacagccuccucuuggagcuacaucguugagaccuccucuagcgacaacggcacgugcuauccgggggauuuuauuaauuacgaagaacuucgggagcagcuguccagcgugucuuccuucgaacgcuuugagaucuuccccaagaccagcucuuggccuaaccacgacuccaauaagggagucacagccgcuugucccagagccggcgcgaaaucuuuuuauaagaaccucaucuggcuggugaaaaagggcaauagcuacccuaaacuuuccaagagcuauauuaacgauaaggggaaagaaguucuggugcucuggggaauccaucaccccuccaccacagccgaccaacagucucuguaccagaaugcugaugccuacgucuucgugggcaccagccgguauuccaagaaauuuaagccugagauugcuauccgcccgaaagugagagaccaggaggggcggaugaacuacuauuggacgcuggucgaacccggagauaagauuacauucgaggccaccggcaaccuccugguuccucgcuacgcguuugccauggaaagaaaugcugggagcggaaucauuaucucugacacacccgugcacgauugcaacaccaccugucaaacaccuaaaggcgccaucaauacgucccuucccuuccagaacauucauccgaucaccauuggcaagugcccuaaguaugugaaaagcacaaagcugcggcucgcuaccgggcugcgcaauguccccucuauccagagcagaggacuuuuuggcgccauugccggguucaucgagggaggcuggacagggaugguggacggaugguacggcuaucaccaucagaacgaacaaggcuccggguacgcugcggaccugaaaucuacccagaaugccaucgauaagauuacgaacaaaguuaauagcgugaucgagaagaugaacacacaguuuaccgcugucggaaaggaguucaaucaccucgaaaaacggauugagaaccugaauaagaaaguggacgauggcuuccuggacaucuggaccuacaacgccgaacuccugguucuucuggagaaugaacgcacacucgauuaucacgacuccaacgugaagaaccuguacgagaaagucagaaaucagcuuaagaacaaugccaaggagauugggaacggauguuuugaguucuaucauaaaugcgauaauaccuguauggagagcgugaagaacggcacauacgacuauccuaaauacucugaagaggcuaagcugaaucgggaagagaucgauggggucaaacucgaguccacgcgcaucuaucaaauucuggccaucuacagcaccguggcgucuucccugguucucguggucagccugggcgcuauuuccuuuuggaugugcucuaacggaagccuucagugcagaaucuguauuuga

SEQ ID NO: 195918 - RNA, 1701 nt, Artificial Sequence; identical to SEQ ID NO: 190077
  derived and/or modified sequence opt5 from hemagglutinin__InfluenzaA__AJJ99494

SEQ ID NO: 195919 - RNA, 1701 nt, Artificial Sequence
  derived and/or modified sequence opt5 from hemagglutinin__InfluenzaA__AJJ99505
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaggaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccaaguauagcaaaaaguuuaaaccugagauugcugucagaccgaagguucgggaccaggaggggcgcaugaacuacuauuggacccugguggaacccggagauaaaaucacguucgaggccacaggcaaccugcucgugccuagauacgcguuugccauggaacggaaugcugggucuggaauuaucauuuccgacacccccguccaugauugcaacacaaccugucaaaccccuaagggcgccaucaauacaagccugcccuuccagaacauccacccgauuacgaucggcaagugcccuaaauaugugaagucuaccaaacuucgccuggcuacagggcucagaaauguucccagcauucagucccggggacuguuuggcgccaucgccggguucauugagggaggcuggaccgggaugguggacggaugguacggcuaucaucaccagaacgaacaaggcucuggguacgcugcggaccuuaagagcacacagaaugccaucgauaaaaucaccaacaaggucaauuccgugauugagaagaugaacacgcaguuuacagcuguuggaaaaggcuucaaucaccuggagaagcgcaucgaaaaccucaauaaaaagguggacgauggguuccuggacauuuggaccuacaacgccgagcugcucguccugcuugaaaaugagagaacccuggauuaucaugacagcaacgugaaaaaccucuacgaaaagguccggucucagcugaagaauaacgccaaagagaucggaaauggcuguuuugaguucuaucacaagugcgauaacacauguauggaauccgugaaaaaugggaccuacgacuauccuaaguacagcgaggaagcuaaacuuaaccgcgaggaaauugauggcguuaagcuggagucuacaagaaucuaucaaauccucgccauuuacuccacgguggcgagcucccugguccuggugguuucucucggagcuaucagcuuuuggaugugcuccaauggcucucugcagugccggauuuguaucuga

SEQ ID NO: 195920 - RNA, 1701 nt, Artificial Sequence; identical to SEQ ID NO: 185935
  derived and/or modified sequence opt5 from hemagglutinin__InfluenzaA__AJJ99516

SEQ ID NO: 195921 - RNA, 1701 nt, Artificial Sequence
  derived and/or modified sequence opt5 from hemagglutinin__InfluenzaA__AJJ99527
augaaggccauccugcucgugcugcuuuacaccuucgcuacagccaacgcggacacgcugugcauuggcuaucacgcuaauaacagcaccgauacagucgacaccguucucgagaaaaaugugacagugacccauuccgucaaccugcuugaagauaagcacaaugggaaacuguguaagcucagaggaguggcuccccugcaucugggcaaaugcaacaucgccggguggauucucggaaauccugagugugaaucucugagcacagccuccucuuggagcuacaucguugagaccuccucuagcgacaacggcacgugcuauccgggggauuuuauuaauuacgaagaacuucgggagcagcuguccagcgugucuuccuucgaacgcuuugagaucuuccccaagaccagcucuuggccuaaccacgacuccaauaagggagucacagccgcuugucccagagccggcgcgaaaucuuuuuauaagaaccucaucuggcuggugaaaaagggcaauagcuacccuaaacuuuccaagagcuauauuaacgauaaggggaaagaaguucuggugcucuggggaauccaucaccccuccaccacagccgaccaacagucucuguaccagaaugcugaugccuacgucuucgugggcaccagccgguauuccaagaaauuuaagccugagauugcuauccgcccgaaagugagagaccaggaggggcggaugaacuacuauuggacgcuggucgaacccggagauaagauuacauucgaggccaccggcaaccuccugguuccucgcuacgcguuugccauggaaagaaaugcugggagcggaaucauuaucucugacacacccgugcacgauugcaacaccaccugucaaacaccuaaaggcgccaucaauacgucccuucccuuccagaacauucauccgaucaccauuggcaagugcccuaaguaugugaaaagcacaaagcugcggcucgcuaccgggcugcgcaauguccccucuauccagagcagaggacuuuuuggcgccauugccggguucaucgagggaggcuggacagggaugguggacggaugguacggcuaucaccaucagaacgaacaaggcuccggguacgcugcggaccugaaaucuacccagaauguuaucgauaagauuacgaacaaagugaauagcgucaucgagaagaugaacacacaguuuaccgccgugggaaaggaguucaaucaccucgaaaaacggauugagaaccugaauaagaaaguugacgauggcuuccuggacaucuggaccuacaacgcugaacuccuggugcuucuggagaaugaacgcacacucgauuaucacgacuccaacgucaagaaccuguacgagaaagugagaaaucagcuuaagaacaaugccaaggagauugggaacggauguuuugaguucuaucauaaaugcgauaauaccuguauggagagcgucaagaacggcacauacgacuauccuaaauacucugaagaggccaagcugaaucgggaagagaucgauggggugaaacucgaguccacgcgcaucuaucaaauucuggcuaucuacagcaccguugccucuucccuggugcucgucgugagccugggcgcgauuuccuuuuggaugugcucuaacggaagccuucagugcagaaucuguauuuga

SEQ ID NO: 195922 - RNA, 1701 nt, Artificial Sequence
  derived and/or modified sequence opt5 from hemagglutinin__InfluenzaA__AJJ99538
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccacagccgaucaacagucucucuaccagaacgcugacaccuacguguucgugggcacgagcagauauuccaagaaauuuaagccugagauugccauccggccgaaaguccgcgaucaggaggggagaaugaauuacuauuggacacugguugaacccggagacaagauuaccuucgaggcuacaggcaaccugguggugccucgguacgccuuugcgauggaacgcaacgccgggagcggaaucauuaucucugauacccccguccaugacugcaauaccacaugucaaacgccuaaaggcgcuaucaacaccucccuccccuuccagaauauucacccgaucacaauuggcaagugcccuaaguaugugaaaagcaccaagcugagacuugccacagggcugcggaacguucccucuauccagagccgcggacucuuuggcgcuauugccggguucaucgagggaggcuggaccgggaugguggacggaugguacggcuaucaucaccagaaugaacaaggcuccggguacgccgcugaucugaaaucuacgcagaacgcgaucgacaagauuacaaauaaagucaacagcgugaucgagaagaugaauacccaguuuaccgccguuggaaaggaguucaaccaccuugaaaagagaauugagaaucugaacaagaaaguggaugacggcuuccucgauaucuggacauacaaugcugaacugcugguccuccuggagaacgaacggacccuugacuaucaugauuccaaugugaagaaccuguacgagaaaguccgcaaccagcucaagaauaacgccaaggagacagggaauggauguuuugaguucuaucacaaaugcgacaacacguguauggagagcgugaagaauggcaccuacgauuauccuaaauacucugaagaggccaagcugaacagagagaaaauugacgggguuaaacuugaauccacacggaucuaucaaauccuggcuauuuacagcaccguggccucuucccucguccuggugguuagccugggcgcgaucuccuuuuggaugugcucuaauggaagccuccagugccgcauuuguaucuga

SEQ ID NO: 195923 - RNA, 1701 nt, Artificial Sequence
  derived and/or modified sequence opt5 from hemagglutinin__InfluenzaA__AJJ99549
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccacagccgaucaacagucccucuaccagaacgcugacaccuacguguucguggggacgucuagauauagcaagaaauuuaagccugagauugccauccggccgaaaguccgcgaucaggagggaagaaugaauuacuauuggacacugguugaacccggcgacaagauuaccuucgaggcuacagggaaccugguggugccucgguacgccuuugcgauggaacgcaacgccggauccggcaucauuaucagcgauacccccguccaugacugcaauaccacaugucaaacgccuaaaggcgcuaucaacaccucucuccccuuccagaauauucacccgaucacaauugggaagugcccuaaguaugugaaauccaccaagcugagacuugccacaggacugcggaacguucccagcauccagucucgcggccucuuuggggcuauugccggauucaucgagggcggguggaccggaaugguggacggcugguacggcuaucaucaccagaaugaacaagggagcggauacgccgcugaucugaaauccacgcagaacgcgaucgacaagauuacaaauaaagucaacucugugaucgagaagaugaauacccaguuuaccgccguuggcaaggaguucaaccaccuugagaaaagaauugagaaucugaacaagaaaguggaugacggguuccucgauaucuggacauacaaugcugaacugcugguccuccuggagaacgaacggacccuugacuaucaugauagcaaugugaagaaccuguacgagaaaguccgcaaccagcucaagaauaacgccaaggagauuggaaauggcuguuuugaguucuaucacaaaugcgacaacauguguauggaauccgugaagaaugggacauacgauuauccuaaauacagcgaagaggccaagcugaacagagaagagaucgacggcguuaaacuugagucuacgcggaucuaucaaauucuggcuaucuacuccaccgccgcgagcucucucgugcuggucgugucccugggagcuauuagcuuuuggaugugcuccaauggcucucuccagugccgcaucuguauuuga

SEQ ID NO: 195924 - RNA, 1701 nt, Artificial Sequence; identical to SEQ ID NO: 190113
  derived and/or modified sequence opt5 from hemagglutinin__InfluenzaA__AJJ99560

SEQ ID NO: 195925 - RNA, 1701 nt, Artificial Sequence
  derived and/or modified sequence opt5 from hemagglutinin__InfluenzaA__AJJ99571
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccacagccgaucaacagucucucuaccagaacgcugacaccuacguguucgugggcacgagcagauauuccaagaaauuuaagccugagauugccauccggccgaaaguccgcgaucaggaggggagaaugaauuacuauuggacacugguugaacccggagacaagauuaccuucgaggcuacaggcaaccugguggugccucgguacgccuuugcgauggaacgcaacgccgggagcggaaucauuaucucugauacccccguccaugacugcaauaccacaugucaaacgccuaaaggcgcuaucaacaccucccuccccuuccagaauauucacccgaucacaauuggcaagugcccuaaguaugugaaaagcaccaagcugagacuugccacagggcugcggaacguucccucuauccagagccgcggacucuuuggcgcuauugccggguucaucgagggaggcuggaccgggaugguggacggaugguacggcuaucaucaccagaaugaacaaggcuccggguacgccgcugaucugaaaucuacgcagaacgcgaucgacaagauuacaaauaaagucaacagcgugaucgagaagaugaauauucaguuuaccgccguuggaaaggaguucaaccaccuugagaaaagaaucgagaaucugaacaagaaaguggaugacggcuuccucgauauuuggaccuacaaugcugaacugcugguccuccuggagaacgaacggacacuugacuaucaugauuccaaugugaagaaccuguacgagaaaguccgcaaccagcucaagaauaacgccaaggagaucgggaauggauguuuugaguucuaucacaaaugcgacaacaccuguauggaaagcgugaagaauggcacauacgauuauccuaaauacucugaagaggccaagcugaacagagaagagaucgacgggguuaaacuugaguccacgcggauuuaucaaauccuggcuauuuacagcaccguggccucuucccucguccuggugguuagccugggcgcgaucuccuuuuggaugugcucuaauggaagccuccagugccgcauuuguaucuga

SEQ ID NO: 195926 - RNA, 1701 nt, Artificial Sequence
  derived and/or modified sequence opt5 from hemagglutinin__InfluenzaA__AJJ99582
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaacggcgccaucaauacaagccuccccuuccagaacauucacccgaucacgauuggcaaaugcccuaaguaugugaagucuaccaaacugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaucuuaagagcacacagaaugccaucgacaaaauuaccaacaaggucaauuccgugaucgagaaaaugaacacgcaguuuacagcuguuggaaaggaguucaaucaccuugaaaagagaauugagaaccugaauaaaaagguggaugacggcuuccucgauaucuggaccuacaacgccgaacugcugguccuccuggagaaugaacggacccuugacuaucaugauagcaacgugaaaaaccuguacgagaagguccgcucucagcucaaaaauaacgccaaggagauugggaauggauguuuugaguucuaucacaagugcgacaacacauguauggaguccgugaaaaauggcaccuacgauuauccuaaguacagcgaagaggcuaaacugaacagagaagagaucgacgggguuaagcuggagucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 195927 - RNA, 1701 nt, Artificial Sequence; identical to SEQ ID NO: 185935
  derived and/or modified sequence opt5 from hemagglutinin__InfluenzaA__AJJ99593

SEQ ID NO: 195928 - RNA, 1701 nt, Artificial Sequence
  derived and/or modified sequence opt5 from hemagglutinin__InfluenzaA__AJJ99604
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgcgcgucagagaucaggaggggcggaugaauuacuauuggacccugguugaacccggagacaaaauuacguucgaggccacaggcaaccugguggugccucgcuacgcguuugccauggaaagagaugcugggucuggaaucauuaucuccgacacccccguccaugacugcaacacaaccugucaaaccccuaagggcgccaucaauacaagccuccccuuccagaacauucacccgaucacgauuggcaaaugcccuaaguaugugaagucuaccaaacugcggcuugcuacagggcugcgcaauguucccagcauccaguccagaggacucuuuggcgccauugccggguucaucgagggaggcuggaccgggaugguggauggaugguacggcuaucaucaccagaacgaacaaggcucuggguacgcugcggaccuuaagagcacacagaaugccaucgaugagauuaccaacaaagucaauuccgugaucgagaagaugaacacgcaguuuacagcuguuggaaaagaguucaaucaccuggagaagcggauugaaaaccugaauaagaaaaucgacgauggcuuccucgacauuuggaccuacaacgccgagcugcuggugcuccuggaaaaugagcgcacccuugauuaucaugacagcaacgucaagaaucuguacgagaaagugagaucucagcucaagaacaacgccaaagaaaucgggaauggauguuuugaguucuaucacaagugcgauaacacauguauggaauccgucaagaauggcaccuacgacuauccuaaauacagcgaggaagcuaagcugaaccgggaggagaucgauggggugaaacuugaaucuacacgcauuuaucaaauccuggccauuuacuccacgguugcgagcucccucgugcuggucgugucucugggcgcuaucagcuuuuggaugugcuccaauggaucucuccagugcagaauuuguaucuga

SEQ ID NO: 195929 - RNA, 1698 nt, Artificial Sequence
  derived and/or modified sequence opt5 from hemagglutinin__InfluenzaA__AJJ99616
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaaaacuccuuuuaucgcaaucugcuuuggcugacaggcaaaaacgggcucuaccccaaucugagcaagucuuaugcuaacaacaaagagaaggaagugcugguccucuggggagugcaccacccuccgaauaucgccaaccagaaaacccuguaccauacagagaaugcuuacguguccgucguuagcucccacuauucuagaaaacuuacccccgaaauugccaagcggccuaaggugcgcgaccaggagggcagaaucaacuacuauuggacgcugcucgagcccggggauacaauuaucuucgaagcgaauggaaaccugauugccccucgguacgcuuuugcccuuagccgcggcuucggguccggaaucauuaauagcaacgcucccauggacaagugugaugccaaaugccagaccccgcaaggcgcgaucaauucuucccugccuuuucagaacgugcaucccgucacaaucggcgaguguccuaaguaugugagaagcgccaaacuccggaugguuaccgggcugcgcaauauucccucuauccagagcagaggacuguucggcgcuauugccggguuuaucgaaggaggcuggaccgggaugguggacggaugguacggcuaucaccaccagaacgagcaaggcuccggguacgcugccgaucagaagucuacacagaaugccauuaacggaaucacgaauaaagucaacagcgugaucgaaaagaugaacacccaguucacagcuguuggcaaggaguuuaauaaacucgagcggcgcauggaaaaccugaauaagaaaguggacgauggguucauugacaucuggaccuacaacgcggagcuucugguccuccuggaaaaugagagaacacuugauuuccaugacuccaacgugaagaaucuguaugaaaaagucaagagccaacucaagaacaaugccaaagagauuggaaacggcugcuuugaguucuaccacaaguguaaugacgaaugcauggagucugugaaaaacgggaccuaugauuaccccaaguauuccgaagagagcaaacugaaucgggagaagaucgacggcguuaagcuggaaucuaugggaguguaccagauucucgcuaucuauuccacggucgccagcucccuggugcuucugguuucucucggcgccaucagcuuuuggaugugcuccaacgggucucugcagugucgcauuugcaucuga

SEQ ID NO: 195930 - RNA, 1698 nt, Artificial Sequence; identical to SEQ ID NO: 186650
  derived and/or modified sequence opt5 from hemagglutinin__InfluenzaA__AJJ99628

SEQ ID NO: 195931 - RNA, 1698 nt, Artificial Sequence
  derived and/or modified sequence opt5 from hemagglutinin__InfluenzaA__AJJ99640
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaaaacuccuuuuaucgcaaucugcuuuggcugacaggcaaaaacgggcucuaccccaaucugagcaagucuuaugcuaacaacaaagagaaggaagugcugguccucuggggagugcaccacccuccgaauaucgccaaccagaaaacccuguaccauacagagaaugcuuacguguccgucguuagcucccacuauucuagaaaguucacccccgaaauugccaagcggccuaaagugcgcgaccaggagggcagaaucaacuacuauuggacgcuucuggagcccggggauacaauuaucuuugaagcgaauggaaaccucauugccccucgguacgcuuucgcccugagccgcggcuuuggguccggaaucauuaauagcaacgcucccauggacaagugugaugccaaaugccagaccccgcaaggcgcgaucaauucuucccuuccuuuccagaacgugcaucccgucacaaucggcgaguguccuaaguaugugagaagcgccaaacugcggaugguuaccgggcuccgcaauauucccucuauccagagcagaggacuguuuggcgcuguggccggguucauugaaggaggcuggaccgggauggucgacggaugguacggcuaucaccaccagaacgagcaaggcuccggguacgcugccgaucagaagucuacacagaaugccaucaacggaauuacgaauaaagugaacagcguuaucgaaaagaugaacacccaguuuacagcugugggcaaggaguucaauaaacuggagcggcgcauggaaaaccucaauaagaaagucgacgauggguucaucgacauuuggaccuacaacgcggagcugcuugugcugcucgaaaaugagagaacacuggauuuucaugacuccaacgucaagaaucuuuaugaaaaaguuaagagccaacugaagaacaaugccaaagagaucggaaacggcugcuucgaguuuuaccacaaguguaaugacgaaugcauggagucugugaaaaacgggaccuaugauuaccccaaguauuccgaagagagcaaacucaaucgggagaagauugacggcgugaagcuggaaucuaugggagucuaccagauccuggcuauuuauuccacgguggccagcucccucguucugcuugugucucugggcgccaucagcuucuggaugugcuccaacgggucucuccagugucgcaucugcauuuga

SEQ ID NO: 195932 - RNA, 1698 nt, Artificial Sequence; identical to SEQ ID NO: 186650
  derived and/or modified sequence opt5 from hemagglutinin__InfluenzaA__AJJ99652

SEQ ID NO: 195933 - RNA, 1698 nt, Artificial Sequence
  derived and/or modified sequence opt5 from hemagglutinin__InfluenzaA__AJJ99664
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaaaacucucacaaugggaaacuuugccugcucaagggaaucgcuccccugcagcugggcaacuguagcauugccggguggauccucggaaauccugagugcgaacugcuuauuuccaaagagucuuggagcuacaucguggaaaagccgaaccccgagaauggcaccuguuauccugggcauuuugccgauuacgaggaacugagagagcaacucuccucuguuagcuccuucgaacgguuugagaucuuccccaaggagagcucuuggccuaaccacacggugaccggagucuccgcuagcugcucucauaauggcgaauccagcuuuuaucgcaaccugcuuuggcugacaggcaaaaaugggcucuaccccaaccugucuaaguccuaugccaauaacaaagagaaggaagugcugguucucuggggagugcaccacccuccgaacauuggcgaccagaaagcucuguaccauaccgagaaugccuacgucagcgugguguccucucacuauagcagaaaguucacacccgaaaucgcgaagcggccuaaaguccgcgaucaggaggggagaauuaacuacuauuggacccuucuggagcccggagacacgaucauuuuugaagccaauggcaaccucaucgcuccucgguacgccuucgcucugucccgcggguuuggaagcggcauuaucaauucuaacgcccccauggauaagugugacgcgaaaugccagacaccgcaaggcgccaucaauuccagccuuccuuuccagaacguucaucccgugaccauuggggaguguccuaaguaugugagaucugcuaaacugcggauggucacaggacuccgcaauauccccagcauucaguccagaggccuguuuggggccaucgcuggauucauugaaggcggguggaccggaaugguggauggcugguacggcuaucaccaccagaacgagcaagggucuggauacgccgccgaccaaaagagcacccagaaugcuaucaacggcaucacaaauaaaguuaacuccgugauugaaaagaugaauacgcaguuuaccgcggucgggaaggaguucaacaaacuggagcggcgcauggaaaaccucaauaagaaaguggaugacggauucaucgauauuuggacauacaacgccgagcugcuuguucugcucgaaaaugagagaacccuggacuuucaugacagcaacgugaagaaucuuuaugaaaaagucaagucucagcugaagaacaaugcuaaagagaucggcaacgggugcuucgaguuuuaccacaaguguaaugaugaaugcauggaguccgugaaaaacggcacauaugacuaccccaaguauagcgaagagucuaaacucaaucgggagaagauugauggagucaagcuggaauccaugggcguguaccagauccuggccaucuauagcaccguugccuccucucucgugcugcuugucagccugggggcuauuuccuucuggaugugcucuaacggaagccuccagugucgcaucugcauuuga

SEQ ID NO: 195934 - RNA, 1701 nt, Artificial Sequence
  derived and/or modified sequence opt5 from hemagglutinin__InfluenzaA__AJJ99675
augaaggccauccugcucgugcugcuuuacaccuucgcuacagccaaagcggacacgcugugcauuggcuaucacgcuaacaauagcaccgauacagucgacaccguucucgagaagaacgugacagugacccauuccgucaaucugcuugaagauaaacacaacgggaagcuguguaaacucagaggaguggcgccccugcaucugggcaagugcaauaucgccggguggauucucggaaacccugagugugaaucucugagcacagcuuccucuuggagcuacaucguugagaccuccucuagcgacaauggcacgugcuauccgggggauuuuauuaacuacgaagaacuucgggagcagcuguccagcgugucuuccuucgaacgcuuugagaucuuccccaagaccagcucuuggccuaaucacgacuccaacaaaggagucacagccgcuugucccagagccggcgccaagagcuuuuauaaaaaucucaucuggcuggugaagaaaggcaacucuuacccuaaacuuuccaagagcuauauuaaugauaaggggaaggaaguucuggugcucuggggaauccaucaccccuccaccacagccgaccaacagucucuguaccagaacgcugaugccuacgucuucgugggcaccagccgguauuccaaaaaguuuaaaccugagauugcuauccgcccgaaggugagagaccaggaggggcggaugaauuacuauuggacgcuggucgaacccggagauaaaauuacauucgaggccaccggcaaccuccugguuccucgcuacgcguuugccauggaaagaaacgcugggagcggaaucauuaucucugacacacccgugcacgauugcaauaccaccugucaaacaccuaagggcgccaucaacacgucccuucccuuccagaauauucauccgaucaccauuggcaagugcccuaaauaugucaagagcacaaaacugcggcucgcuaccgggcugcgcaacgugcccucuauccagagcagaggacuuuuuggcgccauugccggguucaucgagggaggcuggacagggaugguggacggaugguacggcuaucaccaucagaaugaacaaggcuccggguacgcugcggaccugaagucuacccagaacgccaucgauaaaauuacggacaagguuaauagcgugaucgagaagaugaacacacaguuuaccgcugucggaaaagaguucaaucaccucgaaaagcggauugagaaccugaauaaaaagguggaugacggcuuccuggauaucuggaccuacaacgccgaacuccugguucuucuggagaaugaacgcacacucgacuaucacgauuccaacgugaaaaaucuguacgagaaggucagaaaccagcuuaagaacaaugccaaagagauugggaacggauguuuugaguucuaucauaagugcgacaauaccuguauggagagcgugaaaaacggcacauacgauuauccuaaguacucugaagaggcuaaacugaaucgggaagagaucgacggggucaagcucgaguccacgcgcaucuaucaaauucuggccaucuacagcaccguggcgucuucccugguucucguggucagccugggcgcuauuuccuuuuggaugugcucuaacggaagccuucagugcagaaucuguauuuga

SEQ ID NO: 195935 - RNA, 1701 nt, Artificial Sequence
  derived and/or modified sequence opt5 from hemagglutinin__InfluenzaA__AJJ99686
augaccgccauccugcucgugcugcuuuacacauucgcuacggccaacgcggacacccugugcauuggcuaucacgcuaauaacagcacagauaccgucgacacaguucucgagaagaaugugaccgugacacauuccgucaaccugcuugaagauaaacacaaugggaagcuguguaaacucagaggaguggcgccccugcaucugggcaagugcaacaucgccggguggauucucggaaauccugagugugaaucucugagcaccgcuuccucuuggagcuacaucguugagacguccucuagcgacaacgggaccugcuauccgggcgauuuuauuaauuacgaagaacuucgggagcagcuguccagcgugucuuccuucgaacgcuuugagaucuuccccaaaacaagcucuuggccuaaccacgacuccaauaagggagucaccgccgcuugucccagagccggcgccaagagcuuuuauaaaaaccucaucuggcuggugaagaaaggcaauucuuacccuaaacuuuccaagagcuauauuaacgauaaggggaaggaaguucuggugcucuggggaauccaucaccccuccacaaccgccgaccaacagucucuguaccagaaugcugaugccuacgucuucgugggcacgagccgguauuccaaaaaguuuaaaccugagauugcuauccgcccgaaggugagagaccaggaggggcggaugaacuacuauuggacacuggucgaacccggagauaaaauuaccuucgaggccacaggcaaccuccugguuccucgcuacgcguuugccauggaaagaaaugcugggagcggaaucauuaucucugacacccccgugcacgauugcaacaccacaugucaaacgccuaagggcgccaucaauaccucccuucccuuccagaacauucauccgaucacaauuggcaaaugcccuaaguaugucaagagcaccaaacugcggcucgcuacagggcugcgcaaugugcccucuauccagagcagaggacuuuuuggcgccauugccggguucaucgagggaggcuggaccgggaugguggacggaugguacggcuaucaccaucagaacgaacaaggcuccggguacgcugcggaccugaagucuacgcagaaugccaucgauaaaauuacaaacaagguuaauagcgugaucgagaaaaugaacacccaguuuaccgcugucggaaaggaguucaaucaccucgaaaagcggauugagaaccugaauaaaaagguggacgauggcuuccuggacaucuggacauacaacgccgaacuccugguucuucuggagaaugaacgcacccucgauuaucacgacuccaacgugaaaaaccuguacgagaaggucagaaaucagcuuaaaaacaaugccaaggagauugggaacggauguuuugaguucuaucauaagugcgauaauacauguauggagagcgugaaaaacggcacguacgacuauccuaaguacucugaagaggcuaaacugaaucgggaagagaucgauggggucaagcucgaguccacccgcaucuaucaaauucuggccaucuacagcacaguggcgucuucccugguucucguggucagccugggcgcuauuuccuuuuggaugugcucuaacggaagccuucagugcagaaucuguauuuga

SEQ ID NO: 195936 - RNA, 1701 nt, Artificial Sequence
  derived and/or modified sequence opt5 from hemagglutinin__InfluenzaA__AJJ99697
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccacagccgaucaacagucucucuaccagaacgcugacaccuacguguucgugggcacgagcagauauuccaagaaauuuaagccugagauugccauccggccgaaaguccgcgaucaggaggggagaaugaauuacuauuggacacugguugaacccggagacaagauuaccuucgaggcuacaggcaaccugguggugccucgguacgccuuugucauggaacgcaacgcggggagcggaaucauuaucucugauacccccgugcaugacugcaauaccacaugucaaacgccuaaaggcgccaucaacaccucccuccccuuccagaauauucacccgaucacaauuggcaagugcccuaaguauguuaaaagcaccaagcugagacuugcuacagggcugcggaacgugcccucuauccagagccgcggacucuuuggcgccauugcuggguucaucgagggaggcuggaccgggauggucgacggaugguacggcuaucaucaccagaaugaacaaggcuccggguacgccgccgaucugaaaucuacgcagaacgcuaucgacaagauuacaaauaaagugaacagcguuaucgagaagaugaauacccaguuuaccgcggugggaaaggaguucaaccaccuugaaaagagaauugagaaucugaacaagaaagucgaugacggcuuccucgauaucuggacauacaaugccgaacugcuggugcuccuggagaacgaacggacccuugacuaucaugauuccaaugucaagaaccuguacgagaaagugcgcaaccagcucaagaauaacgcuaaggagacagggaauggauguuuugaguucuaucacaaaugcgacaacacguguauggagagcguuaagaauggcaccuacgauuauccuaaauacucugaagaggccaagcugaacagagagaaaauugacggggugaaacuugaauccacacggaucuaucaaauccuggccauuuacagcaccgucgcuucuucccucgugcugguugugagccugggcgccaucuccuuuuggaugugcucuaauggaagccuccagugccgcauuuguaucuga

SEQ ID NO: 195937 - RNA, 1701 nt, Artificial Sequence
  derived and/or modified sequence opt5 from hemagglutinin__InfluenzaA__AJJ99708
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccugaucacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacagccgaccaacagucucucuaccagaaugcugauaccuacguguucgugggcacgagcagauauuccaagaaauuuaagccugagauugccauccggccgaaaguccgcgaccaggaggggagaaugaacuacuauuggacacugguugaacccggagauaagauuaccuucgaggcuacaggcaaucugguggugccucgguacgccuuugucauggaacgcaacgcggggagcggaaucauuaucucugacacccccgugcaugacugcaacaccacaugucaaacgccuaaaggcgccaucaauaccucccuccccuuccagaacauucacccgaucacaauuggcaagugcccuaaguauguuaaaagcaccaagcugagacuugcuacagggcugcggaaugugcccucuauccagagccgcggacucuuuggcgccauugcuggguucaucgagggaggcuggaccgggauggucgauggaugguacggcuaucaucaccagaacgaacaaggcuccggguacgccgccgaccugaaaucuacgcagaaugcuaucgauaagauuacaaacaaagugaauagcguuaucgagaagaugaacacccaguuuaccgcggugggaaaggaguucaaucaccuugaaaagagaauugagaaccugaauaagaaagucgacgauggcuuccucgacaucuggacauacaacgccgaacugcuggugcuccuggagaaugaacggacccuugauuaucaugacuccaacgucaagaaucuguacgagaaagugcgcaaccagcucaagaacaaugcuaaggagacagggaacggauguuuugaguucuaucacaaaugcgauaauacguguauggagagcguuaagaacggcaccuacgacuauccuaaauacucugaagaggccaagcugaauagagagaaaauugauggggugaaacuugaauccacacggaucuaucaaauccuggccauuuacagcaccgucgcuucuucccucgugcugguugugagccugggcgccaucuccuuuuggaugugcucuaacggaagccuccagugccgcauuuguaucuga

SEQ ID NO: 195938 - RNA, 1701 nt, Artificial Sequence
  derived and/or modified sequence opt5 from hemagglutinin__InfluenzaA__AJJ99719
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaaaugcaacaucgccggguggauucugggaaauccugagugugaaucucugagcacagccuccucuuggagcuacaucguggagaccuccucuagcgacaacggcacgugcuauccgggggauuuuauugacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaggcuuuuauaagaaucuuaucuggcugguuaaaaaggggaacagcuacccuaaacucucuaaguccuauauuaaugacaagggaaaagaagugcugguccuuuggggcauccaccaccccagcaccacagccgaucaacagucccuguaccagaacgcugacaccuacguguucguggggacgucuagauauagcaagaaauuuaagccugagauugccauccggccgaaaguccgcgaucaggagggaagaaugaauuacuauuggacacucguugaacccggcgacaagauuaccuucgaggcuacagggaaccugguggugccucgguacgccuuugcgauggaacgcaacgccggauccggcaucauuaucagcgauacccccguccaugacugcaauaccacaugucaaacgccuaaaggcgcuaucaacaccucucugcccuuccagaauauucacccgaucacaauugggaagugcccuaaguaugugaaauccaccaagcucagacuggccacaggacuucggaacguucccagcauccagucucgcggccuguuuggggcuauugccggauucaucgagggcggguggaccggaaugguggacggcugguacggcuaucaucaccagaaugaacaagggagcggauacgccgcugaucucaaauccacgcagaacgcgaucgacaagauuacaaauaaagucaacucugugaucgagaagaugaauacccaguuuaccgccguuggcaaggaguucaaccaccuggaaaagagaauugagaaucuuaacaagaaaguggaugacggguuccuggauaucuggacauacaaugcugaacuccugguccugcucgagaacgaacggacccuggacuaucaugauagcaaugugaagaaccuuuacgagaaaguccgcaaccagcugaagaauaacgccaaggagauuggaaauggcuguuuugaguucuaucacaaaugcgacaacacauguauggaguccgugaagaaugggacguacgauuauccuaaauacagcgaagaggccaagcucaacagagaagagaucgagggcguuaaacuggaaucuacccggaucuaucaaauucuugcuaucuacuccacaguggccagcucucugguccucgugguuucccugggagcgauuagcuuuuggaugugcuccaauggcucucugcagugccgcaucuguauuuga

SEQ ID NO: 195939 - RNA, 1701 nt, Artificial Sequence
  derived and/or modified sequence opt5 from hemagglutinin__InfluenzaA__AJJ99730
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaaaugcaacaucgccggguggauucugggaaauccugagugugaaucucugagcacagccuccucuuggagcuacaucguggagaccuccucuagcgacaacggcacgugcuauccgggggauuuuauugacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaggcuuuuauaagaaucuuaucuggcugguuaaaaaggggaacagcuacccuaaacucucuaaguccuauauuaaugacaagggaaaagaagugcugguccuuuggggcauccaccaccccagcaccacagccgaucaacagucccuguaccagaacgcugacaccuacguguucguggggacgucuagauauagcaagaaauuuaagccugagauugccauccggccgaaaguccgcgaucaggagggaagaaugaauuacuauuggacacucauugaacccggcgacaagaucaccuucgaggcuacagggaaccugguugugccucgguacgccuuugcgauggaacgcaacgccggauccggcauuaucaucagcgauacccccgugcaugacugcaauaccacaugucaaacgccuaaaggcgcuauuaacaccucucugcccuuccagaauauccacccgauuacaaucgggaagugcccuaaguaugucaaauccaccaagcucagacuggccacaggacuucggaacgugcccagcauucagucucgcggccuguuuggggcuaucgccggauucaucgagggcggguggaccggaaugguugacggcugguacggcuaucaucaccagaaugaacaagggagcggauacgccgcugaucucaaauccacgcagaacgcgauugacaagaucacaaauaaagugaacucugucauugagaagaugaauacccaguuuaccgccgugggcaaggaguucaaccaccuggaaaagagaaucgagaaucuuaacaagaaaguugaugacggguuccuggauauuuggacauacaaugcugaacuccuggugcugcucgagaacgaacggacccuggacuaucaugauagcaaugucaagaaccuuuacgagaaagugcgcaaccagcugaagaauaacgccaaggagaucggaaauggcuguuuugaguuccaccauaaaugcgacaacacauguauggaguccgucaagaaugggacguaugauuacccuaaauauagcgaagaggccaagcucaacagagaagagaucgacggcgugaaacuggagucuacccggauuuaccaaauccuugcuauuuauuccacaguugccagcucucuggugcucgucgugucccugggagcgaucagcuuuuggaugugcuccaauggcucucugcagugccgcauuuguaucuga

SEQ ID NO: 195940 - RNA, 1701 nt, Artificial Sequence; identical to SEQ ID NO: 190066
  derived and/or modified sequence opt5 from hemagglutinin__InfluenzaA__AJJ99741

SEQ ID NO: 195941 - RNA, 1701 nt, Artificial Sequence; identical to SEQ ID NO: 186857
  derived and/or modified sequence opt5 from hemagglutinin__InfluenzaA__AJJ99752

SEQ ID NO: 195942 - RNA, 1701 nt, Artificial Sequence; identical to SEQ ID NO: 185693
  derived and/or modified sequence opt5 from hemagglutinin__InfluenzaA__AJJ99763

SEQ ID NO: 195943 - RNA, 1698 nt, Artificial Sequence
  derived and/or modified sequence opt5 from hemagglutinin__InfluenzaA__AJJ99775
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaaaacuccuuuuaucgcaaucugcuuuggcugacaggcaaaaacgggcucuaccccaaucugagcaagucuuaugcuaacaacaaagagaaggaagugcugguccucuggggagugcaccacccuccgaauaucgccgaccagaaaacccuguaccauacagagaacgcuuacguguccgucguuagcucccacuauucuagaaaguucacccccgaaauugccaagcggccuaaagugcgcgaucaggagggcagaaucaauuacuauuggacgcuucuggagcccggggacacaauuaucuuugaagcgaacggaaaucucauugccccucgguacgcuuucgcccugagccgcggcuuuggguccggaaucauuaacagcaaugcucccaccgauaagugugacgccaaaugccagacaccgcaaggcgcgaucaacucuucccuuccuuuccagaaugugcaucccgucaccaucggcgaguguccuaaguaugugagaagcgccaaacugcggaugguuaccgggcuccgcaacauucccucuauccagagcagaggacuguuuggcgcuauugccggguucaucgaaggaggcuggacagggaugguggauggaugguacggcuaucaccaccagaaugagcaaggcuccggguacgcugccgaccagaagucuacgcagaacgccauuaauggaaucaccaacaaagucaauagcgugaucgaaaagaugaacacacaguuuaccgcuguuggcaaggaguucaacaaacuggagcggcgcauggaaaaucucaacaagaaaguggaugacggguucauugauaucuggacauacaaugcggagcugcuuguccugcucgaaaacgagagaacccuggacuuucaugacuccaaugugaagaaccuuuaugaaaaagucaagagccaacugaagaauaacgccaaagagauuggaaauggcugcuucgaguuuuaccacaaguguaacgaugaaugcauggagucugugaaaaaugggacguaugacuaccccaaguauuccgaagagagcaaacucaaccgggagaagaucgauggcguuaagcuggaaucuaugggaguguaccagauucuggcuaucuauuccacagucgccagcucccucgugcugcuuguuucucugggcgccaucagcuucuggaugugcuccaaugggucucuccagugucgcauuugcaucuga

SEQ ID NO: 195944 - RNA, 1701 nt, Artificial Sequence
  derived and/or modified sequence opt5 from hemagglutinin__InfluenzaA__AJJ99786
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaauccuuuuauaagaaucugaucuggcucguuaaaaagggcaacucuuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcgaugcugggucuggaaucauuaucuccgacacccccguccaugacugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauauccccagcauucagucccgcggacucuuuggcgccaucgccggguucaucgagggaggcuggaccgggaugguugauggaugguacggcuaucaucaccagaacgaacaaggcucuggguacgcugcggaccugaaaagcacacagaaugccauugaugagaucaccaacaaggugaauagcgucauugagaaaaugaacacgcaguuuacagcugugggaaaggaguucaaucaccuugagaagagaaucgaaaaccugaauaaaaagauugacgauggcuuccucgacaucuggaccuacaacgccgagcugcugguucuccuggaaaaugagcggacccuugauuaucaugacagcaacgugaaaaaucuguacgagaagguccgcucucagcucaaaaacaacgccaaggaaaucgggaauggauguuuugaguucuaucacaagugcgauaacacauguauggaauccgugaaaaauggcaccuacgacuauccuaaguacagcgaggaagcuaaacugaacagagaggagauugauggggucaaacuugaaucuacacggaucuaucaaauucuggccaucuacuccgcgguggcuagcucccucguucugguggucucucugggcgccauuagcuuuuggaugugcuccaauggaucucuccagugccgcaucuguauuuga

SEQ ID NO: 195945 - RNA, 1698 nt, Artificial Sequence
  derived and/or modified sequence opt5 from hemagglutinin__InfluenzaA__AJJ99798
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaagaccgaaccccgagaauggcaccuguuauccugggcauuuugccgauuacgaggaacugcgggagcaacucuccucugucagcuccuucgaacgcuuugagaucuuccccaaggagagcucuuggccuaaccacacggugaccggaguuuccgccagcugcucucauaauggcgaaaacuccuuuuauagaaaucugcuuuggcugacaggcaagaacgggcucuaccccaaucugagcaaaucuuaugcuaacaacaaggagaaagaagugcugguccucuggggagugcaccacccuccgaauaucgccaaccagaagacccuguaccauacagagaaugcuuacguguccgucguuagcucccacuauucucggaaauucacccccgaaauugccaagcgcccuaaggugagagaccaggagggccggaucaacuacuauuggacgcuucuggagcccggggauacaauuauguuugaagcgaauggaaaccucaucgccccucgcuacgcuuucgcccugagcagaggcuuuggguccggaauuaucaauagcaacgcucccauggacaaaugugaugccaagugccagaccccgcaaggcgcgauuaauucuucccuuccuuuccagaacgugcaucccgucacaaucggcgaguguccuaaauaugugcggagcgccaagcugcgcaugguuaccgggcucagaaauauccccucuauucagagccggggacuguuuggcgcuaucgccggguucauugaaggaggcuggaccgggaugguggacggaugguacggcuaucaccaccagaacgagcaaggcuccggguacgcugccgaucagaaaucuacacagaaugccaucaacggaauuacgaauaaggucaacagcgugaucgaaaagaugaacacccaguuuacagcuguuggcaaagaguucaauaagcuggagcgcagaauggaaaaccucaauaaaaagguggacgauggguucaucgacauuuggaccuacaacgcggagcugcuuguccugcucgaaaaugagcggacacuggauuuucaugacuccaacgugaaaaaucuuuaugaaaaggucaaaagccaacugaagaacaaugccaaggagaucggaaacggcugcuucgaguuuuaccacaaauguaaugacgaaugcauggagucugugaagaacgggaccuaugauuaccccaaauauuccgaagagagcaagcucaaucgcgagaaaauugacggcguuaagcuggaaucuaugggaguguaccagauccuggcuauuuauuccacggucgccagcucccucgugcugcuuguuucucugggcgccaucagcuucuggaugugcuccaacgggucucuccaguguagaaucugcauuuga

SEQ ID NO: 195946 - RNA, 1698 nt, Artificial Sequence; identical to SEQ ID NO: 185512
  derived and/or modified sequence opt5 from hemagglutinin__InfluenzaA__AJJ99810

SEQ ID NO: 195947 - RNA, 1698 nt, Artificial Sequence
  derived and/or modified sequence opt5 from hemagglutinin__InfluenzaA__AJJ99822
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaagcccuguaccauaccgagaaugcuuacgugagcgucguuuccucucacuauagcagaaaguucacacccgaaauugccaagcggccuaaagugcgcgaucaggaggggagaaucaacuacuauuggacccuucuggagcccggagacacgauuaucuuugaagcgaauggcaaccucauugccccucgguacgcuuucgcccugucccgcggguuuggaagcggcaucauuaauucuaacgcucccauggauaagugugacgccaaaugccagacaccgcaaggcgcgaucaauuccagccuuccuuuccagaacgugcaucccgucaccaucggggaguguccuaaguaugugagaucugccaaacugcggaugguuacaggacuccgcaauauucccuuuauccagagcagaggccuguucggggcuauugccggauuuaucgaaggcggguggaccggaaugguggauggcugguacggcuaucaccaccagaacgagcaaggguccggauacgcugccgaccagaagucuacccagaaugccauuaacggcaucacaaauaaagucaacagcgugaucgaaaagaugaauacgcaguucaccgcuguugggaaggaguucaacaaacuggagcggcgcauggaaaaccucaauaagaaaguggaugacggauuuauugauaucuggacauacaacgcggagcugcuuguccugcucgaaaaugagagaacccuggacuuccaugacuccaacgugaagaaucuuuaugaaaaagucaagagccaacugaagaacaaugccaaagagauuggcaacgggugcuuugaguucuaccacaaguguaaugaugaaugcauggagucugugaaaaacggcacauaugacuaccccaaguauuccgaagagagcaaacucaaucgggagaagaucgauggaguuaagcuggaaucuaugggcguguaccagauucuggcuaucuauuccaccgucgccagcucccucgugcugcuuguuucucugggggccaucagcuuuuggaugugcuccaacggaucucuccagugucgcauuugcaucuga

SEQ ID NO: 195948 - RNA, 1701 nt, Artificial Sequence
  derived and/or modified sequence opt5 from hemagglutinin__InfluenzaA__AJJ99833
augaaggccauccugcucgugcugcuuuacaccuucgcuacagccaacgcggacacgcugugcauuggcuaucacgcuaauaacagcaccgauacagucgacaccguucucgagaaaaaugugacagugacccauuccgucaaccugcuugaagauaagcacaaugggaaacuguguaagcucagaggaguggcuccccugcaucugggcaaaugcaacaucgccggguggauucucggaaauccugagugugaaucucugagcacagccuccucuuggagcuacaucguugagaccuccucuagcgacaacggcacgugcuauccgggggauuuuauuaauuacgaagaacuucgggagcagcuguccagcgugucuuccuucgaacgcuuugagaucuuccccaagaccagcucuuggccuaaccacgacuccaauaagggagucacagccgcuugucccagagccggcgcgaaaucuuuuuauaagaaccucaucuggcuggugaaaaagggcaauagcuaccuuaaacuguccaagagcuauauuaacgauaaggggaaagaaguucucgugcuguggggaauccaucacccuuccaccacagccgaccaacagucucuguaccagaaugcugaugccuacgucuucgugggcaccagccgguauuccaagaaauuuaagcccgagauugcuauccgcccuaaagugagagaccaggaggggcggaugaacuacuauuggacgcucgucgaaccgggagauaagauuacauucgaggccaccggcaaccugcuuguuccccgcuacgcguuugccauggaaagaaaugcugggagcggaaucauuaucucugacacaccugugcacgauugcaacaccaccugucaaacacccaaaggcgccaucaauacgucccugccuuuccagaacauucaucccaucaccauuggcaagugcccgaaguaugugaaaagcacaaagcuccggcuggcuaccgggcuucgcaaugucccuucuauccagagcagaggacuguuuggcgccauugccggguucaucgagggaggcuggacagggaugguggacggaugguacggcuaucaccaucagaacgaacaaggcuccggguacgcugcggaccucaaaucuacccagaaugccaucgauaagauuacgaacaaaguuaauagcgugaucgagaagaugaacacacaguuuaccgcugucggaaaggaguucaaucaccuggaaaaacggauugagaaccugaauaagaaaguggacgauggcuuccucgacaucuggaccuacaacgccgaacugcuuguucugcucgagaaugaacgcacacuggauuaucacgacuccaacgugaagaaccuuuacgagaaagucagaaaucagcugaagaacaaugccaaggagauugggaacggauguuuugaguucuaucauaaaugcgauaauaccuguauggagagcgugaagaacggcacauacgacuaucccaaauacucugaagaggcuaagcucaaucgggaagagaucgauggggucaaacuggaguccacgcgcaucuaucaaauucuggccaucuacagcaccguggcgucuucccucguucugguggucagccuuggcgcuauuuccuuuuggaugugcucuaacggaagccugcagugcagaaucuguauuuga

SEQ ID NO: 195949 - RNA, 1701 nt, Artificial Sequence; identical to SEQ ID NO: 189848
  derived and/or modified sequence opt5 from hemagglutinin__InfluenzaA__AJJ99844

SEQ ID NO: 195950 - RNA, 1701 nt, Artificial Sequence
  derived and/or modified sequence opt5 from hemagglutinin__InfluenzaA__AJJ99855
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccacagccgaucaacagucucucuaccagaacgcugacaccuacguguucgugggcacgagcagauauuccaagaaauuuaagccugagauugccauccggccgaaaguccgcgaucaggaggggagaaugaauuacuauuggacacugguugaacccggagacaagauuaccuucgaggcuacaggcaaccugguggugccucgguacgccuuugcgauggaacgcaacgccgggagcggaaucauuaucucugauacccccguccaugacugcaauaccacaugucaaacgccuaaaggcgcuaucaacaccucccuccccuuccagaauauucacccgaucacaauuggcaagugcccuaaguaugugaaaagcaccaagcugagacuugccacagggcugcggaacguucccucuauccagagccgcggacucuuuggcgcuauugccggguucaucgagggaggcuggaccgggaugguggacggaugguacggcuaucaucaccagaaugaacaaggcuccggguacgccgcugaucugaaaucuacgcagaacgcgaucgacaagauuacaaauaaagucaacagcgugaucgagaagaugaauacccaguuuaccgccguuggaaaggaguucaaccaccuugagaaaagaauugagaaucugaacaagaaaguggaugacggcuuccucgauaucuggacauacaaugcugaacugcugguccuccuggagaacgaacggacccuugacuaucaugauuccaaugugaagaaccuguacgagaaaguccgcaaccagcucaagaauaacgccaaggagauugggaauggauguuuugaguucuaucacaaaugcgacagcacauguauggaaucugugaagaacggcacguacgauuauccuaaauacuccgaagaggccaagcugaauagagaagagaucgacgggguuaaacuugagagcacccggaucuaucaaauucuggcuaucuacucuacaguggccuccagccucguccuggugguuucccugggcgcgauuucuuuuuggaugugcagcaacggaucccuccagugccgcaucuguauuuga

SEQ ID NO: 195951 - RNA, 1701 nt, Artificial Sequence
  derived and/or modified sequence opt5 from hemagglutinin__InfluenzaA__AJJ99866
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugaaaggaguugcgccccuccaucugggcaagugcaacaucgccggguggauucugggaaauccugagugugaaucucucagcacagcuuccucuuggagcuacaucguggagaccuccucuagcgacaacggcacgugcuauccgggggauuuuauugacuacgaagaacugagagagcagcuuuccagcgucucuuccuucgaacgguuugagaucuuccccaagaccagcucuuggccuaaucacgauuccaacaaaggagugacagccgcuuguccccaugccggcgccaagagcuuuuauaaaaaucugaucuggcucguuaagaaaggcaacucuuacccuaagcuguccaagagcuauauuaaugacaaagggaaggaagugcuuguccuguggggaauccaccaccccuccaccucugccgaucaacagagccucuaccagaacgcugacgccuacguguucgugggcacaucccgcuauagcaaaaaguuuaaaccugagauugcuaucagaccgaagguccgggaucaggaggggcgcaugaauuacuauuggacccugguugaacccggagacaaaauuacguucgaggccacaggcaaccugguggugccuagauacgcguuugccauggaacggaacgcugggucuggaaucauuaucuccgauacccccguccaugacugcaauacaaccugucaaaccccuaagggcgccaucaacacaagccuccccuuccagaauauucacccgaucacgauuggcaagugcccuaaauaugugaagucuaccaaacugcgccuugcuacagggcugagaaacguucccagcauccagucccggggacucuuuggcgccauugccggguucaucgagggaggcuggaccgggaugguggacggaugguacggcuaucaucaccagaaugaacaaggcucuggguacgcugcggaucuuaagagcacacagaacgccaucgacgagauuaccaauaaagucaacuccgugaucgagaagaugaauacgcaguuuacagcuguuggaaaggaguucaaccaccuggagaaacgcauugaaaaucugaacaagaaaguggaugacggcuuccucgauaucuggaccuacaaugccgagcugcugguccuccuggaaaacgagagaacccuugacuaucaugauagcaaugugaagaaccuguacgagaaaguccggucucagcucaagaacaaugccaaggaaauugggaacggauguuuugaguucuaucacaaaugcgacaauacauguauggaauccgugaagaacggcaccuacgauuauccuaaauacagcgaggaagcuaagcugaaucgcgaggagaucgacgggguuaaacuugaaucuacaagaaucuaucaaauucuggccaucuacuccacgguggcgagcucccucguccuggugguuucucugggcgcuauuagcuuuuggaugugcuccaacggaucucuccagugccggaucuguauuuga

SEQ ID NO: 195952 - RNA, 1701 nt, Artificial Sequence
  derived and/or modified sequence opt5 from hemagglutinin__InfluenzaA__AJJ99877
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaagcacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcuccagcagauauucuaaaaaguuuaaaccugagauugcuauccggccgaagguccgcgaucaggaagggagaaugaauuacuauuggacacugguugagcccggagacaaaauuaccuucgaagccacgggcaaccugguggugccucgguacgcguuugccauggagcgcaacgcuggguccggaaucauuaucagcgauacacccguccaugacugcaauaccacaugucaaaccccuaagggcgccaucaacaccucucuccccuuccacaauauucauccgaucacaauuggcaaaugcccuaaguauguuaagagcacgaaacugagacuugcuaccgggcugcggaacgugcccuccauccagucucgcggacucuuuggcgccauugccggguucaucgaaggaggcuggacagggaugguggacggaugguacggcuaucaccaccagaaugagcagggcagcggguacgcugcggaucugaaguccacccaaaacgccaucgacgagauuacaaauaaagucaacagcgugaucgaaaagaugaauacccaguuuacggcuguuggaaaagaguucaaccaucuugaaaagagaauugagaaucugaacaagaaaguggaugacggcuuccucgauaucuggacauacaaugccgaacugcugguccuccuggagaacgagcggacccuugacuaucacgauucuaaugugcgcaaccuguacgaaaaggucagaucccagcucaaaaacaaugccaaggagauugggaacggauguuuugaguucuaucauaaaugcgacaauaccuguauggaaagcgugaagaacggcacauacgauuauccuaaguacucugaagaggcuaaacugaaucgggaggaaaucgacgggguuaaacuugaguccacccgcaucuaucagauucuggccaucuacagcacaguggcguccucucucguccuggugguuagccugggcgcuauuuccuuuuggaugugcucuaacggaagccuccaaugcagaaucuguauuuga

SEQ ID NO: 195953 - RNA, 1701 nt, Artificial Sequence
  derived and/or modified sequence opt5 from hemagglutinin__InfluenzaA__AJJ99888
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccuccgccgaucaacagucucucuaccagaacgcugacgccuacguguucguggggacaagcagauauuccaagaaauuuaagccugagauugcuauccggccgaaaguccgcgaucaggagggaagaaugaauuacuauuggacccugguugaacccggcgacaagauuacguucgaggccacagggaaccugguggugccucgguacgcguuugccauggaacgcgaugcuggaagcggcaucauuaucucugacacccccguccaugacugcaacacaaccugucaaaccccuaaaggcgccaucaauacaucccuccccuuccagaacauucacccgaucacgauugggaagugcccuaaguaugugaaaagcaccaagcugagacuugcuacaggacugcggaauguucccucuauccagagccgcggccucuuuggggccauugccggauucaucgagggcggguggaccggaaugguggauggcugguacggcuaucaucaccagaacgaacaaggguccggauacgcugcggaccugaaaucuacacagaaugccaucgaugagauuaccaacaaggucaauagcgugaucgagaaaaugaacacgcaguuuacagcuguuggcaaggaguucaaucaccuugagaagagaauugaaaaccugaauaaaaagaucgacgauggguuccucgacauuuggaccuacaacgccgagcugcuggugcuccuggaaaaugagcggacccuugauuaucaugacuccaacgucaaaaaucuguacgagaaggugcgcagccagcucaaaaacaacgccaaggaaaucggaaauggcuguuuugaguucuaucacaagugcgauaacacauguauggaaucugucaaaaaugggaccuacgacuauccuaaguacuccgaggaagcuaaacugaacagagaggagaucgauggcgugaaacuugaaagcacacggauuuaucaaauccuggccauuuacucuacgguugcguccagccucgugcuggucgugucccugggagcuaucucuuuuuggaugugcagcaauggcucccuccagugccgcauuuguaucuga

SEQ ID NO: 195954 - RNA, 1701 nt, Artificial Sequence
  derived and/or modified sequence opt5 from hemagglutinin__InfluenzaA__AJJ99899
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuugucccagagccggcgcgaaaucuuuuuauaagaaccugaucuggcucguuaaaaagggcaauagcuacccuaaccuguccaaaagcuauauuaaugauaaggggaaggaagugcuuguccuguggggaauccaucaccccuccaccacagccgaccaacagucucucuaccagaacgcugaugccuacguguucgugggcaccagccgguauuccaaaaaguuuaaaccugagauugcuauccgcccgaaggucagagaccaggaggggcggaugaacuacuauuggacgcugcuggaacccggagauaaaauuacauucgaggccaccggcaaucuccugguuccucgcuacgcguuugccauggaaagaaacgcugggagcggaaucauuaucucugacacacccgugcacgauugcaauaccaccugucaaacaccuaagggcgccaucaacacgucccuucccuuccagaauauucauccgaucaccauuggcaaaugcccuaaguaugucaagagcacaaaacugcggcucgcuaccgggcugcgcaacgugcccucuauccagagcagaggacuuuuuggcgccauugccggguucaucgagggaggcuggacagggaugguggacggaugguacggcuaucaccaucagaauggccaaggguccggauacgcugcggaccugaagucuacccagaacgccguugauaaaaucacgaauaaggugaacagcgucauugagaaaaugaauacacaguuuaccgcugugggcaaggaguucaaccaccucgagaagcggaucgaaaaucugaacaaaaagguugacgauggguuccuggacauuuggaccuacaaugccgagcuccuggugcuucuggaaaacgagcgcacacucgauuaucacgacuccaacgucaaaaaucuguacgaaaaggugagaaaccagcuuaaaaauaacgccaaggagaucggaaauggcuguuuugaguucuaucauaagugcgauaacaccuguauggaaagcgucaaaaaugggacauacgacuauccuaaguacucugaggaagcuaaacugaaccgggaggaaauugauggcgugaagcucgaguccacgcgcaucuaucaaauccuggccauuuacagcaccguugcgucuucccuggugcucgucgugagccugggagcuaucuccuuuuggaugugcucuaauggcagccuucagugcagaauuuguaucuga

SEQ ID NO: 195955 - RNA, 1701 nt, Artificial Sequence
  derived and/or modified sequence opt5 from hemagglutinin__InfluenzaA__AJJ99910
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccgacaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacagccgaccaacagucucucuaccagaaugcugauaccuacguguucgugggcacgagcagauauuccaagaaauuuaagccugagauugccauccggccgaaaguccgcgaccaggaggggagaaugaacuacuauuggacacugguugaacccggagauaagauuaccuucgaggcuacaggcaaucugguggugccucgguacgccuuugcgauggaacgcaacgccgggagcggaaucauuaucucugacacccccguccaugacugcaacaccacaugucaaacgccuaaaggcgcuaucaauaccucccuccccuuccagaacauucacccgaucacaauuggcaagugcccuaaguaugugaaaagcaccaagcugagacuugccacagggcugcggaauguucccucuauccagagccgcggacucuuuggcgcuauugccggguucaucgagggaggcuggaccgggaugguggauggaugguacggcuaucaucaccagaacgaacaaggcuccggguacgccgcugaccugaaaucuacgcagaaugcgaucgauaagauuacaaacaaagucaauagcgugaucgagaagaugaacacccaguuuaccgccguuggaaaggaguucaaucaccuugaaaagagaauugagaaccugaauaagaaaguggacgauggcuuccucgacaucuggacauacaacgcugaacugcugguccuccuggagaaugaacggacccuugauuaucaugacuccaacgugaagaaucuguacgagaaaguccgcaaccagcucaagaacaaugccaaggagacagggaacggauguuuugaguucuaucacaaaugcgauaauacguguauggagagcgugaagaacggcaccuacgacuauccuaaauacucugaagaggccaagcugaauagagagaaaauugaugggguuaaacuugaauccacacggaucuaucaaauccuggcuauuuacagcaccguggccucuucccucguccuggugguuagccugggcgcgaucuccuuuuggaugugcucuaacggaagccuccagugccgcauuuguaucuga

SEQ ID NO: 195956 - RNA, 1701 nt, Artificial Sequence; identical to SEQ ID NO: 189848
  derived and/or modified sequence opt5 from hemagglutinin__InfluenzaA__AJJ99921

SEQ ID NO: 195957 - RNA, 1701 nt, Artificial Sequence
  derived and/or modified sequence opt5 from hemagglutinin__InfluenzaA__AJJ99932
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcgacaucgccggguggauucugggaaacccugagugugaaucucucagcacagccuccucuuggagcuacaucguggagaccuccucuagcgauaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacagccgaccaacagucucucuaccagaaugcugaugccuacguguucgugggcaccagcagauauuccaagaaauuuaagccugagauugcuauccggccgaaaguccgcgaccaggaggggagaaugaacuacuauuggacgcugguugaacccggagauaagauuacauucgaggccaccggcaaucugguggugccucgguacgcguuugccauggaacgcaacgcugggagcggaaucauuaucucugacacacccguccaugacugcaacaccaccugucaaacaccuaaaggcgccaucaauacgucccuccccuuccagaacauucacccgaucaccauuggcaagugcccuaaguaugugaaaagcacaaagcugagacuugcuaccgggcugcggaauguucccucuauccagagccgcggacucuuuggcgccauugccggguucaucgagggaggcuggacagggaugguggauggaugguacggcuaucaucaccagaacgaacaaggcuccggguacgcugcggaccugaaaucuacccagaaugccaucgauaagauuacgaacaaagucaauagcgugaucgagaagaugaacacacaguuuaccgcuguuggaaaggaguucaaucaccuugagaaaagaauugagaaccugaauaagaaaguggacgauggcuuccucgacaucuggaccuacaacgccgaacugcugguccuccuggagaaugaacggacacuugauuaucaugacuccaacgugaagaaucuguacgagaaaguccgcaaccagcucaagaacaaugccaaggagauugggaacggauguuuugaguucuaucacaaaugcgauaauaccuguauggaaagcgugaagaacggcacauacgacuauccuaaauacucugaagaggcuaagcugaauagagaagagaucgaugggguuaaacuugaguccacgcggaucuaucaaauucuggccaucuacagcaccguggcgucuucccucguccuggugguuagccugggcgcuauuuccuuuuggaugugcucuaacggaagccuccagugccgcaucuguauuuga

SEQ ID NO: 195958 - RNA, 1701 nt, Artificial Sequence; identical to SEQ ID NO: 189478
  derived and/or modified sequence opt5 from hemagglutinin__InfluenzaA__AJJ99943

SEQ ID NO: 195959 - RNA, 1701 nt, Artificial Sequence
  derived and/or modified sequence opt5 from hemagglutinin__InfluenzaA__AJJ99954
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgggagcagcuuuccagcgucucuuccuucgaaaaguuugagaucuuccccaagaccagcucuuggccuaaucacgauuccaacaaaggagugacagccgcuuguccccaugccggcgccaagagcuuuuauaaaaaucugaucuggcucguuaagaaaggcaacucuuacccuaagcuguccaagagcuauauuaaugacaaagggaaggaagugcuuguccuguggggaauccaccaccccuccaccucugccgaucaacagagccucuaccagaacgcugacgccuacguguucgugggcacaucccgcuauagcaaaaaguuuaaaccugagauugcuaucagaccgaagguccgggaucaggaggggcgcaugaauuacuauuggacccugguugaacccggagacaaaauuacguucgaggccacaggcaaccugguggugccuagauacgcguuugccauggaacggaacgcugggucuggaaucauuaccuccgauacacccguccaugacugcaauaccaccugucaaacaccuaagggcgccaucaacacgagccuccccuuccagaauauccacccgauuaccaucggcaacugcccuaaguaugugaaaucuacaaagcugcgccuugcuaccgggcugagaaauguucccagcauucagucccggggacucuuuggcgccaucgccggguucauugagggaggcuggacagggaugguggacggaugguacggcuaucaucaccagaacgaacaaggcucuggguacgcugcggaucugaaaagcacccagaaugccaucgacaagaucacgaacaaagucaauuccgugauugagaagaugaacacacaguuuaccgcuguuggaaaggaguucaaucaccuugaaaaacgcaucgagaaccugaauaagaaaguggaugacggcuuccucgauauuuggaccuacaacgccgaacugcugguccuccuggagaaugaaagaacacuugacuaucaugauagcaacgugaagaaccuguacgagaaaguccggucucagcucaagaauaacgccaaggagaucgggaauggauguuuugaguucuaucacaaaugcgacaacaccuguauggaguccgugaagaauggcacauacgauuauccuaaauacagcgaagaggcuaagcugaaccgcgaagagauugacgggguuaaacuugagucuacgagaaucuaucaaauccuggccauuuacuccaccguggcgagcucccucguccuggugguuucucugggcgcuaucagcuuuuggaugugcuccaauggaucucuccagugccggauuuguaucuga

SEQ ID NO: 195960 - RNA, 1701 nt, Artificial Sequence; identical to SEQ ID NO: 185935
  derived and/or modified sequence opt5 from hemagglutinin__InfluenzaA__AJJ99965

SEQ ID NO: 195961 - RNA, 1698 nt, Artificial Sequence
  derived and/or modified sequence opt5 from hemagglutinin__InfluenzaA__AJJ99989
augaaggugaaacugcucguccugcuuugcaccuucacagccacguacgcugacaccaucuguauuggcuaucacgccaacaauagcacagauaccguugacacagugcuggagagaaacgugaccgucacacauuccgugaaucuccuggaaaacucucacaaugggaaacuuugccugcucaaaggaaucgcgccccugcagcugggcaacuguagcguugcuggguggauucucggaaauccugagugcgaacugcuuaucuccaaggagucuuggagcuacauuguggaaaaaccgaaccccgagaauggcaccuguuauccugggcauuuugccgauuacgaggaacugcgggagcaacucuccucugucagcuccuucgaacgcuuugagaucuuccccaaggagagcucuuggccuaaccacacggugaccggaguuuccgccagcugcucucauaauggcgaauccagcuuuuauagaaaccugcuuuggcugacaggcaagaaugggcucuaccccaaccugucuaaauccuaugcuaauaacaaggagaaagaagugcugguccucuggggagugcaccacccuccgaacaucggcgaccagaaggcccuguaccauaccgagaaugcuuacgugagcgucguuuccucucacuauagcaaaaaguucacacccgaaauugccaagcggccuaaagugcgcgaucaggaggggagaaucaacuacuauuggacccuucuggagcccggagacacgauuaucuuugaagcgaauggcaaccucauugccccucgguacgcuuucgcccugucccgcggguuuggaagcggcaucauuaauucuaacgcucccauggauaagugugacgccaaaugccagacaccgcaaggcgcgaucaauuccagccuuccuuuccagaacgugcaucccgucaccaucggggaguguccuaaguaugugagaucugccaaacugcggaugguuacaggacuccgcaauauucccagcauccaguccagaggccuguuuggggcuauugccggauucaucgaaggcggguggaccggaaugguggauggcugguacggcuaucaccaccagaacgagcaagggucuggauacgcugccgaccagcggagcacccagaaugccauuaacggcaucacaaauaaggucaacuccgugaucgaaaagaugaauacgcaguuuaccgcuguugggaaggaguucaacaagcuggagcgcagaauggaaaaccucaauaaaaagguggaugacggauucauugauaucuggacauacaacgcggagcugcuuguccugcucgaaaaugagcggacccuggacuuucaugacagcaacgugaaaaaucuuuaugaaaaggucaaaucucaacugaagaacaaugccaaggagauuggcaacgggugcuucgaguuuuaccacaaauguaaugaugaaugcauggaguccgugaagaacggcacauaugacuaccccaaauauagcgaagagucuaagcucaaucgcgagaaaaucgauggaguuaagcuggaauccaugggcguguaccagauucuggcuaucuauagcaccgucgccuccucucucgugcugcuuguuagccugggggccaucuccuucuggaugugcucuaacggaagccuccaguguagaauuugcaucuga

SEQ ID NO: 195962 - RNA, 1701 nt, Artificial Sequence
  derived and/or modified sequence opt5 from hemagglutinin__InfluenzaA__AJK00001
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuugucccagagccggcgaaaagagcuuuuauaagaaccugaucuggcucguuaaaaagggcaauucuuacccuaaacuguccaagagcuauauuaacgauaaggggaaagaggugcuuguccuguggggaauccaucaccccuccaccacagcggaccaacagucucucuaccagaaugccgaugcuuacguguucgugggcaccagccgguauuccaagaaauuuaagccugagauugccauccgcccgaaagucagagaccaggaagggcggaugaacuacuauuggacgcugguugagcccggagauaagauuacauucgaagcuaccggcaaccugcucgugccucgcuacgccuuugcgauggagagaaaugccgggagcggaaucauuaucucugacacacccgugcacgauugcaacaccaccugucaaacaccuaaaggcgcuaucaauacgucccugcccuuccagaacauucauccgaucaccauuggcaagugcccuaaguaugucaaaagcacaaaacuucggcuggccaccgggcuccgcaaugugcccucuauccagagcagaggacuguuuggcgcuauugccggguucaucgaaggaggcuggacagggaugguugacggaugguacggcuaucaccaucagaacgagcaaggcuccggguacgccgcugaccuuaaaucuacccagaaugcgaucgauaagauuacgaacaaagugaauagcgucaucgagaagaugaacacacaguuuaccgccgugggaaaggaguucaaucaccuggagaaacggauugaaaaccucaauaagaaaguugacgauggcuuccuggacaucuggaccuacaacgcugagcugcucgugcugcuugaaaaugagcgcacacuggauuaucacgacuccaacgucaagaaccucuacgagaaagugagaaaucagcugaagaacaaugccaaggaaauugggaacggauguuuugaguucuaucauaaaugcgauaauaccuguauggaaagcgucaagaacggcacauacgacuauccuaaauacucugaggaagccaaacuuaaucgggagaagaucgauggggugaagcuggaguccacgcgcaucuaucaaauucucgcuaucuacagcaccguugccucuucccuggugcuggucgugagccucggcgcgauuuccuuuuggaugugcucuaacggaagccugcagugcagaaucuguauuuga

SEQ ID NO: 195963 - RNA, 1701 nt, Artificial Sequence
  derived and/or modified sequence opt5 from hemagglutinin__InfluenzaA__AJK00012
augaaggccauccuggugguccuccugugcaccuucgcuacagccaacgcggacacgcuuuguauuggcuaccacgcuaauaacagcaccgauacaguugacaccgugcuggagaaaaaugugacagucacccauuccgugaaccuccuggaagauaagcacaaugggaaacuuugcaagcugagaggaguugcuccccuccaucugggcaaauguaacaucgccggguggauucugggaaauccugagugcgaaucucucagcacagccuccucuuggagcuauaucguggagaccuccucuagcgacaacggcacguguuacccgggggauuuuauugacuaugaagaacugcgggagcagcuuuccagcgucucuuccuucgaacgcuuugagaucuuccccaagaccagcucuuggccuaaucacgauuccaacaagggagugacagccgcuugcccccaugccggcgcgaaaggcuuuuacaagaaucugaucuggcucguuaaaaaggggaacagcuauccuaaacugucuaaguccuacauuaaugacaagggaaaagaagugcuuguccuguggggcauccaccaccccagcaccacagccgaucaacagucccucuaucagaacgcugacaccuacguguucguggggacgucuagauacagcaagaaauuuaagccugagauugccauccggccgaaaguccgcgaucaggagggaagaaugaauuauuacuggacacugguugaacccggcgacaagauuaccuucgaggcuacagggaaccugguggugccucgguaugccuuugcgauggaacgcaacgccggauccggcaucauuaucagcgauaccaccguccaugacuguaauacaacgugccaaacccccaaaggcgcuaucaacacaucucucccuuuccagaauauucaccccaucaccauugggaaguguccgaaguacgugaaauccacaaagcugagacuugccaccggacugcggaacguuccuagcauccagucucgcggccucuuuggggcuauugccggauucaucgagggcggguggacgggaaugguggacggcugguauggcuaccaucaccagaaugaacaagggagcggauaugccgcugaucugaaauccacacagaacgcgaucgacaagauuaccaauaaagucaacucugugaucgagaagaugaauacccaguuuacagccguuggcaaggaguucaaccaccuugaaaagagaauugagaaucugaacaagaaaguggaugacggguuccucgauaucuggaccuacaaugcugaacugcugguccuccuggagaacgaacggacacuugacuaccaugauagcaaugugaagaaccuguaugagaaaguccgcaaccagcucaagaauaacgccaaggagauuggagacggcugcuuugaguucuaccacaaaugugauaauacgugcauggaguccgugaagaacgggaccuaugacuaccccaaauauagcgaagaggccaagcugaauagagagaaaaucgauggcguuaaacuugaaucuacacggaucuaccaaauucuggcuaucuauuccaccguggccagcucucucguccuggugguuucccugggagcgauuagcuuuuggaugugcuccaacggcucucuccagugucgcaucugcauuuga

SEQ ID NO: 195964 - RNA, 1701 nt, Artificial Sequence
  derived and/or modified sequence opt5 from hemagglutinin__InfluenzaA__AJK00023
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuugucccagagccggcgcgaaaucuuuuuauaagaaccugaucuggcucguuaaaaagggcaauagcuacccuaaacuguccaagagcuauauuaacgauaaggggaaagaagugcuuguccuguggggaauccaucaccccuccaccacagccgaccaacagucucucuaccagaaugcugaugccuacguguucgugggcaccagccgguauuccaagaaauuuaagccugagauugcuauccgcccgaaagucagagaccaggaggggcggaugaacuacuauuggacgcugguugaacccggagauaagauuacauucgaggccaccggcaaccugcucgugccucgcuacgcguuugccauggaaagaaaugcugggagcggaaucauuaucucugacacacccgugcacgauugcaacaccaccugucaaacaccuaaaggcgccaucaauacgucccugcccuuccagaacauucauccgaucaccauuggcaagugcccuaaguaugucaaaagcacaaaacuucggcuggcuaccgggcuccgcaaugugcccucuauccagagcagaggacuguuuggcgccauugccggguucaucgagggaggcuggacagggaugguugacggaugguacggcuaucaccaucagaacgaacaaggcuccggguacgcugcggaccuuaagucuacccagaaugccaucgauaagauuacgaacaaagugaauagcgucaucgagaagaugaacacacaguuuaccgcugugggaaaggaguucaaucaccuggaaaaacggauugagaaccucaauaagaaaguugacgauggcuuccuggacaucuggaccuacaacgccgaacugcucgugcugcuugagaaugaacgcacacuggauuaucacgacuccaacgucaagaaccucuacgagaaagugagaaaucagcugaagaacaaugccaaggagauugggaacggauguuuugaguucuaucauaaaugcgauaauaccuguauggagagcgucaagaacggcacauacgacuauccuaaauacucugaagaggcuaaacuuaaucgggaagagaucgauggggugaagcuggaguccacgcgcaucuaucaaauucucgccaucuacagcaccguugcgucuucccuggugcuggucgugagccucggcgcuauuuccuuuuggaugugcucuaacggaagccugcagugcagaaucuguauuuga

SEQ ID NO: 195965 - RNA, 1701 nt, Artificial Sequence; identical to SEQ ID NO: 189848
  derived and/or modified sequence opt5 from hemagglutinin__InfluenzaA__AJK00034

SEQ ID NO: 195966 - RNA, 1701 nt, Artificial Sequence; identical to SEQ ID NO: 190066
  derived and/or modified sequence opt5 from hemagglutinin__InfluenzaA__AJK00045

SEQ ID NO: 195967 - RNA, 1701 nt, Artificial Sequence; identical to SEQ ID NO: 190066
  derived and/or modified sequence opt5 from hemagglutinin__InfluenzaA__AJK00056

SEQ ID NO: 195968 - RNA, 1701 nt, Artificial Sequence; identical to SEQ ID NO: 185935
  derived and/or modified sequence opt5 from hemagglutinin__InfluenzaA__AJK00067

SEQ ID NO: 195969 - RNA, 1698 nt, Artificial Sequence
  derived and/or modified sequence opt5 from hemagglutinin__InfluenzaA__AJK00079
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaaaacuccuuuuaucgcaaucugcuuuggcugacacggaaaaacggccucuaccccaaucugagcaagucuuaugcuaacaacaaagagaaggaagugcugguccucuggggagugcaccacccuccgaauaucgccgaccagaaaacccuguaccauacagagaacgcuuacguguccgucguuagcucccacuauucuagaaaguucacccccgaaauugccaagcgcccuaaagugagagaucaggaggggcggaucaauuacuauuggacgcuucuggagcccggcgacacaauuaucuuugaagcgaacgggaaucucauugccccucgcuacgcuuucgcccugagcagaggauuuggcuccgggaucauuaacagcaaugcucccauggauaagugugacgccaaaugccagaccccgcaaggagcgaucaacucuucccuuccuuuccagaaugugcaucccgucacaaucggcgaguguccuaaguaugugcggagcgccaaacugcgcaugguuaccggccucagaaacauucccucuauccagagccgggggcuguuuggagcuauugccggcuucaucgaagggggauggaccggcaugguggaugggugguacggauaucaccaccagaaugagcaaggcuccggcuacgcugccgaccagaagucuacacagaacgccauuaaugggaucacgaacaaagucaauagcgugaucgaaaagaugaacacccaguuuacagcuguuggaaaggaguucaacaaacuggagcgcagaauggaaaaucucaacaagaaaguggaugacggcuucauugauaucuggaccuacaaugcggagcugcuuguccugcucgaaaacgagcggacacuggacuuucaugacuccaaugugaagaaccuuuaugaaaaagucaagagccaacugaagaauaacgccaaagagauugggaauggaugcuucgaguuuuaccacaaguguaacgaugaaugcauggagucugugaaaaauggcaccuaugacuaccccaaguauuccgaagagagcaaacucaaccgcgagaagaucgaugggguuaagcuggaaucuaugggcguguaccagauucuggcuaucuauuccacggucgccagcucccucgugcugcuuguuucucugggagccaucagcuucuggaugugcuccaauggcucucuccaguguagaauuugcaucuga

SEQ ID NO: 195970 - RNA, 1698 nt, Artificial Sequence
  derived and/or modified sequence opt5 from hemagglutinin__InfluenzaA__AJK00091
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacgaucaccggaguguccgccagcugcucucauaauggcgaauccagcuuuuaucgcaaccugcuuuggcugacaggcaaaaaugggcucuaccccaaccugucuaaguccuaugcuaauaacaaagagaaggaaguucuggugcucuggggaguccaccacccuccgaacauuggcgugcagaaagcccuguaccauaccgagaaugcuuacgugagcgucguuuccucucacuauagcagaaaguucacacccgaaaucgccaagcggccuaaagugcgcgaccaggaggggagaauuaacuacuauuggacccuucuggagcccggagauacgaucauuuuugaagcgaauggcaaccucaucgccccucgguacgcuuucgcccugucccgcggguuuggaagcggcauuaucaauucuaacgcucccauggacaagugugaugccaaaugccagacaccgcaaggcgcgaucaauuccagccuuccuuuccagaacgugcaucccgucaccauuggggaguguccuaaguaugugagaucugccaaacugcggaugguuacaggacuccgcaauauccccagcauucaguccagaggccuguuuggggcuaucgccggauucauugaaggcggguggaccggaaugguggacggcugguacggcuaucaccaccagaacgagcaagggucuggauacgcugccgaucaaaagagcacccagaaugccaucaacggcaucacaaauaaagucaacuccgugauugaaaagaugaauacgcaguuuaccgcuguugggaaggaguucaacaaacuggagcggcgcauggaaaaccucaauaagaaaguggacgauggauucaucgacauuuggacauacaacgcggagcugcuuguccugcucgaaaaugagagaacccuggauuuucaugacagcaacgugaagaaucuuuaugaaaaagucaagucucagcugaagaacaaugccaaagagaucggcaacgggugcuucgaguuuuaccacaaguguaaugacgaaugcauggaguccgugaaaaacggcacauaugauuaccccaaguauagcgaagagucuaaacucaaucgggagaagauugacggaguuaagcuggaauccaugggcguguaccagauccuggcuaucuauagcaccgucgccuccucucucgugcugcuuguuagccugggggccguguccuucuggaugugcucuaacggaagccuccagugucgcgucugcauuuga

SEQ ID NO: 195971 - RNA, 1698 nt, Artificial Sequence; identical to SEQ ID NO: 185512
  derived and/or modified sequence opt5 from hemagglutinin__InfluenzaA__AJK00103

SEQ ID NO: 195972 - RNA, 1701 nt, Artificial Sequence; identical to SEQ ID NO: 189944
  derived and/or modified sequence opt5 from hemagglutinin__InfluenzaA__AJK00114

SEQ ID NO: 195973 - RNA, 1701 nt, Artificial Sequence
  derived and/or modified sequence opt5 from hemagglutinin__InfluenzaA__AJK00125
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagagagguugcuccccuccaucugggaaaaugcaacaucgccggcuggauucuggggaauccugaaugugagucucucagcacagccuccucuuggagcuacaucguggaaaccuccucuagcgacaacggaacgugcuauccgggcgauuuuauugacuacgaggagcugcgggaacagcuuuccagcgucucuuccuucgagcgcuuugaaaucuuccccaagaccaauagcuggccuaaccacgauucuaauaagggggugacagccgcuuguccccaugccggagcgaaauccuuuuauaagaaccugaucuggcucguuaaaaagggcaauagcuacccuaaacugucuaaguccuauauuaacgacaagggcaaagaggugcuuguccugugggggauccaccaccccagcaccuccgccgaucaacagucucucuaccagaaugcugacgccuacguguucgugggaacaagcagauauuccaagaaauuuaagccugagauugcuauccggccgaaaguccgcgaucaggaaggcagaaugaacuacuauuggacccugguugagcccggggacaagauuacguucgaagccacaggaaaccugguggugccucgguacgcguuugccauggagcgcaaugcuggcagcgggaucauuaucucugauacccccgucuaugacugcaacacaaccugucaaaccccuaaaggagccaucaauacaucccuccccuuccagaacauucauccgaucacgauuggcaagugcccuaaguacgugaaaagcaccaagcugagacuugcuacaggccugcggaauguucccucuauccagagccgcgggcucuuuggagccauugccggcuucaucgaagggggauggaccggcaugguggacgggugguauggauaccaccaucagaacgagcaaggcuccggcuacgcugcggaucugaaaucuacacagaaugccaucgacgagauuaccaacaaggucaauagcgugaucgaaaagaugaacacgcaguuuacagcuguugggaaagaguucaaucaccuugaaaagagaauugagaaccugaauaaaaagguggaugacggauuccucgauaucuggaccuauaacgccgaacugcugguccuccuggagaaugagcggacccuugacuaccacgauuccaacgugaaaaaccuguaugaaaagguccgcagccagcucaaaaauaacgccaaggagauuggcaauggguguuuugaguucuaccauaagugcgacaacacauguauggaaucugugaaaaauggaaccuaugauuacccuaaguauuccgaagaggcuaaacugaacagagagaagaucgacggcguuaaacuugaaagcacacggaucuaccaaauucuggccaucuacucuacgguggcguccagccucguccuggugguuucccugggggcuauuucuuuuuggaugugcagcaauggcucccuccagugccgcaucuguauuuga

SEQ ID NO: 195974 - RNA, 1701 nt, Artificial Sequence; identical to SEQ ID NO: 185693
  derived and/or modified sequence opt5 from hemagglutinin__InfluenzaA__AJK00136

SEQ ID NO: 195975 - RNA, 1704 nt, Artificial Sequence
  derived and/or modified sequence opt5 from hemagglutinin__InfluenzaA__AJK00166
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggagaaaacacacaaugggaagcucugugaucuggacggagugaaaccccuuauccugagagauugcagcguugcgggcuggcuccuggggaacccuaugugugacgaguucaucaaugugccggaaugguccuauauugucgagaaggcuaaccccgccaaugaucugugcuacccuggaaacuuuaaugacuaugaggaacucaagcaucugcuuucucggaucaaccacuucgagaaaauucagaucauucccaagagcuccuggucugaucaugaagccagcuccggcgugagcucugcuuguccuuaccaggggaaacccuccuuuuuccgcaauguuguguggcugaucaagaaaaacaauaccuauccuacaauuaagagaagcuacaacaauaccaaccaagaggaccuccugauccuuuggggaauccaccacucuaacgaugccgcugagcagacaaagcuguaucagaauccgaccacguacauuuccgucggcaccagcacacucaaccagcggcuggugcccaaaaucgccacccgcucuaaggugaauggccaauccgggagaauggacuuuuucuggacaauucugaaaccuaacgaugcgaucaauuuugaaagcaacggaaauuucauugcccccgaguacgcuuauaagaucgucaaaaagggcgacuccgccaucaugaaaucugaaguugaguacgggaacugcaauaccaagugucagacgccuauuggagcuaucaacagcuccaugcccuuucauaauauucacccgcucacaaucggcgaaugcccuaaguaugugaaaagcaacaagcuggugcuugccaccgggcugcgcaauucuccccuccgggagagacggcgcaaaagaggacuguucggcgcgauugccggcuuuaucgaagggggauggcagggcauggucgacgggugguacggauaucaucacuccaacgaacagggcagcggguacgcugccgauaaggagucuacacaaaaagcuaucgacggagugaccaauaagguuaacagcauuaucgauaagaugaacacccaguucgaagccgugggccgggaguuuaauaaccuugaacgcagaauugagaaucugaacaaaaagauggaggacggcuuccucgaugucuggacauauaaugccgaacugcuggugcucauggagaacgaacggacgcuggacuuccacgauuccaauguuaaaaaccuuuacgacaaggugcgccugcagcucagagauaaugcuaaagagcuggggaacggauguuuugaguucuaccauaagugcgacaaugaauguauggagucuguccggaacggcaccuaugauuacccucaauauagcgaagaggcgagacuuaagcgcgaagagaucuccggggugaaacuggagagcauuggaacauaccagauccucucuauuuauuccaccgucgccagcucucuggcucuggccaucaugguggccggccucucccuguggaugugcagcaaugggucccuucagugccggaucuguauuuga

SEQ ID NO: 195976 - RNA, 1707 nt, Artificial Sequence
  derived and/or modified sequence opt5 from hemagglutinin__InfluenzaA__AJK00177
auggagaagaucgugcugcuccuggccgucguuagccuugugagauccgaccagauuugcaucggcuaccacgcuaacaauucuaccgaacaaguggauacaauuauggagaaaaacgucacggugacccaugcccaggacauccuggaaaagacacacaaugggaaacucugugaucuggacggaguuaagccccuuauucugcgggauugcagcguggcgggcuggcuccuggggaacccuaugugugacgaguucaucaaugucccggaaugguccuauaucguggagaaagcuaaccccgccaaugaucugugcuacccuggaaaccucaaugacuaugaggaacugaagcaucuucugucucgcauuaaccacuuugagaagauccagauuauccccaaaagcuccuggucugaucaugaagccagccucggcguuuccagcgcuuguccuuaccaggggacccccucuuucuuuagaaauguggucuggcugauuaagaaaaacaauacauauccuaccaucaagcgguccuacaacaauacaaaccaagaggaccuucugauucucuggggaauccaccacagcaacgaugaggccgaacagaucaaacuguaucagaauccgaccacguacgugucugugggcaccuccacacugaaccagcgccucguccccaagauugcuaccagaagcaagguuaauggccaaucugggcggauggacuucuuuuggacaauccugaaaccugaugacgccauuaacuucgaguccaauggaaacuuuaucgcgcccgaauacgccuauaagauugugaaaaagggcgacagcgcuaucaugaaauccgagguggaauacgggaauugcaacaccaagugucagacgccuaucggagccauuaauucuagcaugcccuuccauaacauccacccgcuuacaauuggcgagugcccuaaauaugucaaguccaauaagcuggugcucgcuaccgggcugcgcaacagcccccuuagagagaaacggcgcagaaagcggggacuguuuggcgccaucgcgggcuucauugaagggggauggcagggcaugguugaugggugguacggauaucaucacucuaaugagcagggcuccggguacgccgcugacaaagaaagcacacaaaaggccaucgauggagugaccaacaaagucaauucuaucauugacaagaugaacacccaguuugaggcugugggccgcgaguucaacaaucucgaaagacggaucgagaaccugaauaagaaaauggaagauggcuuucuggacguuuggacauauaacgccgagcuccuggugcuuauggaaaaugagcgcacgcuggauuuccacgacagcaacgucaagaaucucuacgauaaagugagacugcagcuucgggacaacgccaaggaacuggggaauggauguuucgaguuuuaccauaaaugcgauaacgaguguauggaauccgucagaaauggcaccuaugacuacccucaauauucugaggaagcucgccucaagcgggaggagauuagcggggugaagcuggaauccaucggaauuuaccagauccugagcauuuauucuacaguugcguccagccucgcccuggcuaucaugguggccggccuuucucuguggaugugcuccaacgggagccuccagugcagaaucuguauuuga

SEQ ID NO: 195977 - RNA, 1704 nt, Artificial Sequence
  derived and/or modified sequence opt5 from hemagglutinin__InfluenzaA__AJK00188
auggagaagaucgugcugcuccuggccgucguuagccuugugagauccgaccagauuugcaucggcuaccacgcuaacaauucuaccgaacaaguggauacaauuauggagaaaaacgucacggugacccaugcccaggacauccuggaaaagacacacaaugggaaacucugugaucuggacggaguuaagccccuuauucugcgggauugcagcguggcgggcuggcuccuggggaacccuaugugugacgaguucaucaaugucccggaaugguccuauaucguggagaaagcuaaccccgccaaugaucugugcuacccuggaaaccucaaugacuaugaggaacugaagcaucuucugucucgcauuaaccacuuugagaagauccagauuauccccaaaagcuccuggucugaucaugaagccagccucggcguuuccagcgcuuguccuuaccaggggacccccucuuucuuuagaaauguggucuggcugauuaagaaaaacaauacauauccuaccaucaagcgguccuacaacaauacaaaccaagaggaccuucugauucucuggggaauccaccacagcaacgaugaggccgaacagaucaaacuguaucagaauccgaccacguacauuucugugggcaccuccacacugaaccagcgccucgugcccaagaucgcuaccagaagcaaggucaauggccaaucugggcggauggacuucuuuuggacaauucugaaaccugaugacgccaucaacuucgaguccaauggaaacuuuauugcgcccgaauacgccuauaagaucguuaaaaagggcgacagcgcuaucaugaaauccgagguggaauacgggaauugcaacaccaagugucagacgccuauuggagccaucaauucuagcaugcccuuccauaacauucacccgcuuacaaucggcgagugcccuaaauaugugaaguccaauaagcugguccucgcuaccgggcugcgcaacagcccccuuagagagaaacggcgcaagagaggacuguuuggcgccauugcgggcuucaucgaagggggauggcagggcaugguggaugggugguacggauaucaucacucuaaugagcagggcuccggguacgccgcugacaaagaaagcacacaaaaggccaucgauggaguuaccaacaaagucaauucuauuaucgacaagaugaacacccaguuugaggcugugggccgggaguucaacaaucucgaacgcagaauugagaaccugaauaagaaaauggaagauggcuuucuggacguguggacauauaacgccgagcuccugguucuuauggaaaaugagcggacgcuggauuuccacgacagcaacgugaagaaucucuacgauaaaguccgccugcagcuuagagacaacgccaaggaacuggggaauggauguuucgaguuuuaccauaaaugcgauaacgaguguauggaauccgugcggaauggcaccuaugacuacccucaauauucugaggaagcuagacucaagcgcgaggagaucagcggggucaagcuggaauccauuggaacauaccagauccugagcauuuauucuaccguggcguccagccucgcccuggcuaucaugguugccggccuuucucuguggaugugcuccaacgggagccuccagugccggaucuguauuuga

SEQ ID NO: 195978 - RNA, 1704 nt, Artificial Sequence
  derived and/or modified sequence opt5 from hemagglutinin__InfluenzaA__AJK00207
auggagaagaucgugcugcuccuggccauugucagccuuguuagauccgaccagaucugcauuggcuaccacgcuaacaauucuaccgaacaaguggauacaaucauggagaaaaacgugacggucacccaugcccaggacauucuggaaaagacacacaaugggaaacucugugaucuggacggagugaagccccuuauccugcgggauugcagcguugcgggcuggcuccuggggaacccuaugugugacgaguucaucaaugugccggaaugguccuauauugucgagaaagcuaaccccgccaaugaucugugcuacccuggaaacuuuaaugacuaugaggaacucaagcaucugcuuucucgcaucaaccacuucgagaagauucagaucauucccaaaagcuccuggucugaucaugaagccagcuccggcgugagcucugcuuguccuuaccaggggacccccuccuuuuucagaaauguuguguggcugaucaagaaaaacaauacauauccuaccauuaagcggagcuacaacaauacaucucaagaggaccuccugguccuuuggggaauccaccacuccaacgaugccaccgagcagaugaaacuguaucagaacccgacgaccuacgugagcgugggcacaucuacccucaaucagcgccugguccccaagaucgcuacaagauccaagguuaacggccaaagcgggcggauggacuuuuucuggaccauucugaaauccaaugaugccaucaacuuugaaucuaauggaaacuucauugcgccugaguacgccuauaagaucgugaaaaagggcgacagcgcuauuaugaaauccgaaguggaguacgggaauugcagcacgaagugucagacacccaucggagccaucaacucuuccaugccuuuucauaauauucacccccucaccaucggcgaaugcccgaaauaugucaagagcaacaagcuggugcuugcuacagggcugcgcaauucuccucucagagagcggcgcagaaaacggggacuguucggcgccauugcgggcuuuaucgaagggggauggcagggcaugguugacgggugguacggauaucaucacagcaacgaacagggcuccggguacgccgcugauaaggagucuacccaaaaagccauugacggagugaccaauaaggucaacagcaucaucgauaaaaugaauacacaguucgaagcugugggccgcgaguuuaacaaccuugaaagacggauugagaaucugaacaagaagauggaggacggcuuccucgauguuuggacguauaaugccgaacugcuggugcucauggagaacgaacgcacccuggacuuccacgauuccaaugucaaaaaccuuuacgacaaggugagacugcagcuccgggauaauacaaaagagcuggggaacggauguuuugaguucuaccauaagugcgacaaugaguguauggagagcgucagaaacggcaccuaugauuacccccaauauucugaagaggcccgccuuaaacgggaagagaucuccggggugaagcuggagagcauuggaacauaccagauccucucuauuuauuccaccguugcuagcucccuggcgcuggccaucaugguggcuggccucucucuguggaugugcagcaaugggucccuucagugcagaauuuguaucuga

SEQ ID NO: 195979 - RNA, 1704 nt, Artificial Sequence
  derived and/or modified sequence opt5 from hemagglutinin__InfluenzaA__AJK00218
auggagaagaucgugcuguuccucgccauugucagccugguuagauccgaccagaucugcauuggcuaccacgcuaacaauucuaccgaacaaguggauacaaucauggagaagaacgugacggucacccaugcccaggacauucuugaaaagacacacaaugggaaacugugugaucucgacggagugaagccccugauccuucgggauugcagcguugcgggcuggcugcucgggaacccuaugugugacgaguuuaucaaugugccggaaugguccuauauugucgagaaagcuaaccccgccaaugaucugugcuacccuggaaacuucaaugacuaugaggaacugaagcaucuccugucucgcaucaaccacuuugagaagauuagaaucauucccaaaagcuccuggccugaucaugaagccucuagcggcguguccagcgcuugucccuaccaggggaccccuucuuucuuucggaauaucguuuggcuuauuaagaaaaacaauacauauccgaccaucaagcgcuccuacaacaauacaagccaggaggaccugcucgugcuguggggaauccaccacucuuccgaugccaccgagcaaauuaaacuuuaucagaaccccacgaccuacgucagcgugggcacaucuacccugaaccagagacucgugccuaagaucgcuacacgguccaaggucaauggccagagcgggcgcauggacuucuuuuggaccauucugaaauccaacgaugccaucaauuucgaaucuaacggaaauuuuauugcgcccgaguacgccuauaagaucguuaaaaagggcgacagcgcuaucaugaaauccgaaguggaguacgggaacugcagcacgaagugucaaacaccuauuggagccaucaauucuuccaugcccuuccauaacauucacccgcugaccaucggcgaaugcccuaaauaugucaagagcaauaagcucgugcuggcuacagggcuuagaaacucuccccugcgggagcgcagacggaaacgcggacucuuuggcgccauugcgggcuucaucgaagggggauggcagggcaugguggacgggugguacggauaucaucacagcaaugagcagggcuccggguacgccgcugauaaggagucuacccagaaagccaucgacggaguuaccaacaaggugaauagcauuaucgauaaaaugaacacacaauuugaagcugucggcagagaguucaauaaccuggaacggcgcauugagaaccuuaauaagaagauggaggacggcuuccuggauguguggacguauaacgccgaacuccugguucugauggagaaugaaagaacccucgacuuucacgauuccaacgugaaaaaucuguacgacaagguccggcuucagcugagagauaacgccaaagagcucgggaauggauguuucgaauuuuaccauaagugcgacaacgaguguauggagagcgugcgcaauggcacauaugauuacccucaguauucugaagaggcucggcugaaaagagaagagaucuccggggucaaacuugagagcauuggaaccuaccaaauccugucuauuuauuccacagcggccagcucccucgcucuggccaucaugguggccggccugucucucuggaugugcagcaacgggucccugcagugccgcaucuguauuuga

SEQ ID NO: 195980 - RNA, 1704 nt, Artificial Sequence
  derived and/or modified sequence opt5 from hemagglutinin__InfluenzaA__AJK00239
auggagaagaucgugcugcuccuggccauugucagccuuguuagauccgaccagaucugcauuggcuaccacgcuaacaauucuaccgaacaaguggauacaaucauggagaaaaacgugacggucacccaugcccaggacauucuggaaaagacacacaaugggaaacucugugaucuggacggagugaagccccuuauccugcgggauugcagcguugcgggcuggcuccuggggaacccuaugugugacgaguucaucaaugugccggaaugguccuauauugucgagaaagcuaaccccgccaaugaucugugcuacccuggaaacuuuaaugacuaugaggaacucaagcaucugcuuucucgcaucaaccacuucgagaagauucagaucauucccaaaagcuccuggucugaucaugaagccagcuccggcgugagcucugcuuguccuuaccaggggacccccuccuuuuucagaaauguuguguggcugaucaagaaaaacaauacauauccuaccauuaagcggagcuacaacaauacaucucaagaggaccuccugguccuuuggggaauccaccacuccaacgaugccaccgagcagaugaaacuguaucagaacccgacgaccuacgugagcgugggcacaucuacccucaaucagcgccugguccccaagaucgcuacaagauccaagguuaacggccaaagcgggcggauggacuuuuucuggaccauucugaaauccaaugaugccaucaacuuugaaucuaauggaaacuucauugcgccugaguacgccuauaagaucgugaaaaagggcgacagcgcuauuaugaaauccgaaguggaguacgggaauugcagcacgaagugucagacacccaucggagccaucaacucuuccaugccuuuucauaauauucacccccucaccaucggcgaaugcccgaaauaugucaagagcaacaagcuggugcuugcuacagggcugcgcaauucuccucucagagagcggcgcagaaaacggggacuguucggcgccauugcgggcuuuaucgaagggggauggcagggcaugguugacgggugguacggauaucaucacagcaacgaacagggcuccggguacgccgcugauaaggagucuacccaaaaagccauugacggagugaccaauaaggucaacagcaucaucgauaaaaugaauacacaguucgaagcugugggccgcgaguuuaacaaccuugaaagacggauugagaaucugaacaagaagauggaggacggcuuccucgauguuuggacguauaaugccgaacugcuggugcucauggagaacgaacgcacccuggacuuccacgauuccaaugucaaaaaccuuuacgacaaggugagacugcagcuccgggauaaugccaaagagcuggggaacggauguuuugaguucuaccauaagugcgacaaugaguguauggagagcgucagaaacggcacauaugauuacccccaauauucugaagaggcucgccuuaaacgggaagagaucuccggggugaagcuggagagcauuggaaccuaccagauccucucuauuuauuccacaguugcgagcucccuggcccuggcuaucaugguggccggccucucucuguggaugugcagcaaugggucccuucagugcagaauuuguaucuga

SEQ ID NO: 195981 - RNA, 1704 nt, Artificial Sequence
  derived and/or modified sequence opt5 from hemagglutinin__InfluenzaA__AJS18468
auggagaagaucgugcugcuccuggccgucguuagccuugugaaauccgaccagauuugcaucggcuaccacgcuaacaauucuaccgaacaaguggauacaauuauggagaagaacgucacggugacccaugcccaggacauccuggagaaaacacacaaugggagacucugugaucugaacggaguuaagccccuuauucugaaagacugcagcguggcgggcuggcuccuggggaauccuaugugugaugaguucauccgggucccggaaugguccuauaucguggagcgcgcuaaccccgccaaugaccugugcuacccuggaaaccucaaugauuaugaggaacugaagcaucuucugucuagaauuaaccacuuugagaagacccucaucauucccaaaagcuccuggccuaaucaugaaacaucucugggcguuagcgccgcuugucccuaccagggggugccuuccuucuuucggaacgucguguggcuuaccaagaaaaaugacgccuauccgacaaucaagaugagcuacaacaauaccaaccgcgaggaucugcucauucuguggggaauccaccacucuaacaaugcugccgagcagacgaaccuguauaaaaaucccaccacauacguguccgucggcaccagcacacucaaccaaagacugguuccuaagauugcgacccggucucaggugaauggccagcgcgggagaauggacuucuuuuggacgauccuuaagcccaacgaugccauccauuucgaauccaauggaaacuuuauugcuccugaguacgccuauaaaaucgugaagaaaggcgacagcacaauuaugaagucugaaauggaguacgggcacugcaauaccaaaugucagacacccaucggagcuauuaacuccagcaugccguuccauaauauccacccucugaccaucggcgaaugccccaaguaugucaaauccaacaagcucgugcuggccaccgggcuucgcaauucuccucugcgggagagacggcgcaagagaggacucuuuggcgcgauugccggcuucaucgaagggggauggcaaggcaugguugaugggugguacggauaucaccauagcaacgaacagggcuccggguacgcugccgaccgggagagcacacagaaagcuauugacggagugacgaauaaggucaacucuaucauugauaaaaugaacacccaguuugaagccgugggccgcgaguucaauaaccuggaaagacggaucgagaaucugaacaagaaaauggaggacggcuuucucgauguuuggacauauaaugccgaacugcuugugcugauggagaacgaaagaacccucgacuuccacgauuccaaugucaagaaccuguacgacaaggugcgccuucaacugcgggauaaugcuaaagagcucgggaacggauguuucgaauuuuaccauaagugcgacaaugaguguauggagagcgucagaaacggcacauaugauuacccccaguauucugaagaggcgcgccugaaacgggaagagaucagcggggugaagcuggaguccauuggaaccuaccagauccucucuauuuauagcacgguugccuccagccugacacuugcuaucauuguggccggccugucucucuggaugugcuccaaugggagccugcaaugcagaaucuguauuuga

SEQ ID NO: 195982 - RNA, 1704 nt, Artificial Sequence
  derived and/or modified sequence opt5 from hemagglutinin__InfluenzaA__AJS18479
auggagaagaucgugcugcuccuggccgucguuagccuugugaaauccgaccagauuugcaucggcuaccacgcuaacaauucuaccgaacaaguggauacaauuauggagaagaacgucacggugacccaugcccaggacauccuggagaaaacacacaaugggagacucugugaucugaacggaguuaagccccuuauucugaaagacugcagcguggcgggcuggcuccuggggaauccuaugugugaugaguucauccgggucccggaaugguccuauaucguggagcgcgcuaaccccgccaaugaccugugcuacccuggaaaccucaaugauuaugaggaacugaagcaucuucugucuagaauuaaccacuuugagaagacccucaucauucccaaaagcuccuggccuaaucaugaaacaucucugggcguuagcgccgcuugucccuaccaggggaugccuuccuucuuucggaacguggucuggcuuaccaagaaaaaugacacauauccgaccaucaagaugagcuacaacaauacgaaccgcgaggaucugcucauucuguggggaauccaccacucuaacaaugccgcugagcagaccaaccuguauaaaaaucccacaaccuacguguccgugggcacagccacccucaaccaaagacuggucccuaagauugcgacgcggagccagguuaauggccagcgcgggagaauggacuucuuuuggacaauccuuaagcccaacgaugccauccauuucgaaucuaauggaaacuuuauugcuccugaguacgccuauaaaaucgugaagaaaggcgacuccaccauuaugaaguccgaaauggaguacgggcacugcaauacaaaaugucagacccccaucggagcuauuaacucuuccaugccguuccauaauauccacccucugaccaucggcgaaugccccaaguaugugaaaagcaacaagcucguccuggccacagggcuucggaauagcccucugcgcgagagacggcgcaagagaggacucuuuggcgcgauugccggcuucaucgaagggggauggcaaggcaugguggaugggugguacggauaucaccauucuaacgaacagggcagcggguacgcugccgaccgggaguccacgcagaaagcuauugacggaguuaccaauaaggugaacagcaucauugauaaaaugaacacacaguuugaagccgucggccgcgaguucaauaaccuggaaagacggaucgagaaucugaacaagaaaauggaggacggcuuucucgauguguggaccuauaaugccgaacugcuuguucugauggagaacgaaagaacacucgacuuccacgauucuaaugugaagaaccuguacgacaagguccgccuucaacugcgggauaaugcuaaagagcucgggaacggauguuucgaauuuuaccauaagugcgacaaugaguguauggaguccgugagaaacggcaccuaugauuacccccaguauagcgaagaggcgcgccugaaacgggaagagaucucuggggucaagcuggagagcauuggaacguaccagauccucuccauuuauucuacaguggccagcucccuggcucuugccaucauuguugccggccugagccucuggaugugcucuaaugggucccugcaaugcagaaucuguauuuga

SEQ ID NO: 195983 - RNA, 1704 nt, Artificial Sequence
  derived and/or modified sequence opt5 from hemagglutinin__InfluenzaA__AJY79339
auggagaagaucgugcugcuccuggccauugucagcaucguuaaauccgaccagauuugcaucggcuaccacgcuaacaauucuaccgaacaaguggauacaauuauggagaagaacgugacggucacccaugcccaggacauccuugaaaagacacacaaugggaagcuguguaaccucgauggagugaaaccccugauccuuagagacugcagcguugcgggcuggcugcucgggaauccuaugugugaugaguuccugaacgugccggaaugguccuauauugucgagaagaucaaucccgcuaacgaccugugcuacccuggaaaucucaacgauuaugaggaacugaagcaucuucugucucggauuaaucacuuugagaaaauccagauuauccccaaggacagcugguccgaucaugaagccucuggcgugagcuccgccuguccuuaccaggggcgcagcucuuucuuuagaaacguuguguggcucaccaaaaagaaugacgcuuaucccacaauuaaaaaguccuacaacaauaccaaccaagaggaucugcuuguccuguggggaauccaccacccuaacgacgccgcugagcagacacggcucuaucagaauccgaccacguacaucagcgugggcaccucuacacugaaccagcgccuggugcccaagauugccaccagauccaaagucaauggccaaagcgggcggauggaguucuuuuggacaauccucaagucuaacgaugcgauuaauuucgaauccaacggaaauuuuaucgccccugaaaacgcuuacaaaauuguuaagaaaggcgacagcaccaucaugaaguccgagcuggaauauucuaauugcaacacgaaaugucagacacccaucggggccauuaauagcuccaugccuuuccauaacauccacccccuuaccauuggagagugcccgaaguacgugaaaagcaaucgccuggugcucgcuacaggccugagaaacucuccucagggggagaaacggcgcaagaaaagaggacuuuuuggcgccaucgcgggcuucauugaagggggauggcagggcauggucgacgggugguauggauaccaucacuccaaugagcaaggcagcggguaugccgcugauaaggaaucuacccagcgggccaucgacggagugaccaacaaaguuaacagcaucauugauaagaugaauacacaguuugaggcugugggccgcgaguucaacaaucuggaaagacggaucgagaaccucaauaagaaaauggaagacggcuuucuggaugucuggacguacaacgccgagcugcucgugcugauggaaaaugagcgcacccuugacuuccacgauuccaacguuaagaaucuguaugacaaagugagacuccaacugcgggauaacgccaaggaacuugggaauggauguuucgaguuuuaccauagaugcgacaacgaguguauggaaucuguccgcaauggcacauacgauuauccccaguacagcgaggaagcucggcugaaaagagaggagauuuccggggugaagcucgaaagcaucggaaccuaucagauucugucuaucuacuccacagucgcgagcucucuggcccucgcuauuaugguggccggccugucccuuuggaugugcagcaacgggucccugcagugccgcaucuguaucuga

SEQ ID NO: 195984 - RNA, 1704 nt, Artificial Sequence
  derived and/or modified sequence opt5 from hemagglutinin__InfluenzaA__AJY79341
auggagaagaucgugcugcuccuggccauugucagcaucguuaaauccgaccagauuugcaucggcuaccacgcuaacaauucuaccgaacaaguggauacaauuauggagaagaacgugacggucacccaugcccaggacauccuugaaaagacacacaaugggaagcuguguaaccucgauggagugaaaccccugauccuuagagacugcagcguugcgggcuggcugcucgggaauccuaugugugaugaguuccugaacgugccggaaugguccuauauugucgagaagaucaaucccgcuaacgaccugugcuacccuggaaauuuuaacgauuaugaggaacucaagcaucugcuuucucggauuaaucacuucgagaaaauccagauuauccccaaggacagcugguccgaucaugaaaccucuggcgugagcuccgccuguccuuaccaggggcgcagcuccuuuuucagaaacguuguguggcugaccaaaaagaaugacgccuaucccacaauuaaaaagucuuacaacaauacaaaccaagaggaucuccugguccuuuggggaauccaccacccuaacgacgcugccgagcagacccggcuguaucagaauccgacgaccuacaucagcgugggcacaucuacccucaaccagcgccuggugcccaagauugcuacaagauccaaagucaauggccaaaacgggcggauggaauuuuucuggaccauccugaaaagcaaugaugccauuaacuuugagucuaauggaaacuucaucgcgccugaaaaugccuacaaaauuguuaagaaaggcgacuccacgaucaugcgcagcgagcucgaauauuccaacugcaauacaaagugucagacccccaucggggcuauuaacucuagcaugccuuuucauaauauccacccccugacaauuggagagugcccgaaauacgugaaguccaacagacuugugcuggccaccggccuccggaauagcccucagggggagaagcgccggaaaaagagaggacuguucggcgcuaucgccggcuuuauugaagggggauggcagggcauggucgacgggugguauggauaccaucacucuaacgagcaaggcuccggguaugcggccgauaaagaaagcacccagcgcgcuaucgacggagugacaaacaagguuaauucuaucauugauaaaaugaacacgcaguucgaggccgugggcagagaauuuaauaaccuugagcggcgcaucgagaaucugaacaagaagauggaagacggcuuccucgaugucuggaccuacaaugcugagcugcuggugcucauggaaaacgagagaacacuggacuuccacgauagcaauguuaaaaaccuuuaugacaaggugcggcugcaacucagagauaaugccaaagaacuggggaacggauguuuugaguucuaccaucgcugcgacaaugaguguauggaauccguccggaacggcaccuacgauuauccccaguacucugaggaagccagacuuaagcgcgaggagauuagcggggugaaacuggaauccaucggaacauaucagauucucagcaucuacucuaccgucgcuuccagccuggcgcuggccauuaugguggcuggccucucucuguggaugugcuccaaugggagccuucagugccggaucuguaucuga

SEQ ID NO: 195985 - RNA, 1704 nt, Artificial Sequence
  derived and/or modified sequence opt5 from hemagglutinin__InfluenzaA__AJY79342
auggagaagaucgugcugcuccuggccauugucagcaucguuaaauccgaccagauuugcaucggcuaccacgcuaacaauucuaccgaacaaguggauacaauuauggagaagaacgugacggucacccaugcccaggacauccuugaaaagacacacaaugggaagcuguguaaccucgauggagugaaaccccugauccuuagagacugcagcguugcgggcuggcugcucgggaauccuaugugugaugaguuccugaacgugccggaaugguccuauauugucgagaagaucaaucccgcuaacgaccugugcuacccuggaaauuuuaacgauuaugaggaacucaagcaucugcuuucucggauuaaucacuucgagaaaauccagauuauccccaaggacagcugguccgaucaugaagccucuggcgugagcuccgccuguccuuaccaggggcgcagcuccuuuuucagaaacguuguguggcugaccaaaaagaaugacgcuuaucccacaauuaaaaagucuuacaacaauaccaaccaagaggaucuccugguccuuuggggaauccaccacccuaacgacgccgcugagcagacacggcuguaucagaauccgaccacguacaucagcgugggcaccucuacacucaaccagcgccuggugcccaagauugccaccagauccaaagucaauggccaaagcgggcggauggaauuuuucuggacaauccugaagucuaacgaugcgauuaauuuugaguccaacggaaauuucaucgccccugaaaacgcuuacaaaauuguuaagaaaggcgacagcaccaucaugaaguccgagcucgaauauucuaauugcaacacgaaaugucagacacccaucggggccauuaauagcuccaugccuuuucauaacauccacccccugaccauuggagagugcccgaaguacgugaaaagcaaucgccuugugcuggcuacaggccucagaaacucuccucagggggagaaacggcgcaagaaaagaggacuguucggcgccaucgcgggcuuuauugaagggggauggcagggcauggucgacgggugguauggauaccaucacuccaaugagcaaggcagcggguaugccgcugauaaggaaucuacccagcgggccaucgacggagugaccaacaaaguuaacagcaucauugauaagaugaauacacaguucgaggcugugggccgcgaauuuaacaaucuugagagacggaucgagaaccugaauaagaaaauggaagacggcuuccucgaugucuggacguacaacgccgagcugcuggugcucauggaaaaugagcgcacccuggacuuccacgauuccaacguuaagaaucuuuaugacaaagugagacugcaacuccgggauaacgccaaggaacuggggaauggauguuuugaguucuaccauagaugcgacaacgaguguauggaaucuguccgcaauggcacauacgauuauccccaguacagcgaggaagcucggcuuaaaagagaggagauuuccggggugaagcuggaaagcaucggaaccuaucagauucucucuaucuacuccacagucgcgagcucucuggcccuggcuauuaugguggccggccucucccuguggaugugcagcaacgggucccuucagugccgcaucuguaucuga

SEQ ID NO: 195986 - RNA, 1704 nt, Artificial Sequence
  derived and/or modified sequence opt5 from hemagglutinin__InfluenzaA__AJY79343
auggagaagaucgugcugcuccuggccauugucagcaucguuaaauccgaccagauuugcaucggcuaccacgcuaacaauucuaccgaacaaguggauacaauuauggagaagaacgugacggucacccaugcccaggacauccuugaaaagacacacaaugggaagcuguguaaccucgauggagugaaaccccugauccuuagagacugcagcguugcgggcuggcugcucgggaauccuaugugugaugaguuccugaacgugccggaaugguccuauauugucgagaagaucaaucccgcuaacgaccugugcuacccuggaaauuuuaacgauuaugaggaacucaagcaucugcuuucucggauuaaucacuucgagaaaauccagauuauccccaaggacagcugguccgaucaugaagccucuggcgugagcuccgccuguccuuaccaggggcgcagcuccuuuuucagaaacguuguguggcugaccaaaaagaaugacgcuuaucccacaauuaaaaagucuuacaacaauaccaaccaagaggaucuccugguccuuuggggaauccaccacccuaacgacgccgcugagcagacacggcuguaucagaauccgaccacguacaucagcgugggcaccucuacacucaaccagcgccuggugcccaagauugccaccagauccaaagucaauggccaaagcgggcggauggaauuuuucuggacaauccugaagucuaacgaugcgauuaauuuugaguccaacggaaauuucaucgccccugaaaacgcuuacaaaauuguuaagaaaggcgacagcaccaucaugaaguccgagcucgaauauucuaauugcaacacgaaaugucagacacccaucggggccauuaauagcuccaugccuuuucauaacauccacccccugaccauuggagagugcccgaaguacgugaaaagcaaucgccuugugcuggcuacaggccucagaaacucuccucagggggagaaacggcgcaagaaaagaggacuguucggcgccaucgcgggcuuuauugaagggggauggcagggcauggucgacgggugguauggauaccaucacuccaaugagcaaggcagcggguaugccgcugauaaggaaucuacccagcgggccaucgacggagugaccaacaaaguuaacagcaucauugauaagaugaauacacaguucgaggcugugggccgcgaauuuaacaaucuugagagacggaucgagaaccugaauaagaaaauggaagacggcuuccucgaugucuggacguacaacgccgagcugcuggugcucauggaaaaugagcgcacccuggacuuccacgauuccaacguuaagaaucuuuaugacaaagugagacugcaacuccgggauaacgccaaggaacuggggaauggauguuuugaguucuaccauagaugcgacgaugaguguauggaaucuguccgcaacggcacauacgacuauccccaguacagcgaggaagcucggcuuaaaagagaggagauuuccggggugaagcuggaaagcaucggaaccuaucagauucucucuaucuacuccacagucgcgagcucucuggcccuggcuauuaugguggccggccucucccuguggaugugcagcaaugggucccuucagugccgcaucuguaucuga

SEQ ID NO: 195987 - RNA, 1704 nt, Artificial Sequence
  derived and/or modified sequence opt5 from hemagglutinin__InfluenzaA__AJY79345
auggagaagaucgugcugcuccuggccauugucagcaucguuaaauccgaccagauuugcaucggcuaccacgcuaacaauucuaccgaacaaguggauacaauuauggagaagaacgugacggucaccagagcccaggacauccuugaaaagacacauaaugggaagcuguguaaccucgauggagugaaaccccugauccuucgggacugcagcguugcgggcuggcugcucgggaauccuaugugugaugaguuccugaacgugccggaaugguccuauauugucgagaagaucaaucccgcuaacgaccugugcuacccuggaaauuuuaacgauuaugaggaacucaagcaucugcuuucucgcauuaaucacuucgagaaaauccagauuauccccaaggacagcugguccgaucacgaagccucuggcgugagcuccgccuguccuuaccaggggagaagcuccuuuuuccggaacguuguguggcugaccaaaaagaaugacgcuuaucccacaauuaaaaagucuuacaacaauaccaaccaagaggaucuccugguccuuuggggaauccaucacccuaacgacgccgcugagcagacacgccuguaucagaauccgaccacguacaucagcgugggcaccucuacacucaaccagagacuggugcccaagauugccacccgguccaaagucaauggccaaagcgggcgcauggaauuuuucuggacaauccugaagucuaacgaugcgauuaauuuugaguccaacggaaauuucaucgccccugaaaacgcuuacaaaauuguuaagaaaggcgacagcaccaucaugaaguccgagcucgaauauucuaauugcaacacgaaaugucagacacccaucggggccauuaauagcuccaugccuuuucacaacauccauccccugaccauuggagagugcccgaaguacgugaaaagcaauagacuugugcuggcuacaggccuccggaacucuccucagggggagaaacgcagaaagaaacggggacuguucggcgccaucgcgggcuuuauugaagggggauggcagggcauggucgacgggugguauggauaccaccauuccaaugagcaaggcagcggguaugccgcugauaaggaaucuacccagcgcgccaucgacggagugaccaacaaaguuaacagcaucauugauaagaugaauacacaguucgaggcugugggcagagaauuuaacaaucuugagcggcgcaucgagaaccugaauaagaaaauggaagacggcuuccucgaugucuggacguacaacgccgagcugcuggugcucauggaaaaugagagaacccuggacuuccacgauuccaacguuaagaaucuuuaugacaaagugcggcugcaacucagagauaacgccaaggaacuggggaauggauguuuugaguucuaccaccgcugcgacaacgaguguauggaaucuguccggaauggcacauacgauuauccccaguacagcgaggaagcuagacuuaaacgcgaggagauuuccggggugaagcuggaaagcaucggaaccuaucagauucucucuaucuacuccacagucgcgagcucucuggcccuggcuauuaugguggccggccucucccuguggaugugcagcaacgggucccuucagugccggaucuguaucuga

SEQ ID NO: 195988 - RNA, 1701 nt, Artificial Sequence; identical to SEQ ID NO: 195465
  derived and/or modified sequence opt5 from hemagglutinin__InfluenzaA__AKA54643

SEQ ID NO: 195989 - RNA, 1701 nt, Artificial Sequence
  derived and/or modified sequence opt5 from hemagglutinin__InfluenzaA__AKA54650
augaagaccaucauugcccugagcuacauccucugccugguguucacacagaaaauucccggcaacgacaauuccacggcuacccuuugucuggggcaccaugccgucccuaacggaacaaucguuaagaccauuacaaaugauagaaucgaggugaccaacgcgacagaacucgugcaaaauucuagcaucggcgagauuugcgacuccccgcaccagauccuggauggggaaaacuguacccuuauugacgcucugcucggagauccccagugcgacggcuuucagaauaaaaagugggaucuguucgucgagcggucuaaagccuauagcaacuguuacccuuaugacgugcccgauuacgccucccugcgcucucucguugcuagcuccgggacgcuggaauuuaauaacgagagcuucaauuggaccggagugacacaaaacggcaccucuuccgccugcaucagacggucuagcuccagcuuuuucucucgccuuaauuggcugacacaucucaacuauaaguacccugcucugaaugucaccaugcccaacaacgagcaguuugacaaacuuuauauuuggggcgugcaccauccugggacggauaaggaccagaucuuccuguacgcccaguccagcggaagaauuacaguuuccaccaagcggucucaacaggcggugaucccgaauaucggcagccgcccccggauuagagauaucccuucccgcauuagcaucuacuggacaauugucaaacccggggacauccuccugaucaacucuaccggaaaucugauugccccuagaggcuauuuuaagauccgguccgggaaaagcucuauuaugcgcagcgacgcucccaucggaaaguguaaguccgaaugcauuaccccgaacggcucuaucccuaaugauaaacccuuccagaacgugaauagaaucacauacggcgccuguccucgguaugugaagcacagcacgcucaaacuggcuaccgggaugcgcaacguccccgagaagcagacaagaggaauuuuuggcgccaucgcgggguucauugaaaauggaugggagggcaugguugacgggugguacggauuucggcaccaaaacuccgagggcagaggccaggccgcugaucuuaaaagcacccaggccgcuaucgaccaaauuaaugggaagcugaaccgccucaucggaaaaacaaaugaaaaguuccaucagauugagaaggaguucucugaaguggaaggccggauccaggaucuggagaaauauguggaggacaccaagaucgaucuuugguccuacaacgccgaacugcucgucgcccuggagaaucagcacacgauugaccugacagauagcgaaaugaacaaacucuuugagaagaccaaaaagcaacugagagaaaacgcugaggacauggggaauggaugcuucaagaucuaucauaaaugugauaacgcgugcauuggcucuauccgcaaugggaccuacgaccacaacguguaccgggacgaggcccuuaauaacagauuucagauuaagggcguugaacugaaauccggauauaaggauuggauccucuggaucagcuucgcuauuuccugcuuucugcuuuguguggcccugcucggcuucaucaugugggccugccagaaagggaauauucgcuguaacaucugcauuuga

SEQ ID NO: 195990 - RNA, 1701 nt, Artificial Sequence
  derived and/or modified sequence opt5 from hemagglutinin__InfluenzaA__AKA54651
augaagaccaucauugccuucagcugcauccugugucagauuuccgcucaaaaacuccccggcucugacaacagcauggccacacugugccuugggcaccaugcggugccuaauggaacgcuggucaagaccaucacagaugaccagauugagguuaccaacgcuacagaacucgugcaguccaccucuaaaggcgagaucuguagcuccccgcaccagauccuggaugggaagaauugcacacuuauugacgcccugcucggagauccccauugugacgauuuucaaaacaaaaagugggaccuguucguggaaagaucuaccgccuacagcaauugcuauccuuacuauguccccgauuacgcuucccugcggagccucguggccucuuccggcacgcuggaguuuacccaggaaucuuucaacuggacagggguugcucaggacggagccucuuauuccugucgcagagagagcgagaauagcuuuuucucccggcuuaacuggcuguacagccucaauuauaaguacccugcgcugaacgugaccaugcccaauaacgauaaauuugacaaacuuuacaucuggggcguccaccauccuggcacagauaaggaccagaccucccuguauauucaagccucugggcgcgugacgguuagcacaaaguggucccagcagaccgugaucccgaauauuggaagcagacccuggauccggggcgucucuuccauuaucagcaucuacuggacaauugugaaaccuggggacauccuccugauuaacucuaccggaaaucugaucgcuccccgcggcuauuucaagauucagagcgggaaguccucuaucaugagaagcgaugcccacaucggaaacugcaacuccgaauguauuaccccuaauggcagcauccccaacgacaaaccguuucaaaaugugaaccggauuacauacggcgcuugcccucgcuaugucaagcagaauacgcucaaacuggccaccgggaugagaaacguucccgagaagcagacacggggaaucuucggcgcgauugccggguuuaucgaaaauggaugggagggcaugguggaugggugguacggauuccgccaccaaaacucugagggcaccggccaggcugccgaccuuaaauccacacaggcugccaucaaucagauuaccgggaagcugaacagagugaucaaaaagacgaaugaaaaguuucaucaaauugagaaagaguucagcgaagucgaaggacggauccaggaucucgagcgcuauguggaggacacaaagauugaucuguggucuuacaacgccgaacuucugguugcucucgagaaucagcacaccaucgaccugaccgauuccgaaaugaacaaacuguucgagagaacacggaagcagcucagagaaaaugcggaggacaugggcaacggguguuuuaaaauuuaccauaagugcgauaacgccugcaucggaagcauccgcaauggcaccuaugaccacgacguguaccgggaugaggcugucaacaauagauuccaaauuaagggggugcagcugaaacuuggcuauaaggacuggauccuguggauuuccuuugccaucucuuguuuccuccugugcgccguucuucugggauuuauuaugugggcuugucagaaaggcaacauccgcugcaauaucuguauuuga

SEQ ID NO: 195991 - RNA, 1701 nt, Artificial Sequence
  derived and/or modified sequence opt5 from hemagglutinin__InfluenzaA__AKA59351
augaaggccauccuggugauucuccuguacaccuucgcugccgcgaacgcugacacaaucugcauuggcuaucacgccaauaacagcacggauaccgucgacacaguucuugagaaaaaugugaccgugacacauuccgucgaucugcucgaagacaagcacaacgggagacuguguaaacuucggggaguggcuccccugcaucucggcaagugcaauaucgccggguggauucugggaaacccugagugugaaucucugagcaccgccuccucuuggagcuacaucguugagacauccucuagcgauaaugggaccugcuauccgggcgacuuuaucgauuacgaggagcuccgcgagcagcuguccagcgugucuuccuucgaaagauuugagauuuuccccaaaacgagcucuuggccuaaccacgaauccaauaagggagucaccgcugccuguccccaagcgggcgccaagagcuuuuauaaaaaccuuaucuggcuggugaagaaagaaaauucuuacccuaagcucuccaaaagcuauauuaacgacaagggcaaggagguucuggugcuuugggggauccaucaccccuccacaucugcugaucagcagagccuguaccagaaugccgacgcuuacgucuucgugggaaccucccgguauagcaaaaaguuuaaaccugaaauugccauccgcccgaaggugagagaucaagagggccggaugaacuacuauuggacacucgucgaacccggggacaaaauuaccuucgaggcgacgggaaaucugguugugccucgcuacgccuuugcuauggaaagaaacgccggcucugggaucaucauuuccgauacacccgugcacgacugcaacaccacaugucagaccccuaagggagcuaucaauaccagccugcccuuccagaacauucauccgaucacaauuggcaaaugcccuaaguaugucaagucuacgaaacuccggcuggccaccggccuucgcaaugugcccagcauccaguccagagggcuguuuggagccaucgcuggcuucauugaagggggauggacaggcaugguugacgggugguacggauaucaccaucaaaacgagcagggcucuggcuacgcggccgaucucaagagcacccagaaugcuaucgacgaaauuacaaacaaagucaauuccgugaucgagaagaugaacacccaguuuacggccguggggaaagaguucaaucaccuggagaagcggauugaaaaccuuaauaagaaaguugaugacggauuccuggauaucuggacauacaacgccgagcuccuggugcugcucgagaaugaacgcacccuggacuaucacgauagcaacgucaagaaucuuuacgagaaagugagaucucaacugaagaacaacgcuaaagaaaucggcaauggguguuuugaguucuaucauaagugcgacaacaccuguauggaauccgucaagaauggaacauacgauuauccuaaauacagcgaggaggccaagcucaaccgggaagagauugacggcgugaaacuggaaucuacccgcaucuaucagauucuugcgaucuacuccacaguugcuagcucccuggugcucgucgugucucugggggccauuagcuuuuggaugugcuccaauggcucucugcagugcagaaucuguauuuga

SEQ ID NO: 195992 - RNA, 1701 nt, Artificial Sequence
  derived and/or modified sequence opt5 from hemagglutinin__InfluenzaA__AKA59353
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcgagugcaacaucgccggguggauucugggaaauccugaaugugagucucucagcacagcuuccucuuggagcuacaucguggaaaccccguccucuaacaauggcacgugcuaucccggggacuuuauugauuacgaggagcugcgggaacagcuuagcuccgucagcucuuucgagcgcuuugaaaucuucccuaacaccuccagcuggcccaaucacgacucuuccaaaggagugacagccgcuuguccucaugccggcgccaagagcuuuuauaagaaccugaucuggcucguuaaaaagggcaauucuuaccccaaacuguccaagagcuauauuaacgauaaagggaaggaggugcuuguccuguggggaauccaccacccuuccaccucugccgaccaacagaagcucuaccagaaugaggaugcuuacguguucgugggcacaagcagauauuccaaaaaguuuaaaccggaaauugccauccggcccaagguccgcgaccaggaggggagaaugaacuacuauuggacccugguugaaccuggagauaaaauuacguucgaggcuacaggcaacaucguggugccccgguacgccuuugcgauggaacgcaaugccgggagcggaauuaucaucucugacaccccuguccauaacugcaauacaaccugucaaacccccaagggcgcuauuaacacaucccugccguuccagaaugugcacccuaucacgauuggcaaaugccccaaguauguuaagagcaccaaacucagacuggccacagggcuucggaacgugccuucuauccagagccgcggacuguuuggcgcuauugccggguucaucgagggaggcuggaccgggauggucgauggaugguacggcuaucaucaccagaaugagcaaggcuccggguuugccgcugaccucaagucuacacagaacgcgaucgacggaauuaccaauaaagugaacagcguuaucgaaaagaugaauacgcaguucacagccgugggcaaagaguucaaccaccuggaaaagagaauugagaaucuuaaccggaagaucgaugacggguuucuggauauuuggaccuacaaugcugaacuccugauccugcucgagaacgagcgcacccuggacuaccaugauuccaacgucagaaaucuuuaugaaaaagugcggagccagcugaagaacaaugccaaagagaucggaaacggcuguuucgaauuuuaccacaagugcgacaauacauguauggagucugucaaaaacgggaccuaugauuaccccaaguauuccgaagaggccaagcucaaucgcgaggaaauugacggcgugaaacuggagagcacaagaaucuaccaaauucuugcuaucuauucuacgguugccuccagccuggugcucauugucucccugggagcgaucucuuucuggaugugcagcaacggcucccugcagugccggauuuguaucuga

SEQ ID NO: 195993 - RNA, 1701 nt, Artificial Sequence
  derived and/or modified sequence opt5 from hemagglutinin__InfluenzaA__AKA59355
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgcggagcuuuuauaaaaaucugaucuggcucguuaagaaaggcaacucuuacccuaagcugaaucaauccuauauuaacgacaaagggaaggaagugcuuguccuguggggaauccaccaucccccuaccagcgccgaucagcagucccucuaccagaaugcugacgccuacguguucgugggcacaucuagauauagcaagaaauuuaagccggagauugcuauccgccccaaagucagagaucaagaggggcggaugaacuacuauuggacccugguugaaccuggagacaagauuacguucgaggccacaggcaaccugguggugccccgcuacgcguuugccauggaaagaaaugcuggguccggaaucauuaucagcgauaccccuguccacgacugcaacacaaccugucagacccccaaaggcgccaucaauacaucucucccguuccagaacauucacccuaucacgauuggcaagugccccaaauaugugaaguccaccaagcugcggcuugcuacagggcugcgcaauguuccuagcauccagucuagaggacucuuuggcgccauugccggguucaucgagggaggcuggaccgggaugguggacggaugguacggcuaucaucaccaaaacgaacagggcagcggguacgcugcggaucugaaauccacacagaaugccaucgacgagauuaccaacaaggucaaucuugugaucgagaaaaugaacacgcaguuuacagcuguuggaaaggaguucucucaccuggagaaacggauugaaaaucucaacaagaagguggaugacggcuuccuggauaucuggaccuacaaugccgagcugcucguccugcuugaaaacgagcgcacccuggacuaucaugauagcaaugugaaaaaccucuacgagaagauuagaucccaacugaaaaacaaugccaaggaaaucgggaacggauguuuugaguucuaucacaaaugcgacaauacauguauggaaagcgucaagaacggcaccuacgauuaucccaaguacucugaggaagcuaaacuuaaucgggaggagaucgacggggugaagcuggaauccacacgcguuuaucagauucucgccaucuacagcacgguggcgucuucccugguccuggugguuagccucggcgcuauuuccuuuuggaugugcucuaacggaagccugcagugcagaaucuguauuuga

SEQ ID NO: 195994 - RNA, 1701 nt, Artificial Sequence
  derived and/or modified sequence opt5 from hemagglutinin__InfluenzaA__AKE37137
augaaggccagacuggugguccuccuguacaccuucgcuacagccaacgcggacacgcuuugcaucggcuaucacgcuaauaacagcaccgauacaguugacaccgugcuggagaaaaaugugacagucacccauuccgugaaccuccuggaagauaagcacaaugggaaacuuuguaagcugcggggaguugcuccccuccaucugggcaaaugcaacauugccggguggauccugggaaauccugagugugaaucucucagcacagccuccucuuggagcuacauuguggagaccuccucuagcgacaacggcacgugcuauccgggggauuuuaucgacuacgaagaacugcgcgagcagcuuuccagcgucucuuccuucgaaagauuugagauuuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaccuccuauaucaaugacaaggggaaggaagugcuuguccuguggggcauucaccacccuagcacauccgccgaucaacagucucucuaccagaacgcugacgccuacgcuuucgugggaaccagccgguauuccaaaaaguuuaaaccggagaucgccauucgccccaaggugagagaucgggaggggcgcaugaauuacuauuggacgcuggucgaaccuggagacaaaaucacauucgaggcgaccggcaaccugguugugcccagauacgccuuugcuauggaacggaacgccgggagcggaauuaucauuucugauacauccgugcaugacugcaauaccaccugucagacaccuaagggcgcuaucaacacgagccuccccuuccaaaauguccacccgaucaccauuggcaaaugcccuaaguaugugaagucuacaaaacugcgccuugccaccgggcugagaaacguucccagcauccagucccggggacucuuuggcgccauugcuggguucaucgagggaggcuggacagggaugguggacggaugguacggcuaucaucaccagaaugaacagggcucuggguacgcggccgaucuuaagagcacccaaaacgcuuuugacgagauuacgaauaaagucaacuccgugaucgagaagaugaauacacaguucaccgccguuggaaaagaguucaaccaccuggagaagcgcaucgaaaaucugaacaagaaaguggaugacggcuuucucgauauuuggaccuacaaugccgagcugcugguccuccuggaaaacgagagaacacuugacuaucaugauagcaaugugaagaaccuguacgagaaaguccggucucagcucaagaacaaugcuaaagaaaucgggaacggauguuucgaguuuuaucacaagugcgacaauaccuguauggaauccgugaagaacggcacauacgauuauccuaaauacagcgaggaagccaagcugaaucgcgaggagauugacgggguuaaacuugaaucuacgagaaucuaucagauucuggcgaucuacuccaccguggcuagcucccucguccuggugguuucucugggcgccaucagcuucuggaugugcuccaacggaucucuccaaugccggauuuguaucuga

SEQ ID NO: 195995 - RNA, 1701 nt, Artificial Sequence
  derived and/or modified sequence opt5 from hemagglutinin__InfluenzaA__AKS48035
auggagaagauggugcugcuccuggccgucguuagccuugugaaauccgaccagaucugcauuggcuaccacgcuaacaauucuaccgaacaaguggauacaaucauggagaagaacgucacggugacccaugcccaggacauucuggagaaaacacacaaugggagacucugugaucugaacggaguuaagccccuuauccugaaagacugcagcguggcgggcuggcuccuggggaauccuaugugugaugaguucauucgggucccggaaugguccuauaucguggagcgcgcuaaccccgccaaugaccugugcuacccuggaaaccucaaugauuaugaggaacugaagcaucuucugucuagaaucaaccacuuugagaagacccucauuauccccaaaagcuccuggccuaaucauacaucuagcggcguuuccgccgcuugucccuaccaggggaugccuagcuucuuucggaacguggucuggcugaccaagaaaaaugacgccuauccgacaauuaagaugucuuacaacaauaccuaucgcgaagaucuucugauccucuggggcauucaccacuccaacaacgcugccgagcagacgaaucuguacaaaaaccccaccacauacgugagcgugggaaccucuacacugaaucaaagacucgagccuaagaucgcgacccggucccaggucaacggccagcgcgggagaauggacuucuuuuggacgauucugaagcccaaugaugccauccauuucgaaagcaacggaaauuuuaucgcuccugaguaugccuacaaaauuguuaagaaaggcgacucuacaaucaugaaguccgaaauggaguaugggcacugcaacaccaaaugucagacacccauuggagcuaucaauagcuccaugccguuccauaacauucacccucuuaccaucggcgaaugccccaaguacgugaaaucuaauaagcuggugcucgccaccgggcugcggaacagcccucuucgcgagagacggcgcaagagaggacuguuuggcgcgaucgccggcuucauugaagggggauggcaaggcauggucgaugggugguauggauaccaccauuccaaugaacagggcagcggguaugcugccgaccgggagucuacacagaaagcuaucgacggagugacgaacaagguuaauuccauuaucgauaaaaugaacacccaguuugaagccgugggccgcgaguucaacaaucucgaaagacggauugagaaccugaauaagaaaauggaggacggcuuucuggaugucuggacauacaacgccgaacuccuggugcuuauggagaaugaaagaacccuggacuuccacgauagcaacguuaagaaucucuacgacaaggugcgccugcaacuucgggauaacgcuaaagagcuggggaauggauguuucgaauuuuaucauaagugcgacaacgaguguauggagucugucagaaauggcacauacgauuauccccaguacagcgaagaggcgcgccucaaacgggaagagaucuccggggugaagcuggagucuaucggaaccuaucagauucugagcaucuacuccacggucgccagcucucucgcucuggccauuaucguggccggccuuucccuguggaugugcagcaacgggucucuccaaugcagaauuuguaucuga

SEQ ID NO: 195996 - RNA, 1701 nt, Artificial Sequence
  derived and/or modified sequence opt5 from hemagglutinin__InfluenzaA__ALA08472
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauguguggggcguucaccauccugggacggauaaggaccagauuuuccuguacgcgcaguccagcggaagaaucacaguguccaccaagcggucucaacaggccgucauuccgaauaucggcagccgccccagaauccgggauauuccuucccgcaucagcauuuacuggacaaucgugaagcccggggacauucuccugaucaacucuaccggaaaucugaucgcuccuagaggcuauuuuaaaauucgguccgggaagucuucuaucaugcgcagcgacgcccccauuggaaaauguaaguccgaaugcaucaccccgaacggcucuauuccuaaugauaagcccuuccagaacgugaauagaaucacauacggcgcuuguccucgguaugucaaacacagcacgcucaagcuggccaccgggaugcgcaacguucccgagaaacagacaagaggaaucuuuggcgcgauugccggguucaucgaaaauggaugggagggcaugguggacgggugguacggauuucggcaccaaaacuccgagggcagaggccaggcugccgaucuuaagagcacccaggcugccauugaccaaaucaaugggaaacugaaccgccucauuggaaagacaaaugaaaaauuccaucagaucgagaaggaguucucugaaguggaaggccggauucaggaucuggagaaguaugucgaggacaccaaaaucgaucuuugguccuacaacgccgaacugcucguggcucuggagaaucagcacacgaucgaccugacagauagcgaaaugaacaagcucuuugagaaaaccaagaaacaacugagagaaaacgcggaggacauggggaauggaugcuucaagauuuaucauaagugugauaacgccugcaucggcucuauucgcaaugggaccuacgaccacaacguuuaccgggacgaggcucuuaauaacagauuucagaucaaaggcguggaacugaaguccggauauaaagauuggauucucuggaucagcuucgccaucuccugcuuucugcuuugugucgcccugcucggcuucauuaugugggcuugccagaaggggaauauccgcuguaacauuugcaucuga

SEQ ID NO: 195997 - RNA, 1701 nt, Artificial Sequence; identical to SEQ ID NO: 195465
  derived and/or modified sequence opt5 from hemagglutinin__InfluenzaA__ALA08475

SEQ ID NO: 195998 - RNA, 1701 nt, Artificial Sequence
  derived and/or modified sequence opt5 from hemagglutinin__InfluenzaA__ALA08478
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugaugggaaaaacuguacacugaucgacgcccuccugggagauccccagugcgacggcuuucagaauaagcggugggaucuguucgucgaacgcucuaaagccuauagcaacuguuacccuuaugacgugcccgauuacgcuucccucagaucucugguugccagcuccgggacccuugaguuuaaugacgaauccuucaacugggcuggagugacgcaaaauggcaccucuuccgccugcauucggggcagcaacucuuccuuuuucagccgccugaauuggcucacacauucuaacuuuaaguauccugcgcugaaugucaccaugcccaacaacgagcaguucgauaaacuuuacaucuggggagugcaccauccugggacagacaaagaucagauuuuucuguaugcccaguccagcggcagaaucaccguuuccacgaagcggucucaacaggcugugauuccgaauaucgggagccgccccagaauccggaacauuccuucccgcaucagcauuuacuggacaaucgucaaacccggagacauucuccugaucaauucuaccggcaaccugaucgccccuagaggguacuucaagauucaguccggaaaaagcucuaucaugcggagcgacgcucccauuggcaaguguaaguccgagugcaucacaccgaauggcucuauuccuaacgauaaacccuuucagaaugugaaccgcaucaccuauggggccuguccuagauacgugaagcaaagcacccucaaacuggcgacaggaaugcggaauguccccgaaaagcagacgcgcggcaucuucggggccauugcuggauuuaucgagaacggcugggaagggaugaaagacggaugguauggcuucagacaccagaauagcgagggccgggggcaagccgcugaucuuaagagcacccaggccgccauugaccagaucaacggaaaacugaauagacucauuggcaagacaaacgagaaguuccaccagaucgaaaaagaguuuucugaaguugaggggcgcauucaagaucuggaaaaguacguggaggacaccaaaaucgaucuuugguccuauaaugcugagcugcucguggcgcuggaaaaccagcauacaaucgaccugaccgauagcgagaugaacaaacucuucgaaaagacgaagaagcagcugcgggagaaugccgaagacaugggaaacggcugcuuuaagauuuaccacaagugugauaaugcuugcaucgggucuauuagaaacggcacauaugaccaugacgucuaccgcgaugaggcccuuaauaaccgguuccagaucaaaggaguggagcugaaguccggcuacaaagacuggauucucuggaucagcuuugccaucuccugcuuccugcuuuguguugcucugcucggguuuauuaugugggccugccaaaagggaaauaucagauguaacauuugcaucuga

SEQ ID NO: 195999 - RNA, 1701 nt, Artificial Sequence; identical to SEQ ID NO: 193018
  derived and/or modified sequence opt5 from hemagglutinin__InfluenzaA__ALA08479

SEQ ID NO: 196000 - RNA, 1701 nt, Artificial Sequence
  derived and/or modified sequence opt5 from hemagglutinin__InfluenzaA__ALA08481
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagcccauagcaacuguuauccuuacgacgugcccgauuaugcuucccuccgcucucugguugccagcuccgggacccuugaauuuaauaacgagagcuucaauugggcuggagugacgcaaaacggcaccucuuccagcugcauuagaggcucuaauuccagcuuuuucucucggcugaacuggcucacacaccuuaauuccaaguacccugcccugaacgucaccaugcccaacaaugagcaguuugacaagcuguauaucuggggagugcaucacccugggacagauaaagaccagauuuuccucuacgcgcagagcuccggccgcaucaccguuucuacgaagagaagccaacaggccgugauuccgaacaucgggucccggccccgcaucagagauauuccuagccggaucucuauuuauuggacaaucgucaaacccggagacauucugcugaucaauuccaccggcaaccucaucgcuccucgcggguacuuuaagauuagaagcggaaaaucuagcaucaugcgguccgacgcccccauuggcaaguguaagucugaaugcaucacaccgaauggcagcauuccuaacgauaaacccuuccagaaugugaaccgcaucaccuacggggcuuguccuagauaugugaagcaguccacccugaaacuugccacaggaaugcggaauguccccgagcgccaaacgagaggcaucuuuggggcgauugccggauucaucgaaaacggcugggaggggaugguugacggaugguacggcuuucggcaccagaauagcgagggcagagggcaggcugccgaucugaagucuacccaagcugccauugaccagaucaacggaaaacucaaucgccugauuggcaagacaaacgaaaaauuccaucagaucgagaaggaguucuccgaaguggaagggcggauucaggaucuugagaaguauguggaggacaccaaaaucgaucuguggagcuacaaugccgaacuccuggucgcucuggagaaccaacacacaaucgaccucaccgauucugaaaugaacaagcuguuugagaaaacgaagaaacagcuuagagaaaaugcggaggacaugggaaacggcugcuucaagauuuaucauaagugugauaaugccugcaucggguccauucgcaacggcacauacgaccacgacguguaucgggaugaggcucugaauaacagauuucagaucaaaggaguugaacucaagagcggcuacaaagacuggauucuguggaucuccuucgccaucucuugcuuucuucuguguguggcccuccugggguucauuaugugggcuugccagaagggaaauauccgcuguaacauuugcaucuga

SEQ ID NO: 196001 - RNA, 1701 nt, Artificial Sequence; identical to SEQ ID NO: 196000
  derived and/or modified sequence opt5 from hemagglutinin__InfluenzaA__ALA08482

SEQ ID NO: 196002 - RNA, 1701 nt, Artificial Sequence
  derived and/or modified sequence opt5 from hemagglutinin__InfluenzaA__ALA08483
augaagaccaucauuggccugagcuacauccucugccugguguucgcccagaaacuucccgggaacgacaauuccacagcuacgcugugucucggacaccaugccgucccuaacggcaccauuguuaagacaaucaccaaugauagaauugaggugacaaacgcgaccgaacuggugcaaaauucuagcaucggggagaucugcgacuccccgcaccagauucuugauggagaaaacuguacacugaucgacgcucuccugggcgauccccagugcgacggguuucagaauaaaaagugggaucuguucgucgagcggucuaaagccuauagcaacuguuacccuuaugacgugcccgauuacgccucccuccgcucucugguugcuagcuccggaacccuugaauuuaauaacgagagcuucaauugggccggcgugacgcaaaacggcaccucuuccagcugcauuagagggucuaauuccagcuuuuucucucggcugaacuggcucacacaucuuaauuccaaguauccugcucugaacgucaccaugcccaacaaugagcaguuugacaagcuguacaucuggggagugcaccauccuggcacagauaaagaccagauuuuccucuaugcccagagcuccgggcgcaucaccguuucuacgaagagaagccaacaggcggugauuccgaacaucggaucccggccccgcaucagagauauuccuagccggaucucuauuuacuggacaaucgucaaacccggcgacauucugcugaucaauuccaccgggaaccucaucgccccucgcggauacuuuaagauuagaagcggcaaaucuagcaucaugcgguccgacgcucccauuggcaaguguaagucugaaugcaucacaccgaaugggagcauuccuaacgauaaacccuuccagaaugugaaccgcaucaccuauggagccuguccuagauacgugaagcaguccacccugaaacuugcuacaggcaugcggaauguccccgagcgccaaacgagagggaucuuuggagccauugcgggcuucaucgaaaacgggugggagggaaugguugacggcugguauggcuuucggcaccagaauagcgaggggagaggacaggccgcugaucugaagucuacccaagccgcuauugaccagaucaacggcaaacucaaucgccugauugggaagacaaacgaaaaauuccaccagaucgagaaggaguucuccgaaguggaaggacggauucaggaucuugagaaguacguggaggacaccaaaaucgaucuguggagcuauaaugccgaacuccuggucgcccuggagaaccaacauacaaucgaccucaccgauucugaaaugaacaagcuguuugagaaaacgaagaaacagcuuagagaaaaugcugaggacaugggcaacgggugcuucaagauuuaccacaagugugauaaugcgugcaucggcuccauucgcaacggaacauaugaccaugacguguaccgggaugaggcccugaauaacagauuucagaucaaaggcguugaacucaagagcggguacaaagacuggauucuguggaucuccuucgcuaucucuugcuuucuucuguguguggcccuccugggauucauuaugugggccugccagaagggcaauauccgcuguaacauuugcaucuga

SEQ ID NO: 196003 - RNA, 1701 nt, Artificial Sequence
  derived and/or modified sequence opt5 from hemagglutinin__InfluenzaA__ALA08484
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaaucuccaccaagcggucucaacaggccguuaucccgaauauuggcagccgccccagaauccgggauauuccuucccgcaucagcauuuacuggacaaucgugaagcccggggacauccuccugauuaacucuaccggaaaucugaucgcuccuagaggcuauuuuaaaauucgguccgggaagucuucuaucaugcgcagcgacgcccccauuggaaaauguaaguccgaaugcaucaccccgaacggcucuaucccuaaugauaagcccuuccagaacgucaauagaauuacauacggcgcuuguccucgguaugugaaacacagcacgcucaagcuggccaccgggaugcgcaacgugcccgagaaacagacaagaggaaucuuuggcgcgauugccggguucaucgaaaauggaugggagggcauggucgacgggugguacggauuucggcaccaaaacuccgagggcagaggccaggcugccgaucuuaagagcacccaggcugccauugaccaaaucaaugggaaacugaaccgccucauuggaaagacaaaugaaaaauuccaucagaucgagaaggaguucucugaaguugaaggccggauccaggaucuggagaaguauguggaggacaccaaaauugaucuuugguccuacaacgccgaacugcucguggcucuggagaaucagcacacgaucgaccugacagauagcgaaaugaacaagcucuuugagaaaaccaagaaacaacugagagaaaacgcggaggacauggggaauggaugcuucaagauuuaucauaagugugauaacgccugcaucggcucuauucgcaaugggaccuacgaccacaacgucuaccgggacgaggcucuuaauaacagauuucagaucaaaggcguggaacugaaguccggauauaaagauuggauccucuggauuagcuucgccaucuccugcuuucugcuuuguguugcccugcucggcuucauuaugugggcuugccagaaggggaauauccgcuguaacauuugcaucuga

SEQ ID NO: 196004 - RNA, 1701 nt, Artificial Sequence
  derived and/or modified sequence opt5 from hemagglutinin__InfluenzaA__ALA08488
augaagaccaucauugcccugagcuacauccucugccugguguucgcucagaaaauucccggcaacgggaauagcacagccacgcuuugucugggacaccaugcggucccuaacggcaccaucguuaagacaauuaccaaugacagaaucgaggugacaaacgcuaccgaacucgugcaaaauucuagcaucggggagauuugcgauuccccgcaccagauccuggacggagaaaacuguacacuuauugaugcccugcucggcgacccccagugcgauggguuucagaauaaaaagugggaccuguucgucgagcggucuaaagccuauagcaacuguuacccuuaugaugugcccgacuacgcuucccugcgcucucucguugccagcuccggaacccuggaauuuaauaacgagagcuucaauuggacgggcgugacccaaaacggcacaucuuccgcuugcaucagacgguccucuuccagcuuuuucucucgccuuaauuggcugacccaucucaacuauacauacccugcccugaaugucaccaugcccaacaacgagcaguuugauaaacuuuauauuuggggagugcaccauccugggacggacaaggaucagaucuuccuguacgcgcaguccagcggcagaauuacaguuuccaccaagcggucucaacaggccgugaucccgaauaucgggagccgcccccggauuagagacaucccuucccgcauuagcaucuacuggacaauugucaagcccggagauauccuccugaucaacucuaccggcaaucugauugcuccuagaggguauuuuaaaauccgguccggaaagagcucuauuaugcgcagcgacgcccccaucggcaaauguaaguccgaaugcauuaccccgaacggcucuaucccuaaugacaagcccuuccagaacgugaauagaaucacauacggggcuuguccucgguaugugaaacacagcacgcucaagcuggccaccggaaugcgcaacguccccgagaaacagacaagaggcauuuuuggggcgaucgccggauucauugaaaauggcugggaggggaugguugauggaugguacggcuuucggcaccaaaacuccgagggcagagggcaggcugccgaccuuaagagcacccaggcugccaucgaucaaauuaauggaaaacugaaccgccucaucggcaagacaaaugaaaaauuccaucagauugagaaggaguucucugaaguggaagggcggauccaggaccuggagaaguauguggaggauaccaaaaucgaccuuugguccuacaacgccgaacugcucgucgcucuggagaaucagcacacgauugaucugacagacagcgaaaugaacaagcucuuugagaaaaccaagaaacaacugagagaaaacgcggaggauaugggaaauggcugcuucaagaucuaucauaagugugacaacgccugcauugggucuauccgcaauggcaccuacgaucacaacguguaccgggacgaggcucuuaauaacagauuucagauuaaaggaguugaacugaaguccggcuauaaagacuggauccucuggaucagcuucgccauuuccugcuuucugcuuuguguggcccugcucggguucaucaugugggcuugccagaagggaaauauucgcuguaacaucugcauuuga

SEQ ID NO: 196005 - RNA, 1701 nt, Artificial Sequence
  derived and/or modified sequence opt5 from hemagglutinin__InfluenzaA__ALA08490
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgcccccaucggaaaauguaaguccgaaugcauuaccccgaacggcucuaucccuaaugauaagcccuuccagaacgugaauagaaucacauacggcgcuuguccucgguaugugaaacacagcacgcucaagcuggccaccgggaugcgcaacguccccgagaaacagacaagaggaauuuuuggcgcgaucgccggguucauugaaaauggaugggagggcaugguugacgggugguacggauuucggcaccaaaacuccgagggcagaggccaggcugccgaucuuaagagcacccaggcugccaucgaccaaauuaaugggaaacugaaccgccucaucggaaagacaaaugaaaaauuccaucagauugagaaggaguucucugaaguggaaggccggauccaggaucuggagaaguauguggaggacaccaaaaucgaucuuugguccuacaacgccgaacugcucgucgcucuggagaaucagcacacgauugaccugacagauagcgaaaugaacaagcucuuugagaaaaccaagaaacaacugagagaaaacgcggaggacauggggaauggaugcuucaagaucuaucauaagugugauaacgccugcauuggcucuauccgcaaugggaccuacgaccacaacguguaccgggacgaggcucuuaauaacagauuucagauuaaaggcaucgaacugaaguccggauauaaagauuggauccucuggauuagcuucgccaucuccugcuuucugcuuuguguugcccugcucggcuucauuaugugggcuugccagaaggggaauauccgcuguaacauuugcaucuga

SEQ ID NO: 196006 - RNA, 1701 nt, Artificial Sequence
  derived and/or modified sequence opt5 from hemagglutinin__InfluenzaA__ALA08491
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacaugaccaugcccaacaaugagcaguucgacaagcuguacaucuggggaguccaccauccugggacagauaaagaccagauuuuucucuaugcccagucuuccggccgcaucaccgugagcacgaagagaucccaacaggcuguuauuccgaacaucgggucucggccccgcaucagaaauauuccuagccggaucuccauuuacuggacaaucgugaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgucaaucgcaucaccuauggggccuguccuagauacgugaagcagucuacccugaaacuugcgacaggaaugcggaacgugcccgagaagcaaacgcgcggcaucuucggggccauugcuggauuuaucgaaaauggcugggaggggaugaaagauggaugguauggcuucagacaccagaacagcgagggccgggggcaggccgcugaccugaaguccacccaagccgccauugaucagaucaauggaaaacucaacagacugauuggcaagacaaaugaaaaguuccaccagaucgagaaagaauuuagcgaggucgaagggcgcauucaggaccuugagaaguacguugaggauaccaaaaucgaccuguggucuuauaacgcugaacuccugguggcgcuggagaaccaacauacaaucgaucucaccgacuccgaaaugaauaagcuguucgagaaaacgaagaagcagcuucgggaaaacgccgaggauaugggaaauggcugcuuuaaaauuuaccacaagugugacaacgcuugcaucgggagcauuagaaauggcacauaugaucaugacguguaccgcgacgaggcccugaacaaucgguuccagaucaaaggagucgaacucaagucuggcuacaaagauuggauucuguggaucuccuuugccaucagcugcuuccuucuguguguggcucuccugggguuuauuaugugggccugccagaagggaaacaucagauguaauauuugcaucuga

SEQ ID NO: 196007 - RNA, 1701 nt, Artificial Sequence; identical to SEQ ID NO: 196005
  derived and/or modified sequence opt5 from hemagglutinin__InfluenzaA__ALA08492

SEQ ID NO: 196008 - RNA, 1701 nt, Artificial Sequence
  derived and/or modified sequence opt5 from hemagglutinin__InfluenzaA__ALA08493
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgcccccaucggaaaauguagauccgaaugcauuaccccgaacggcucuaucccuaaugauaagcccuuccagaacgugaaucggaucacauacggcgcuuguccucgcuaugugaagcacagcacgcucaaacuggccaccgggaugagaaacguccccgagaagcagacacggggaauuuuuggcgcgaucgccggguucauugaaaauggaugggagggcaugguugacgggugguacggauuuagacaccaaaacuccgagggccgcggccaggcugccgaucuuaaaagcacccaggcugccaucgaccaaauuaaugggaagcugaaccggcucaucggaaaaacaaaugaaaaguuccaucagauugagaaagaguucucugaaguggaaggcagaauccaggaucuggagaaguauguggaggacaccaagaucgaucuuugguccuacaacgccgaacugcucgucgcucuggagaaucagcacacgauugaccugacagauagcgaaaugaacaaacucuuugagaagaccaaaaagcaacugcgcgaaaacgcggaggacauggggaauggaugcuucaaaaucuaucauaagugugauaacgccugcauuggcucuauccggaaugggaccuacgaccacaacguguacagagacgaggcucuuaauaaccgcuuucagauuaagggcaucgaacugaaauccggauauaaggauuggauccucuggauuagcuucgccaucuccugcuuucugcuuuguguugcccugcucggcuucauuaugugggcuugccagaaagggaauauccgguguaacauuugcaucuga

SEQ ID NO: 196009 - RNA, 1701 nt, Artificial Sequence
  derived and/or modified sequence opt5 from hemagglutinin__InfluenzaA__ALA08494
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagggcucucaacaggccgugaucccgaauaucgggagccggccccgcauuagagauaucccuucccggauuagcaucuacuggacaauugucaagcccggagacauccuccugaucaacucuaccggcaaucugauugcuccucgcggguauuuuaaaaucagauccggaaagagcucuauuaugcggagcgacgcccccaucggcaaauguaaguccgaaugcauuaccccgaacggcucuaucccuaaugauaagcccuuccagaacgugaaucgcaucacauacggggcuuguccuagauaugugaaacacagcacgcucaagcuggccaccggaaugcggaacguccccgagaaacagacacgcggcauuuuuggggcgaucgccggauucauugaaaauggcugggaggggaugguugacggaugguacggcuuuagacaccaaaacuccgagggccgggggcaggcugccgaucuuaagagcacccaggcugccaucgaccaaauuaauggaaaacugaacagacucaucggcaagacaaaugaaaaauuccaucagauugagaaggaguucucugaaguggaagggcgcauccaggaucuggagaaguauguggaggacaccaaaaucgaucuuugguccuacaacgccgaacugcucgucgcucuggagaaucagcacacgauugaccugacagauagcgaaaugaacaagcucuuugagaaaaccaagaaacaacugcgggaaaacgcggaggacaugggaaauggcugcuucaagaucuaucauaagugugauaacgccugcauugggucuaucagaaauggcaccuacgaccacaacguguaccgcgacgaggcucuuaauaaccgguuucagauuaaaggaguugaacugaaguccggcuauaaagauuggauccucuggaucagcuucgccauuuccugcuuucugcuuuguguggcccugcucggguucaucaugugggcuugccagaagggaaauauuagauguaacaucugcauuuga

SEQ ID NO: 196010 - RNA, 1701 nt, Artificial Sequence; identical to SEQ ID NO: 196009
  derived and/or modified sequence opt5 from hemagglutinin__InfluenzaA__ALA08495

SEQ ID NO: 196011 - RNA, 1701 nt, Artificial Sequence; identical to SEQ ID NO: 196009
  derived and/or modified sequence opt5 from hemagglutinin__InfluenzaA__ALA08496

SEQ ID NO: 196012 - RNA, 1701 nt, Artificial Sequence; identical to SEQ ID NO: 195465
  derived and/or modified sequence opt5 from hemagglutinin__InfluenzaA__ALA08497

SEQ ID NO: 196013 - RNA, 1701 nt, Artificial Sequence; identical to SEQ ID NO: 195465
  derived and/or modified sequence opt5 from hemagglutinin__InfluenzaA__ALA08498

SEQ ID NO: 196014 - RNA, 1701 nt, Artificial Sequence
  derived and/or modified sequence opt5 from hemagglutinin__InfluenzaA__ALA08499
augaagaccaucauugcccugagcuacauccucugccugguguucgcucagaaacuucccgagaacgacaauuccacagccacgcugugucucggccaccaugcggucccuaacgggaccauuguuaagacaaucaccucugauagaauugaagugacaaaugcuaccgagcuggugcaaaacagcuccaucggagaaaucugcgacucuccgcaccagauucuugauggcaaaaauuguacacugaucgacgcccuccugggggauccccagugcgacggauuucagaacaagaaaugggaucuguucgucgagcggagcaaggccuauuccaauuguuacccuuaugacgugcccgauuacgcuucucuccgcagccugguugccuccagcggcacccuugaauuuaacgacgagucuuucaauugggcuggggugacgcaaaacggaaccuccagcgccugcauuagaggcucuaauuccagcuuuuucucucggcugaacuggcucacacauuccaauuuuaaguauccugcgcugaacgucaccaugcccaauaacgagcaguucgauaaacuuuacaucuggggcgugcaccauccugggacagacaaggaucagauuuuucuguaugcccagagcuccggacgcaucaccguuucuacgaaaagaagccaacaggcugugauuccgaacaucggcucccggccccgcaucagagacauuccuagccggaucucuauuuacuggacaaucgucaagcccggggacauucuccugaucaauuccaccggaaaccugaucgccccucgcggcuacuucaaaauuagaagcgggaagucuagcaucaugcgguccgaugcucccauuggaaaguguaaaucugaaugcaucacaccgaauggcagcauuccuaacgacaagcccuuucagaaugugaaccgcaucaccuauggcgccuguccuagauacgugaaacaguccacccucaagcuggcgacagggaugcggaauguccccgagaaacaaacgcgcggaaucuucggcgccauugcuggguuuaucgaaaacggaugggagggcaugaaggaugggugguauggauucagacaccagaauagcgagggccggggccaggccgcugaccuuaaaucuacccaagccgccauugaucagaucaacgggaagcugaauagacucauuggaaagacaaacgaaaaauuccaccagaucgagaaggaauuuuccgagguugaaggccgcauucaggaccuggagaaauacguggaggauaccaagguggaccuuuggagcuauaaugcugaacugcucgucgcgcuggagaaccaacauacaaucgaucugaccgacucugaaaugaauaaacucuucgagaagacgaagaaacagcugcgggaaaacgccgaggauauggggaacggaugcuuuaagaucuaccacaaaugugacaaugcuugcauuggcuccaucagaaacgggacauaugaccaugauguguaccgcgacgaggcccuuaauaaccgguuccagauuaagggcguugaacugaaaagcggauacaaggauuggauccucuggauuuccuuugccaucucuugcuuccugcuuuguguggcucugcucggcuuuaucaugugggccugccagaaggggaauauuagauguaacaucugcauuuga

SEQ ID NO: 196015 - RNA, 1701 nt, Artificial Sequence; identical to SEQ ID NO: 195998
  derived and/or modified sequence opt5 from hemagglutinin__InfluenzaA__ALA08501

SEQ ID NO: 196016 - RNA, 1701 nt, Artificial Sequence
  derived and/or modified sequence opt5 from hemagglutinin__InfluenzaA__ALA08502
augaagaccaucauugcccugagcuacauccucugccugguguucgcucagaaacuucccgagaacgacaauuccacagccacgcugugucucggccaccaugcggucccuaacgggaccauuguuaagacaaucaccucugauagaauugaagugacaaaugcuaccgagcuggugcaaaacagcuccaucggagaaaucugcgacucuccgcaccagauucuugauggcaaaaauuguacacugaucgacgcccuccugggggauccccagugcgacggauuucagaacaagaaaugggaucuguucgucgagcggagcaaggccuauuccaauuguuacccuuaugacgugcccgauuacgcuucucuccgcagccugguugccuccagcggcacccuugaauuuaacgacgagucuuucaauugggcuggggugacgcaaaacggaaccuccagcgccugcauuagaggcucuaauuccagcuuuuucucucggcugaacuggcucacacauuccaauuuuaaguauccugcgcugaacgucaccaugcccaauaacgagcaguucgauaaacuuuacaucuggggcgugcaccauccugggacagacaaggaucagauuuuucuguaugcccagagcuccggacgcaucaccguuucuacgaaaagaagccaacaggcugugauuccgaacaucggcucccggccccgcaucagaaauauuccuagccggaucucuauuuacuggacaaucgucaagcccggggacauucuccugaucaacuccaccggaaaucugaucgccccucgcggcuacuucaaaauuagaagcgggaagucuagcaucaugcgguccgacgcucccauuggaaaguguaaaucugaaugcaucacaccgaacggcagcauuccuaaugauaagcccuuucagaacgugaaucgcaucaccuauggcgccuguccuagauacgugaaacaguccacccucaagcuggcgacagggaugcggaacguccccgagaaacaaacgcgcggaaucuucggcgccauugcuggguuuaucgaaaauggaugggagggcaugaaggacgggugguauggauucagacaccagaacagcgagggccggggccaggccgcugaucuuaaaucuacccaagccgccauugaccagaucaaugggaagcugaacagacucauuggaaagacaaaugaaaaauuccaccagaucgagaaggaauuuuccgagguugaaggccgcauucaggaucuggagaaauacguggaggacaccaagguggaucuuuggagcuauaacgcugaacugcucgucgcgcuggagaaucaacauacaaucgaccugaccgauucugaaaugaacaaacucuucgagaagacgaagaaacagcugcgggaaaacgccgaggacauggggaauggaugcuuuaagaucuaccacaaaugugauaacgcuugcauuggcuccaucagaaaugggacauaugaccaugacguguaccgcgaugaggcccuuaacaaucgguuccagauuaagggcguugaacugaaaagcggauacaaggacuggauccucuggauuuccuuugccaucucuugcuuccugcuuuguguggcucugcucggcuuuaucaugugggccugccagaaggggaacauuagauguaauaucugcauuuga

SEQ ID NO: 196017 - RNA, 1701 nt, Artificial Sequence; identical to SEQ ID NO: 196016
  derived and/or modified sequence opt5 from hemagglutinin__InfluenzaA__ALA08503

SEQ ID NO: 196018 - RNA, 1701 nt, Artificial Sequence; identical to SEQ ID NO: 195465
  derived and/or modified sequence opt5 from hemagglutinin__InfluenzaA__ALA08504

SEQ ID NO: 196019 - RNA, 1701 nt, Artificial Sequence; identical to SEQ ID NO: 195465
  derived and/or modified sequence opt5 from hemagglutinin__InfluenzaA__ALA08505

SEQ ID NO: 196020 - RNA, 1701 nt, Artificial Sequence; identical to SEQ ID NO: 195465
  derived and/or modified sequence opt5 from hemagglutinin__InfluenzaA__ALA08506

SEQ ID NO: 196021 - RNA, 1701 nt, Artificial Sequence; identical to SEQ ID NO: 195465
  derived and/or modified sequence opt5 from hemagglutinin__InfluenzaA__ALA08507

SEQ ID NO: 196022 - RNA, 1701 nt, Artificial Sequence
  derived and/or modified sequence opt5 from hemagglutinin__InfluenzaA__ALA08508
augaagaccaucauugcccugagcuacauccucugccugguguucgcucagaaacuucccgagaacgacaauuccacagccacgcugugucucggccaccaugcggucccuaacgggaccauuguuaagacaaucaccucugauagaauugaagugacaaaugcuaccgagcuggugcaaaacagcuccaucggagaaaucugcgacucuccgcaccagauucuugauggcaaaaauuguacacugaucgacgcccuccugggggauccccagugcgacggauuucagaacaagaaaugggaucuguucgucgagcggagcaaggccuauuccaauuguuacccuuaugacgugcccgauuacgcuucucuccgcagccugguugccuccagcggcacccuugaauuuaacgacgagucuuucaauugggcuggggugacgcaaaacggaaccuccagcgccugcauuagaggcucuaauuccagcuuuuucucucggcugaacuggcucacacauuccaauuuuaaguauccugcgcugaacgucaccaugcccaauaacgagcaguucgauaaacuuuacaucuggggcgugcaccauccugggacagacaaggaucagauuuuucuguaugcccagagcuccggacgcaucaccguuucuacgaaaagaagccaacaggcugugauuccgaacaucggcucccggccccgcaucagaaauauuccuagccggaucucuauuuacuggacaaucgucaagcccggggacauucuccugaucaacuccaccggaaaucugaucgccccucgcggcuacuucaaaauuagaagcgggaagucuagcaucaugcgguccgacgcucccauuggaaaguguaaaucugaaugcaucacaccgaacggcagcauuccuaaugauaagcccuuucagaacgugaaucgcaucaccuauggcgccuguccuagauacgugaaacaguccacccucaagcuggcgacagggaugcggaacguccccgagaaacaaacgcgcggaaucuucggcgccauugcuggguuuaucgaaaauggaugggagggcaugaaggacgggugguauggauucagacaccagaacagcgagggccggggccaggccgcugaucuuaaaucuacccaagccgccauugaccagaucaaugggaagcugaacagacucauuggaaagacaaaugaaaaauuccaccagaucgagaaggaauuuuccgagguugaaggccgcauucaggaucuggagaaauacguggaggacaccaagaucgaucuuuggagcuauaacgcugaacugcucguggcgcuggagaaucaacauacaaucgaccugaccgauucugaaaugaacaaacucuucgagaagacgaagaaacagcugcgggaaaacgccgaggacauggggaauggaugcuuuaagauuuaccacaaaugugauaacgcuugcaucggcuccauuagaaaugggacauaugaccaugacgucuaccgcgaugaggcccuuaacaaucgguuccagaucaagggcguggaacugaaaagcggauacaaggacuggauucucuggaucuccuuugccaucucuugcuuccugcuuuguguugcucugcucggcuuuauuaugugggccugccagaaggggaacaucagauguaauauuugcaucuga

SEQ ID NO: 196023 - RNA, 1701 nt, Artificial Sequence; identical to SEQ ID NO: 195465
  derived and/or modified sequence opt5 from hemagglutinin__InfluenzaA__ALA08509

SEQ ID NO: 196024 - RNA, 1701 nt, Artificial Sequence; identical to SEQ ID NO: 195465
  derived and/or modified sequence opt5 from hemagglutinin__InfluenzaA__ALA08510

SEQ ID NO: 196025 - RNA, 1701 nt, Artificial Sequence
  derived and/or modified sequence opt5 from hemagglutinin__InfluenzaA__ALA08511
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccagcugcaucagacggucuuccagcucuuucuucucccgccuuaauuggcugacccaucucaacuauacauacccugcucugaaugucaccaugcccaacaacgagcaguuugacaaacuuuauauuuggggcgugcaccauccuagcacggauaaggaccagaucuuccuguacgcccaguccucugggagaauuacaguuagcaccaagcggucccaacaggcggugaucccgaauaucggaagccgcccccggauuagagauaucccuucucgcauuuccaucuacuggacaauugucaagcccggcgacauccuccugaucaacagcaccgggaaucugauugccccuagaggauauuuuaaaauccggucuggcaagagcuccauuaugcgcucugacgcucccaucgggaaauguaagagcgaaugcauuaccccgaacggauccaucccuaaugauaagcccuuccagaacgugaauagaaucacauacggcgccuguccucgguaugugaaacacagcacgcucaagcuggcuaccggcaugcgcaacguccccgagaaacagacaagagggauuuuuggagccaucgcgggcuucauugaaaaugggugggagggaaugguugacggcugguacggguuucggcaccaaaacucugagggaagaggccaggccgcugaucuuaaguccacccaggccgcuaucgaccaaauuaauggcaaacugaaccgccucaucgggaagacaaaugaaaaauuccaucagauugagaaggaauuuagcgagguggaaggacggauccaggaucuggagaaguauguggaggacaccaaaaucgaucuuuggucuuacaacgccgaacugcucgucgcccuggagaaucagcacacgauugaccugacagauuccgaaaugaacaagcucuuugagaaaaccaagaaacaacugagagaaaacgcugaggacaugggcaaugggugcuucaagaucuaucauaagugugauaacgcgugcauuggaagcauccgcaauggcaccuacgaccacaacguguaccgggacgaggcccuuaauaacagauuucagauuaaagggguugaacugaaguccggcuauaaagauuggauccucuggaucucuuucgcuauuagcugcuuucugcuuuguguggcccugcucggauucaucaugugggccugccagaagggcaauauucgcuguaacaucugcauuuga

SEQ ID NO: 196026 - RNA, 1701 nt, Artificial Sequence; identical to SEQ ID NO: 195465
  derived and/or modified sequence opt5 from hemagglutinin__InfluenzaA__ALA08512

SEQ ID NO: 196027 - RNA, 1701 nt, Artificial Sequence; identical to SEQ ID NO: 195465
  derived and/or modified sequence opt5 from hemagglutinin__InfluenzaA__ALA08514

SEQ ID NO: 196028 - RNA, 1701 nt, Artificial Sequence; identical to SEQ ID NO: 195465
  derived and/or modified sequence opt5 from hemagglutinin__InfluenzaA__ALA08515

SEQ ID NO: 196029 - RNA, 1701 nt, Artificial Sequence; identical to SEQ ID NO: 195465
  derived and/or modified sequence opt5 from hemagglutinin__InfluenzaA__ALA08516

SEQ ID NO: 196030 - RNA, 1701 nt, Artificial Sequence; identical to SEQ ID NO: 196022
  derived and/or modified sequence opt5 from hemagglutinin__InfluenzaA__ALA08517

SEQ ID NO: 196031 - RNA, 1701 nt, Artificial Sequence; identical to SEQ ID NO: 195465
  derived and/or modified sequence opt5 from hemagglutinin__InfluenzaA__ALA08519

SEQ ID NO: 196032 - RNA, 1701 nt, Artificial Sequence
  derived and/or modified sequence opt5 from hemagglutinin__InfluenzaA__ALA08520
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauacauacccugcccugaaugucaccaugcccaacaacgagcaguuugacaagcuguauauuuggggcgugcaccauccugggacggauaaggaccagaucuuccuguacgcgcagccguccggaagaauuacaguuagcaccaaacggucccaacaggccgugauccccaauaucggcucucgcccucggauuagagauauccccagccgcauuuccaucuacuggacaauugucaagccuggggacauccuccugaucaacagcaccggaaaucugauugcucccagaggcuauuuuaaaauccggaacgggaagucuuccauuaugcgcagcgacgccccgaucggaaaauguaagucugaaugcauuaccccuaauggcagcauccccaacgauaagccuuuccagaaugugaacagaaucacauacggcgcuuguccccgguaugugaaacacuccacgcucaagcuggccaccgggaugcgcaauguccccgagaaacagacaagaggaauuuuuggcgcgaucgccggguucauugaaaacggaugggagggcaugguugacgggugguacggauuucggcaccaaaauucugagggcagaggccaggcugccgaucuuaagagcacccaggcugccaucgaccaaauuaacgggaaacugaaucgccucaucggaaagacaaacgaaaaauuccaucagauugagaaggaguucuccgaaguggaaggccggauccaggaucuggagaaguauguggaggacaccaaaaucgaucuuuggagcuacaaugccgaacugcucgucgcucuggagaaccagcacacgauugaccugacagauucugaaaugaacaagcucuuugagaaaaccaagaaacaacugagagaaaaugcggaggacauggggaacggaugcuucaagaucuaucauaagugugauaaugccugcauuggcuccauccgcaacgggaccuacgaccacaauguguaccgggacgaggcucuuaacaauagauuucagauuaaaggcguugaacuuaagagcggauauaaagauuggauccucuggaucucuuucgccauuuccugcuuucugcuuuguguggcccugcucggcuucaucaugugggcuugccagaaggggaacauucgcuguaauaucugcauuuga

SEQ ID NO: 196033 - RNA, 1701 nt, Artificial Sequence; identical to SEQ ID NO: 193162
  derived and/or modified sequence opt5 from hemagglutinin__InfluenzaA__ALA08522

SEQ ID NO: 196034 - RNA, 1701 nt, Artificial Sequence
  derived and/or modified sequence opt5 from hemagglutinin__InfluenzaA__ALA08523
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuauuggaaaucugaucgcuccuagaggcuauuuuaaaauucgguccgggaagucuucuaucaugcgcagcgacgcccccauuggaaaauguaaguccgaaugcaucaccccgaacggcucuaucccuaaugauaagcccuuccagaacgugaauagaauuaccuacggcgcuuguccucgguaugugaaacacagcacacucaagcuggccacggggaugcgcaacguccccgagaaacagaccagaggaaucuuuggcgcgauugccggguucaucgaaaauggaugggagggcaugguugacgggugguacggauuucggcaccaaaacuccgagggcagaggccaggcugccgaucuuaagagcacacaggcugccauugaccaaaucaaugggaaacugaaccgccucauuggaaagaccaaugaaaaauuccaucagaucgagaaggaguucucugaaguggaaggccggauccaggaucuggagaaguauguggaggacacaaaaauugaucuuugguccuacaacgccgaacugcucgucgcucuggagaaucagcacaccaucgaccugacggauagcgaaaugaacaagcucuuugagaaaacaaagaaacaacugagagaaaacgcggaggacauggggaauggaugcuucaagauuuaucauaagugugauaacgccugcaucggcucuauucgcaaugggaccuacgaccacaacguguaccgggacgaggcucuuaauaacagauuucagaucaaaggcguugaacugaaguccggauauaaagauuggauccucuggauuagcuucgccaucuccugcuuucugcuuuguguggcccugcucggcuucauuaugugggcuugccagaaggggaauauccgcuguaacauuugcaucuga

SEQ ID NO: 196035 - RNA, 1701 nt, Artificial Sequence
  derived and/or modified sequence opt5 from hemagglutinin__InfluenzaA__ALA08524
augaagaccaucauugcccugagcuacauccucugcaugguguucgcucagaaaauucccggcaacgacaauuccacagccacgcugugucuugggcaccaugcggucccuaacggaaccaucguuaagacaauuaccaaugauagaaucgaggugacaaacgcuaccgaacuggugcaaaauucuagcaucggcgagauuugcgacuccccgcaccagauccucgauggggaaaacuguacacugauugacgcccuucugggagauccccagugcgacggcuuucagaauaaaaagugggaucucuucgucgagcggucuaaagccuauagcaacuguuacccuuaugacgugcccgauuacgcuucccugcgcucucugguugccagcuccgggacccucgaauuuaauaacgagagcuucaauuggacgggagugacccaaaacggcacaucuuccgcuugcaucagacggagcagcuccagcuuuuucucucgccugaauuggcuuacccaucugaacuauacauacccugcccucaaugucaccaugcccaacaacgagcaguuugacaagcuguauauuuggggcgugcaccauccugggacggauaaggaccagaucuuccuuuacgcgcaguccagcggaagaauuacaguuuccaccaaacggucucaacaggccgugaucccgaauaucggcagccgccugcggauuagagauauccccucccgcauuagcaucuacuggacaauugucaagccuggggacauccuccugaucaacucuaccggaaaucugauugcucccagaggcuauuuuaaaauccgguccgggaagucuucuauuaugcgcagcgacgccccuaucggaaaauguaaguccgaaugcauuacccccaacggcucuaucccgaaugauaagccuuuccagaacgugaauagaaucacauacggcgcuuguccccgguaugugaaacacagcacgcucaagcuggccaccgggaugcgcaacgucccugagaaacagacaagaggaauuuuuggcgcgaucgccggguucauugaaaauggaugggagggcaugguugacgggugguacggauuucggcaccaaaacuccgagggcagaggccaggcugccgaucuuaagagcacccaggcugccaucgaccaaauuaaugggaaacugaaccgccucaucggaaagacaaaugaaaaauuccaucagauugagaaggaguucucugaaguggaaggccggauccaggaucuggagaaguauguggaggacaccaaaaucgaucuuugguccuacaacgccgaacugcucgucgcucuggagaaucagcacacgauugaccugacagauagcgaaaugaacaagcucuuugagaaaaccaagaaacaacugagagaaaacgcggaggacauggggaauggaugcuucaagaucuaucauaagugugauaacgccugcauuggcucuauccgcaaugggaccuacgaccacaacguguaccgggacgaggcucuuaauaacagauuucagauuaaaggcguugaacugaaguccggauauaaagauuggauccucuggaucagcuucgccauuuccugcuuucugcuuuguguggcccugcucggcuucaucaugugggcuugccagaaggggaauauucgcuguaacaucugcauuuga

SEQ ID NO: 196036 - RNA, 1701 nt, Artificial Sequence; identical to SEQ ID NO: 195465
  derived and/or modified sequence opt5 from hemagglutinin__InfluenzaA__ALA08525

SEQ ID NO: 196037 - RNA, 1701 nt, Artificial Sequence; identical to SEQ ID NO: 195465
  derived and/or modified sequence opt5 from hemagglutinin__InfluenzaA__ALA08526

SEQ ID NO: 196038 - RNA, 1701 nt, Artificial Sequence; identical to SEQ ID NO: 196022
  derived and/or modified sequence opt5 from hemagglutinin__InfluenzaA__ALA08527

SEQ ID NO: 196039 - RNA, 1701 nt, Artificial Sequence
  derived and/or modified sequence opt5 from hemagglutinin__InfluenzaA__ALA08528
augaagaccaucauugcccugagcuacauccucugccugguguucgcucagaaacuucccgagaacgacaauuccacagccacgcugugucucggccaccaugcggucccuaacgggaccauuguuaagacaaucaccucugauagaauugaagugacaaaugcuaccgagcuggugcaaaacagcuccaucggagaaaucugcgacucuccgcaccagauucuugauggcaaaaauuguacacugaucgacgcccuccugggggauccccagugcgacggauuucagaacaagaaaugggaucuguucgucgagcggagcaaggccuauuccaauuguuacccuuaugacgugcccgauuacgcuucucuccgcagccugguugccuccagcggcacccuugaauuuaacgacgagucuuucaauugggcuggggugacgcaaaacggaaccuccagcgccugcauuagaggcucuaauuccagcuuuuucucucggcugaacuggcucacacauuccaauuuuaaguauccugcgcugaacgucaccaugcccaauaacgagcaguucgauaaacuuuacaucuggggcgugcaccauccugggacagacaaggaucagauuuaucuguacgcccagagcuccggacgcaucaccguuucuacgaaaagaagccaacaggcugugauuccgaacaucggcucccggccccgcaucagaaauauuccuagccggaucucuauuuacuggacaaucgucaagcccggggacauucuccugaucaacuccaccggaaaucugaucgccccucgcggcuauuuuaaaauuagaagcgggaagucuagcaucaugcgguccgacgcucccauuggaaaguguaaaucugaaugcaucacaccgaacggcagcauuccuaaugauaagcccuuccagaacgugaaucgcaucaccuacggcgccuguccuagauaugugaaacaguccacccucaagcuggcgacagggaugcggaacguccccgagaaacaaacgcgcggaaucuuuggcgccauugcuggguucaucgaaaauggaugggagggcaugaaggacgggugguacggauuuagacaccagaacagcgagggccggggccaggccgcugaucuuaaaucuacccaagccgccauugaccagaucaaugggaagcugaacagacucauuggaaagacaaaugaaaaauuccaccagaucgagaaggaguucuccgaaguugaaggccgcauucaggaucuggagaaauauguggaggacaccaagaucgaucuuuggagcuacaacgcugaacugcucguggcgcuggagaaucaacauacaaucgaccugaccgauucugaaaugaacaaacucuuugagaagacgaagaaacagaugcgggaaaacgccgaggacauggggaauggaugcuucaagauuuaucacaaaugugauaacgcuugcaucggcuccauuagaaaugggacauacgaccaugacgucuaccgcgaugaggcccugaacaaucgguuucagaucaagggcguggaacuuaaaagcggauauaaggacuggauucuguggaucuccuucgccaucucuugcuuucuccuguguguugcccuucugggcuucauuaugugggcuugccagaaggggaacaucagauguaauauuugcaucuga

SEQ ID NO: 196040 - RNA, 1701 nt, Artificial Sequence; identical to SEQ ID NO: 195465
  derived and/or modified sequence opt5 from hemagglutinin__InfluenzaA__ALA08529

SEQ ID NO: 196041 - RNA, 1701 nt, Artificial Sequence; identical to SEQ ID NO: 195465
  derived and/or modified sequence opt5 from hemagglutinin__InfluenzaA__ALA08530

SEQ ID NO: 196042 - RNA, 1701 nt, Artificial Sequence
  derived and/or modified sequence opt5 from hemagglutinin__InfluenzaA__ALA08531
augaagaccaucauugcccugagcuacauccucugccugguguucgcucagaaacuucccgagaacgacaauuccacagccacgcugugucucggccaccaugcggucccuaacgggaccauuguuaagacaaucaccucugauagaauugaagugacaaaugcuaccgagcuggugcaaaacagcuccaucggagaaaucugcgacucuccgcaccagauucuugauggcaaaaauuguacacugaucgacgcccuccugggggauccccagugcgacggauuucagaacaagaaaugggaucuguucgucgagcggagcaaggccuauuccaauuguuacccuuaugacgugcccgauuacgcuucucuccgcagccugguugccuccagcggcacccuugaauuuaacgacgagucuuucaauugggcuggggugacgcaaaacggaaccuccagcgccugcauuagaggcucuaauuccagcuuuuucucucggcugaacuggcucacacauuccaauuuuaaguauccugcgcugaacgucaccaugcccaauaacgagcaguucgauaaacuuuacaucuggggcgugcaccauccugggacagacaaggaucagauuuuucuguaugcccagagcuccggacgcaucaccguuucuacgaaaagaagccaacaggcugugauuccgaacaucggcucccggccccgcaucagaaauauuccuagccggaucucuauuuacuggacaaucgucaagcccggggacauucuccugaucaacuccaccggaaaucugaucgccccucgcggcuacuucaaaauuagaagcgggaagucuagcaucaugcgguccgacgcucccauuggaaaguguaaaucugaaugcaucacaccgaacggcagcauuccuaaugauaagcccuuucagaacgugaaucgcaucaccuauggcgccuguccuagauacgugaaacaguccacccucaagcuggcgacagggaugcggaacguccccgagaaacaaacgcgcggaaucuucggcgccauugcuggguuuaucgaaaauggaugggagggcaugaaggacgggugguauggauucagacaccagaacagcgagggccggggccaggccgcugaucuuaaaucuacccaagccgccauugaccagaucaaugggaagcugaacagacucauuggaaagacaaaugaaaaauuccaccagaucgagaaggaauuuuccgagguugaaggccgcauucaggaucuggagaaauacguggaggacaccaagaucgaucuuuggagcuauaacgcugaacugcucguggcgcuggagaaucaacauacaaucgaccugaccgauucugaaaugaacaaacucuucgagaagacgaagaaacagcugcgggaaaacgccgaggacauggggaauggaugcuuuaagauuuaccacaaaugugauaacgcuugcaucggcuccauuagaaaugggacauauaaccaugacgucuaccgcgacgaggcccuuaauaaccgguuccagaucaagggcguggaacugaaaagcggauacaaggauuggauucucuggaucuccuuugccaucucuugcuuccugcuuuguguugcucugcucggcuuuauuaugugggccugccagaaggggaauaucagauguaacauuugcaucuga

SEQ ID NO: 196043 - RNA, 1701 nt, Artificial Sequence; identical to SEQ ID NO: 195465
  derived and/or modified sequence opt5 from hemagglutinin__InfluenzaA__ALA08532

SEQ ID NO: 196044 - RNA, 1701 nt, Artificial Sequence; identical to SEQ ID NO: 195465
  derived and/or modified sequence opt5 from hemagglutinin__InfluenzaA__ALA08533

SEQ ID NO: 196045 - RNA, 1701 nt, Artificial Sequence; identical to SEQ ID NO: 195465
  derived and/or modified sequence opt5 from hemagglutinin__InfluenzaA__ALA08534

SEQ ID NO: 196046 - RNA, 1701 nt, Artificial Sequence; identical to SEQ ID NO: 195465
  derived and/or modified sequence opt5 from hemagglutinin__InfluenzaA__ALA08535

SEQ ID NO: 196047 - RNA, 1701 nt, Artificial Sequence; identical to SEQ ID NO: 196022
  derived and/or modified sequence opt5 from hemagglutinin__InfluenzaA__ALA08536

SEQ ID NO: 196048 - RNA, 1701 nt, Artificial Sequence; identical to SEQ ID NO: 196022
  derived and/or modified sequence opt5 from hemagglutinin__InfluenzaA__ALA08537

SEQ ID NO: 196049 - RNA, 1701 nt, Artificial Sequence; identical to SEQ ID NO: 196022
  derived and/or modified sequence opt5 from hemagglutinin__InfluenzaA__ALA08538

SEQ ID NO: 196050 - RNA, 1701 nt, Artificial Sequence; identical to SEQ ID NO: 195465
  derived and/or modified sequence opt5 from hemagglutinin__InfluenzaA__ALA08539

SEQ ID NO: 196051 - RNA, 1701 nt, Artificial Sequence; identical to SEQ ID NO: 196022
  derived and/or modified sequence opt5 from hemagglutinin__InfluenzaA__ALA08540

SEQ ID NO: 196052 - RNA, 1701 nt, Artificial Sequence; identical to SEQ ID NO: 196022
  derived and/or modified sequence opt5 from hemagglutinin__InfluenzaA__ALA08541

SEQ ID NO: 196053 - RNA, 1701 nt, Artificial Sequence; identical to SEQ ID NO: 196022
  derived and/or modified sequence opt5 from hemagglutinin__InfluenzaA__ALA08542

SEQ ID NO: 196054 - RNA, 1701 nt, Artificial Sequence
  derived and/or modified sequence opt5 from hemagglutinin__InfluenzaA__ALA08543
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgcuaucccgaauaucggcagccgcccccggauuagagauaucccuucccgcauuagcaucuacuggacaauugugaagcccggggacauccuccugaucaacucuaccggaaaucugauugccccuagaggcuauuuuaaaauccgguccgggaagucuucuauuaugcgcagcgacgcucccaucggaaaauguaaguccgaaugcauuaccccgaacggcucuaucccuaaugauaagcccuuccagaacgucaauagaaucacauacggcgccuguccucgguaugugaaacacagcacgcucaagcuggcgaccgggaugcgcaacgugcccgagaaacagacaagaggaauuuuuggcgccaucgcuggguucauugaaaauggaugggagggcauggucgacgggugguacggauuucggcaccaaaacuccgagggcagaggccaggccgcugaucuuaagagcacccaggccgccaucgaccaaauuaaugggaaacugaaccgccucaucggaaagacaaaugaaaaauuccaucagauugagaaggaguucucugaaguugaaggccggauccaggaucuggagaaguauguggaggacaccaaaaucgaucuuugguccuacaacgcugaacugcucguggcgcuggagaaucagcacacgauugaccugacagauagcgaaaugaacaagcucuuugagaaaaccaagaaacaacugagagaaaacgccgaggacauggggaauggaugcuucaagaucuaucauaagugugauaacgcuugcauuggcucuauccgcaaugggaccuacgaccacaacgucuaccgggacgaggcccuuaauaacagauuucagauuaaaggcguggaacugaaguccggauauaaagauuggauccucuggaucagcuucgccauuuccugcuuucugcuuuguguugcucugcucggcuucaucaugugggccugccagaaggggaauauucgcuguaacaucugcauuuga

SEQ ID NO: 196055 - RNA, 1701 nt, Artificial Sequence; identical to SEQ ID NO: 195465
  derived and/or modified sequence opt5 from hemagglutinin__InfluenzaA__ALA08545

SEQ ID NO: 196056 - RNA, 1701 nt, Artificial Sequence; identical to SEQ ID NO: 195465
  derived and/or modified sequence opt5 from hemagglutinin__InfluenzaA__ALA08546

SEQ ID NO: 196057 - RNA, 1701 nt, Artificial Sequence
  derived and/or modified sequence opt5 from hemagglutinin__InfluenzaA__ALA08548
augaagaccaucauugcccugagcuacauccucugccugguguucgcucagaaacuucccgagaacgacaauuccacagccacgcugugucucggccaccaugcggucccuaacgggaccauuguuaagacaaucaccucugauagaauugaagugacaaaugcuaccgagcuggugcaaaacagcuccaucggagaaaucugcgacucuccgcaccagauucuugauggcaaaaauuguacacugaucgacgcccuccugggggauccccagugcgacggauuucagaacaagaaaugggaucuguucgucgagcggagcaaggccuauuccaauuguuacccuuaugacgugcccgauuacgcuucucuccgcagccugguugccuccagcggcacccuugaauuuaacgacgagucuuucaauugggcugggguggcccaaaacggaacguccagcgcgugcauuagaggcucuaauuccagcuuuuucucucggcugaacuggcucacccauuccaauuuuaaguauccugcccugaacgucacaaugcccaauaacgagcaguucgauaaacuuuacaucuggggcgugcaccauccugggaccgacaaggaucagauuuuucuguaugcucagagcuccggacgcaucacaguuucuaccaaaagaagccaacaggccgugauuccgaacaucggcucccggccccgcaucagaaauauuccuagccggaucucuauuuacuggacgaucgucaagcccggggacauucuccugaucaacuccacaggaaaucugaucgcuccucgcggcuacuucaaaauuagaagcgggaagucuagcaucaugcgguccgacgcccccauuggaaaguguaaaucugaaugcaucaccccgaacggcagcauuccuaaugauaagcccuuucagaacgugaaucgcaucacauauggcgcguguccuagauacgugaaacaguccacccucaagcuggccaccgggaugcggaacguccccgagaaacaaacacgcggaaucuucggcgcuauugccggguuuaucgaaaauggaugggagggcaugaaggacgggugguauggauucagacaccagaacagcgagggccggggccaggcugccgaucuuaaaucuacgcaagccgcuauugaccagaucaaugggaagcugaacagacucauuggaaagaccaaugaaaaauuccaccagaucgagaaggaauuuuccgagguugaaggccgcauucaggaucuggagaaauacguggaggacacaaagaucgaucuuuggagcuauaacgcggaacugcucguggcccuggagaaucaacauaccaucgaccugacagauucugaaaugaacaaacucuucgagaagaccaagaaacagcugcgggaaaacgcugaggacauggggaauggaugcuuuaagauuuaccacaaaugugauaacgccugcaucggcuccauuagaaaugggacguaugaccaugacgucuaccgcgaugaggcccuuaacaaucgguuccagaucaagggcguggaacugaaaagcggauacaaggacuggauucucuggaucuccuuugcuaucucuugcuuccugcuuuguguugcccugcucggcuuuauuaugugggcgugccagaaggggaacaucagauguaauauuugcaucuga

SEQ ID NO: 196058 - RNA, 1701 nt, Artificial Sequence
  derived and/or modified sequence opt5 from hemagglutinin__InfluenzaA__ALA08549
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcacaggcgucaucugcgacuccccgcaccagauucuggauggggagaacuguacccuuaucgacgcccugcucggagauccccagugcgacggcuuucagaauaaaaagugggaucuguucguggaacggucuaaagccuauagcaacuguuacccuuaugacguucccgauuacgcuucccugcgcucucucguggccagcuccgggacgcuggaguuuaauaacgaaucuuucaauuggaccggagucacacaaaacggcaccucuuccgcuugcauuagacggagcagcuccagcuuuuucucucgccuuaauuggcugacacaucucaacuauaccuacccugcccugaaugugacgaugcccaacaacgagcaguuugacaaacuuuauaucuggggcguucaccauccugggacagauaaggaccagauuuuccuguacgcgcaguccagcggaagaaucaccguguccacaaaaggcucucaacaggccgucauuccgaauaucgggagccggccccgcaucagagauauuccuucccggaucagcauuuacuggaccaucgugaagcccggagacauucuccugaucaacucuaccggcaaucugaucgcuccucgcggguauuuuaaaauuagauccggaaagagcucuaucaugcggagcgacgcccccauuggcaaauguaaguccgagugcaucacaccgaacggcucuauuccuaaugauaagcccuuccagaacgugaaucgcaucacguacggggcuuguccuagauaugucaaacacagcacccucaagcuggccacaggaaugcggaacguucccgaaaaacagacccgcggcaucuuuggggcgauugccggauucaucgagaauggcugggaagggaugguggacggaugguacggcuuuagacaccaaaacuccgagggccgggggcaggcugccgaucuuaagagcacacaggcugccauugaccaaaucaauggaaaacugaacagacucauuggcaagaccaaugagaaauuccaucagaucgaaaaggaguucucugaaguggaggggcgcauucaggaucuggaaaaguaugucgaggacacgaaaaucgaucuuugguccuacaacgccgagcugcucguggcucuggaaaaucagcacacaaucgaccugaccgauagcgagaugaacaagcucuuugaaaagacccggaagcaacugagagagaacgcggaagacaugggaaauggcugcuucaaaauuuaucauaagugugauaacgccugcaucgggucuauucgcaauggcacauacgaccacaacguuuaccgggacgaggcucuuaauaacagauuucagaucaagggaguggagcugaaauccggcuauaaggauuggauucucuggaucagcuucgccaucuccugcuuucugcuuugugucgcccugcucggguucauuaugugggcuugccagaaaggaaauauccgcuguaacauuugcaucuga

SEQ ID NO: 196059 - RNA, 1701 nt, Artificial Sequence; identical to SEQ ID NO: 196022
  derived and/or modified sequence opt5 from hemagglutinin__InfluenzaA__ALA08550

SEQ ID NO: 196060 - RNA, 1701 nt, Artificial Sequence
  derived and/or modified sequence opt5 from hemagglutinin__InfluenzaA__ALA08551
augaagaccaucauugcccugagcuacauccucugccugguguucgcucagaaacuucuggagaacgacaauuccacagccacgcucugucugggccaccaugcgguccccaacgggaccauuguuaagacaaucaccucugauagaauugaagugacaaaugcuaccgagcuugugcaaaacagcuccaucggagaaaucugcgacucuccucaccagauucuggauggcaaaaauuguacacucaucgacgcccugcugggggauccgcagugcgacggauuucagaacaagaaaugggaucucuucgucgagcggagcaaggccuauuccaauuguuaccccuaugacgugccugauuacgcuucucugcgcagccuuguugccuccagcggcacccuggaauuuaacgacgagucuuucaauugggcuggggugacgcaaaacggaaccuccagcgccugcauuagaggcucuaauuccagcuuuuucucucggcucaacuggcugacacauuccaauuuuaaguaucccgcgcuuaacgucaccaugccuaauaacgagcaguucgauaaacuguacaucuggggcgugcaccaucccgggacagacaaggaucagauuuuucucuaugcccagagcuccggacgcaucaccguuucuacgaaaagaagccaacaggcugugauuccuaacaucggcucccggccgcgcaucagaaauauucccagccggaucucuauuuacuggacaaucgucaagccuggggacauucugcugaucaacuccaccggaaaucucaucgcuccccgcggcuacuucaaaauuagaagcgggaagucuagcaucaugcgguccgacgccccuauuggaaaguguaaaucugaaugcaucacacccaacggcagcauuccgaaugauaagccuuuucagaacgugaaucgcaucaccuauggcgccugucccagauacgugaaacaguccacccugaaacuugcgacagggaugcggaacgucccugagaagcaaacgcgcggaaucuucggcgccauugcuggguuuaucgaaaauggaugggagggcaugaaggacgggugguauggauucagacaccagaacagcgagggccggggccaggccgcugaucugaaaucuacccaagccgccauugaccagaucaaugggaagcucaacagacugauuggaaagacaaaugaaaaauuccaccagaucgagaaggaauuuuccgagguugaaggccgcauucaggaucuugagaaauacguggaggacaccaagaucgaucuguggagcuauaacgcugaacuccugguggcgcuggagaaucaacauacaaucgaccucaccgauucugaaaugaacaaacuguucgagaagacgaagaaacagcuucgggaaaacgccgaggacauggggaauggaugcuuuaagauuuaccacaaaugugauaacgcuugcaucggcuccauuagaaaugggacauaugaccauaacgucuaccgcgacgaggcccugaauaaccgguuccagaucaagggcguggaacucaaaagcggauacaaggauuggauucuguggaucuccuuugccaucucuugcuuccuucuguguguugcucuccugggcuuuauuaugugggccugccagaaggggaauaucagauguaacauuugcaucuga

SEQ ID NO: 196061 - RNA, 1701 nt, Artificial Sequence; identical to SEQ ID NO: 196022
  derived and/or modified sequence opt5 from hemagglutinin__InfluenzaA__ALA08552

SEQ ID NO: 196062 - RNA, 1701 nt, Artificial Sequence; identical to SEQ ID NO: 196022
  derived and/or modified sequence opt5 from hemagglutinin__InfluenzaA__ALA08553

SEQ ID NO: 196063 - RNA, 1701 nt, Artificial Sequence
  derived and/or modified sequence opt5 from hemagglutinin__InfluenzaA__ALA08554
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgcccccaucggaaaauguaaguccgaaugcauuaccccgaacggcucuaucccuaaugauaagcccuuccagaacgugaauagaaucacauacggcgcuuguccucgguaugugaaacacagcacgcucaagcuggccaccgggaugcgcaacguccccgagaaacagacaagaggaauuuuuggcgcgaucgccggguucauugaaaauggaugggagggcaugguugacgggugguacggauuucggcaccaaaacuccgagggcagaggccaggcugccgaucuuaagagcacccaggcugccaucgaccaaauuaaugggaaacugaaccgccucaucggaaagacaaaugaaaaauuccaucagauugagaaggaguucucugaaguggaaggccggauccaggaucuggagaaguauguggaggacaccaaaaucgaucuuugguccuacaacgccgaacugcucgucgcucuggagaaucagcacacgauugaccugacagauagcgaaaugaacaagcucuuugagaaaaccaagaaacaacugagagaaaacgcggaggacauggggaauggaugcuucaagaucuaucauaagugugauaacgccugcauuggcucuauccgcaaugggaccuacgaccacaacguguaccgggacgaggcucuuaauaacagauuucagauuaaaggcguugaacugauguccggauauaaggauuggauccucuggaucagcuucgccauuuccugcuuucugcuuuguguggcccugcucggcuucaucaugugggcuugccagaaagggaauauucgcuguaacaucugcauuuga

SEQ ID NO: 196064 - RNA, 1701 nt, Artificial Sequence
  derived and/or modified sequence opt5 from hemagglutinin__InfluenzaA__ALA08555
augaagaccaucauugcccugagcuacauccucugccugguguucgcucagaaacuucccgagaacgacaauuccacagccacgcugugucucggccaccaugcggucccuaacgggaccauuguuaagacaaucaccucugaucaaauugaagugacaaaugcuaccgagcuggugcagaacagcuccaucggagaaaucugcgacucuccgcaccagauucuugauggcaaaaauuguacacugaucgacgcccuccugggggauccccagugcgacggauuucaaaacaagaaaugggaucuguucgucgagagaagcaaggccuauuccaauuguuacccuuaugacgugcccgauuacgcuucucuccggagccugguugccuccagcggcacccuugaauuuaacgacgagucuuucaauugggcuggggugacgcagaacggaaccuccagcgccugcauucgcggcucuaauuccagcuuuuucucuagacugaacuggcucacacauuccaauuuuaaguauccugcgcugaacgucaccaugcccaauaacgagcaguucgauaaacuuuacaucuggggcgugcaccauccugggacagacaaggaucagauuuuucuguaugcccaaagcuccggacggaucaccguuucuacgaaacgcagccagcaggcugugauuccguccaucggcagcagaccccggauccgcaacauuccuucuagaaucuccauuuacuggacaaucgucaagcccggggacauucuccugaucaauagcaccggaaaccugaucgccccucggggcuacuucaaaauucgcucugggaagucuuccaucaugagaucugacgcucccauuggaaaguguaaaagcgaaugcaucacaccgaauggcuccauuccuaacgauaagcccuuucagaaugugaaccggaucaccuauggcgccuguccucgcuacgugaaacaaagcacccucaagcuggcgacagggaugagaaauguccccgagaaacagacgcggggaaucuucggcgccauugcuggguuuaucgaaaacggaugggagggcaugaaggacgggugguauggauuccgccaccagaauagcgagggcagaggccaagccgcugaucuuaaauccacccaggccgccauugaccagaucaacgggaagcugaaucggcucauuggaaagacaaacgaaaaauuccaccagaucgagaaggaauuuagcgagguugaaggccgcauucaagaucuggagaaauacguggaggacaccaagaucgaucuuuggucuuauaaugcugaacugcucguggcgcuggagaaccagcauacaaucgaccugaccgauuccgaaaugaauaaacucuucgagaagacgaagaaacagcugagagaaaacgccgaggacauggggaacggaugcuuuaagauuuaccacaaaugugauaaugcuugcaucggcagcauucggaacgggacauaugaccauaaugucuacagagacgaggcccuuaacaaucgcuuccagaucaagggcguggaacugaaauccggauacaaggauuggauucucuggaucucuuuugccaucagcugcuuccugcuuuguguugcucugcucggcuuuauuaugugggccugccaaaaggggaacauccgguguaauauuugcaucuga

SEQ ID NO: 196065 - RNA, 1701 nt, Artificial Sequence
  derived and/or modified sequence opt5 from hemagglutinin__InfluenzaA__ALA08556
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggaaucacccaaaacggcacaucuuccgcuugcauuagacggagcagcuccagcuuuuucucucgccuuaauuggcugacccaucucaacuauacauacccugcccugaaugugaccaugcccaacaacgagcaguuugacaaacuuuauaucuggggcguccaccauccugggacggauaaggaccagauuuuccuguacgcgcaguccagcggaagaaucacaguguccaccaagcggucucaacaggccguuaucccgaauauuggcagccgccccagaauccgggauauuccuucccgcaucagcauuuacuggacaaucgugaagcccggggacauccuccugauuaacucuaccggaaaucugaucgcuccuagaggcuauuuuaaaauucgguccgggaagucuucuaucaugcgcagcgacgcccccauuggaaaauguaaguccgaaugcaucaccccgaacggcucuaucccuaaugauaagcccuuccagaacgucaauagaauuacauacggcgcuuguccucgguaugugaaacacagcacgcucaagcuggccaccgggaugcgcaacgugcccgagaaacagacaagaggaaucuuuggcgcgauugccggguucaucgaaaauggaugggagggcauggucgacgggugguacggauuucggcaccaaaacuccgagggcagaggccaggcugccgaucuuaagagcacccaggcugccauugaccaaaucaaugggaaacugaaccgccucauuggaaagacaaaugaaaaauuccaucagaucgagaaggaguucucugaaguugaaggccggauccaggaucuggagaaguauguggaggacaccaaaauugaucuuugguccuacaacgccgaacugcucguggcucuggagaaucagcacacgaucgaccugacagauagcgaaaugaacaagcucuuugagaaaaccaagaaacaacugagagaaaacgcggaggacauggggaauggaugcuucaagauuuaucauaagugugauaacgccugcaucggcucuauucgcaaugggaccuacgaccacaacgucuaccgggacgaggcucuuaauaacagauuucagaucaaaggcguggaacugaaguccggauauaaagauuggauccucuggauuagcuucgccaucuccugcuuucugcuuuguguugcccugcucggcuucauuaugugggcuugccagaaggggaauauccgcuguaacauuugcaucuga

SEQ ID NO: 196066 - RNA, 1701 nt, Artificial Sequence; identical to SEQ ID NO: 196022
  derived and/or modified sequence opt5 from hemagglutinin__InfluenzaA__ALA08557

SEQ ID NO: 196067 - RNA, 1701 nt, Artificial Sequence; identical to SEQ ID NO: 196022
  derived and/or modified sequence opt5 from hemagglutinin__InfluenzaA__ALA08558

SEQ ID NO: 196068 - RNA, 1701 nt, Artificial Sequence
  derived and/or modified sequence opt5 from hemagglutinin__InfluenzaA__ALA08559
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgagauccagcggacggauuacaguuuccaccaagggcucucagcaagccgugaucccgaauaucgggagccgcccccggauuagagauaucccuucccgcauuagcaucuacuggacaauugucaagcccggagacauccuccugaucaacucugcuggcaaucugauugccccuagaggguauuuuaaaauccgguccggaaagagcucuauuaugcgcagcgacgcucccaucggcaaauguaaguccgaaugcauuaccccgaacggcucuaucccuaaugauaagcccuuccagaacgugaauagaaucaccuacggggccuguccucgguaugugaaacacagcacacucaagcuggcgacgggaaugcgcaacguccccgagaaacagaccagaggcauuuuuggggccaucgcuggauucauugaaaauggcugggaggggaugguugacggaugguacggcuuucggcaccagaacuccgagggcagagggcaagccgcugaucuuaagagcacacaggccgccaucgaccagauuaauggaaaacugaaccgccucaucggcaagaccaaugaaaaauuccaucaaauugagaaggaguucucugaaguggaagggcggauccaggaucuggagaaguauguggaggacacaaaaaucgaucuuugguccuacaacgcugaacugcucgucgcgcuggagaaucagcacaccauugaccugacggauagcgaaaugaacaagcucuuugagaaaacaaagaaacagcugagagaaaacgccgaggacaugggaaauggcugcuucaagaucuaucauaagugugauaacgcuugcauugggucuauccgcaauggcaccuacgaccacaacguguaccgggacgaggcccuuaauaacagauuucaaauuaaaggaguugaacugaaguccggcuauaaagauuggauccucuggaucagcuucgccauuuccugcuuucugcuuuguguggcucugcucggguucaucaugugggccugccagaagggaaauauucgcuguaacaucugcauuuga

SEQ ID NO: 196069 - RNA, 1701 nt, Artificial Sequence; identical to SEQ ID NO: 195465
  derived and/or modified sequence opt5 from hemagglutinin__InfluenzaA__ALA08560

SEQ ID NO: 196070 - RNA, 1701 nt, Artificial Sequence
  derived and/or modified sequence opt5 from hemagglutinin__InfluenzaA__ALA08561
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauaaguacccugcccugaaugucacaaugcccaacaaggagcaguuugacaaacuuuauauuuggggcgugcaccauccugggaccgauaaggaccagaucuuccuguacgcgcaguccagcggaagaauuacgguuuccacaaaacggucucaacaggccgugaucccgaacaucggcagccgcccccggauuagagauaucccuucccgcauuagcaucuacuggaccauugucaagcccggggacauccuccugaucaauucuacaggaaaccugauugcuccuagaggcuauuuuaaaauccgguccgggaagucuucuauuaugcgcagcgacgcccccaucggaaaguguaaauccgaaugcauuaccccgaauggcucuaucccuaacgauaagcccuuccagaaugugaacagaaucaccuacggcgcuuguccucgguaugugaaacacagcacacucaagcuggccacggggaugcgcaauguccccgagaaacagaccagaggaauuuuuggcgcgaucgccggguucauugaaaacggaugggagggcaugguugacgggugguacggauuucggcaccaaaauuccgagggcagaggccaggcugccgaucuuaagagcacacaggcugccaucgaccaaauuaacgggaaacugaaucgccucaucggaaagaccaacgaaaaguuccaucagauugagaaagaguucucugaaguggaaggccggauccaggaucuggagaaguauguggaggacacaaaaaucgaucuuugguccuacaaugccgaacugcucgucgcucuggagaaccagcacaccauugaccugacggauagcgaaaugaauaagcucuuugagaaaacaaagaagcaacugagagaaaacgcggaggacauggggaacggaugcuucaaaaucuaucauaagugugauaaugccugcauuggcucuauccgcaacgggaccuacgaccacaauguguaccgggacgaggcucuuaacaauagauuucagauuaaaggcguugaacugaaguccggauauaaagauuggauccucuggaucagcuucgccauuuccugcuuucugcuuuguguggcccugcucggcuucaucaugugggcuugccagaaggggaacauucgcuguaauaucugcauuuga

SEQ ID NO: 196071 - RNA, 1701 nt, Artificial Sequence
  derived and/or modified sequence opt5 from hemagglutinin__InfluenzaA__ALA08563
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaagcuguauauuuggggcgugcaccauccugggacggauaaggaccagaucuuccuguacgcgcaguccagcggaagaauuacaguuuccaccaaacggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccucuccgggaagucuucuauuaugcggagcgacgcccccaucggaaaauguaaguccgaaugcauuaccccgaacggcucuaucccuaaugauaagcccuuccagaacgugaaucgcaucacauacggcgcuuguccuagauaugugaaacacagcacgcugaaacuugccaccgggaugcggaacguccccgagaagcagacacgcggaauuuuuggcgcgaucgccggguucauugaaaauggaugggagggcaugguugacgggugguacggauuuagacaccaaaacuccgagggccggggccaggcugccgaucuuaagagcacccaggcugccaucgaccaaauuaaugggaaacucaacagacugaucggaaagacaaaugaaaaauuccaucagauugagaaggaguucucugaaguggaaggccgcauccaggaucuugagaaguauguggaggacaccaaaaucgaucugugguccuacaacgccgaacuccuggucgcucuggagaaucagcacacgauugaccucacagauagcgaaaugaacaagcuguuugagaaaaccaagaaacaacuucgggaaaacgcggaggacauggggaauggaugcuucaagaucuaucauaagugugauaacgccugcauuggcucuaucagaaaugggaccuacgaccacaacguguaccgcgacgaggcucugaauaaccgguuucagauuaaaggcguugaacucaaguccggauauaaagauuggauccuguggaucagcuucgccauuuccugcuuucuucuguguguggcccuccugggcuucaucaugugggcuugccagaaggggaauauuagauguaacaucugcauuuga

SEQ ID NO: 196072 - RNA, 1701 nt, Artificial Sequence
  derived and/or modified sequence opt5 from hemagglutinin__InfluenzaA__ALA08571
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgcccccaucggaaaauguaaguccgaaugcauuaccccgaacggcucuaucccuaaugauaagcccuuccagaacgugaauagaaucacauacggcgcuuguccucgguaugugaaacacagcacgcucaagcuggccaccgggaugcgcaacguccccgagaaacagacaagaggaauuuuuggcgcgaucgccggguucauugaaaauggaugggagggcaugguugacgggugguacggauuucggcaccaaaacuccgagggcagaggccaggcugccgaucuuaagagcacccaggcugccaucgaccaaauuaaugggaaacugaaccgccucaucggaaagacaaaugaaaaauuccaucagauugagaaggaguucucugaaguggaaggccggauccaggaucuggagaaguauguggaggacaccaaaaucgaucuuugguccuacaacgccgaacugcucgucgcucuggagaaucagcacacgauugaccugacagauagcgaaaugaacaagcucuuugagaaaaccaagaaacaacugagagaaaacgcggaggacauggggaauggaugcuucaagaucuaucauaagugugauaacgccugcauuggcucuauccgcaaugggaccuacgaccacaacguguaccgggacgaggcucuuaauaacagauuucagauuaaaggcguugaacugaaguccggauauaaagauuggauccucuggaucagcuucgccacauccugcuuucugcuuuguguggcccugcucggcuucauuaugugggcuugccagaaggggaauauccgcuguaacauuugcaucuga

SEQ ID NO: 196073 - RNA, 1701 nt, Artificial Sequence; identical to SEQ ID NO: 196008
  derived and/or modified sequence opt5 from hemagglutinin__InfluenzaA__ALA08572

SEQ ID NO: 196074 - RNA, 1701 nt, Artificial Sequence; identical to SEQ ID NO: 196005
  derived and/or modified sequence opt5 from hemagglutinin__InfluenzaA__ALA08573

SEQ ID NO: 196075 - RNA, 1701 nt, Artificial Sequence
  derived and/or modified sequence opt5 from hemagglutinin__InfluenzaA__ALA08574
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaagcuguauauuuggggcgugcaccauccugggacggauaaggaccagaucuuccuguacgcgcaguccagcggaagaauuacaguuuccaccaaacggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgcccccaucggaaaauguaaguccgaaugcauuaccccgaacggcucuaucccuaaugauaagcccuuccagaacgugaauagaaucacauacggcgcuuguccucgguaugugaaacacagcacgcucaagcuggccaccgggaugcgcaacguccccgagaaacagacaagaggaauuuuuggcgcgaucgccggguucauugaaaauggaugggagggcaugguugacgggugguacggauuucggcaccaaaacuccgagggcagaggccaggcugccgaucuuaagagcacccaggcugccaucgaccaaauuucugggaaacugaaucgccucaucggaaagacaaacgaaaaauuccaucagauugagaaggaguucuccgaaguggaaggccggauccaggaucuggagaaguauguggaggacaccaaaaucgaucuuuggagcuacaaugccgaacugcucgucgcucuggagaaccagcacacgauugaccugacagauucugaaaugaauaagcucuuugagaaaaccaagaaacaacugagagaaaacgcggaggacauggggaacggaugcuucaagaucuaucauaagugugauaaugccugcauuggcuccauccgcaacgggaccuacgaccacaauguguaccgggacgaggcucuuaacaauagauuucagauuaaaggcguugaacuuaagagcggauauaaagauuggauccucuggaucuccuucgccauuucuugcuuucugcuuuguguggcccugcucggcuucaucaugugggcuugccagaaggggaacauucgcuguaauaucugcauuuga

SEQ ID NO: 196076 - RNA, 1701 nt, Artificial Sequence
  derived and/or modified sequence opt5 from hemagglutinin__InfluenzaA__ALA08575
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgcccccaucggaaaauguaaguccgaaugcauuaccccgaacggcucuaucccuaaugauaagcccuuccagaacgugaauagaaucacauacggcgcuuguccucgguaugugaaacagagcacgcucaagcuggccaccgggaugcgcaacguccccgagaaacaaacaagaggaauuuuuggcgcgaucgccggguucauugaaaauggaugggagggcaugguugacgggugguacggauuucggcaccagaacuccgagggcagaggccaggcugccgaucuuaagagcacccaagcugccaucgaccagauuaaugggaaacugaaccgccucaucggaaagacaaaugaaaaauuccaccagauugagaaggaguucucugaaguggaaggccggauccaggaucuggagaaguauguggaggacaccaaaaucgaucuuugguccuacaacgccgaacugcucgucgcucuggagaaucaacauacgauugaccugacagauagcgaaaugaacaagcucuuugagaaaaccaagaaacagcugagagaaaacgcggaggacauggggaauggaugcuucaagaucuaucacaagugugauaacgccugcauuggcucuauccgcaaugggaccuacgaccauaacguguaccgggacgaggcucuuaauaacagauuucagauuaaaggcguugaacugaaguccggauauaaagauuggauccucuggaucagcuucgccauuuccugcuuucugcuuuguguggcccugcucggcuucaucaugugggcuugccagaaggggaauauucgcuguaacaucugcauuuga

SEQ ID NO: 196077 - RNA, 1701 nt, Artificial Sequence; identical to SEQ ID NO: 195465
  derived and/or modified sequence opt5 from hemagglutinin__InfluenzaA__ALA08576

SEQ ID NO: 196078 - RNA, 1701 nt, Artificial Sequence; identical to SEQ ID NO: 195465
  derived and/or modified sequence opt5 from hemagglutinin__InfluenzaA__ALA08577

SEQ ID NO: 196079 - RNA, 1701 nt, Artificial Sequence
  derived and/or modified sequence opt5 from hemagglutinin__InfluenzaA__ALA08579
augaagaccaucauugcccugagcuacauccucugccugauuuucgcucagaaaauccccggcaacgacaauuccacagccacgcuuugucuggggcaccaugcggugccuaacggaaccauugucaagacaaucaccaaugauagaaucgagguuacaaacgcuaccgaacucgugcaaaauucuagcauuggcgagaucugcgacuccccgcaccagauucuggauggggaaaacuguacacuuaucgacgcccugcucggagauccccagugcgacggcuuucagaauaaaaagugggaucuguucguggagcggucuaaagccuauagcaacuguuacccuuaugacguccccgauuacgcuucccugcgcucucucguggccagcuccgggacccuggaauuuaauaacgagagcuucaauuggacgggaguuacccaaaacggcacaucuuccgcuugcauuagaaagucuagcuccagcuuuuucucucggcuuaauuggcugacccaucucaacuauacauacccugcccugaaugugaccaugcccaacaacgagcaguuugacaaacuuuauaucuggggcguccaccauccugggacggauaaggaccagauuuuccuguacgcgcgcuccagcggaagaaucacaguguccaccaagcggucucagcaagccguuaucccgaauauuggcagccgccccagaauccgggauauuccuucccgcaucagcauuuacuggacaaucgugaaacccggggacauccuccugauuaacucuaccggaaaucugaucgcuccuagaggcuauuuuaagauucgguccgggaaaagcucuaucaugcgcagcgacgcccccauuggaaaguguaaguccgaaugcaucaccccgaacggcucuaucccuaaugauaaacccuuccagaacgucaauagaauuacauacggcgcuuguccucgguaugugaagcacagcacgcucaaacuggccaccgggaugcgcaacgugcccgagaagcagacaagaggaaucuuuggcgcgauugccggguucaucgaaaauggaugggagggcauggucgacgggugguacggauuucggcaccagaacuccgagggcagaggccaagcugccgaucuuaaaagcacccaggcugccauugaccagaucaaugggaagcugaaccgccucauuggaaaaacaaaugaaaaguuccaucaaaucgagaaggaguucucugaaguugaaggccggauccaggaucuggagaaauauguggaggacaccaagauugaucuuugguccuacaacgccgaacugcucguggcucuggagaaucagcacacgaucgaccugacagauagcgaaaugaacaaacucuuugagaagaccaaaaagcagcugagagaaaacgcggaggacauggggaauggaugcuucaagauuuaucauaaaugugauaacgccugcaucggcucuauucgcaaugggaccuacgaccacaacgucuaccgggacgaggcucuuaauaacagauuucaaaucaagggcguggaacugaaauccggauauaaggauuggauccucuggauuagcuucgccaucuccugcuuucugcuuuguguugcccugcucggcuucauuaugugggcuugccagaaagggaauauccgcuguaacauuugcaucuga

SEQ ID NO: 196080 - RNA, 1701 nt, Artificial Sequence
  derived and/or modified sequence opt5 from hemagglutinin__InfluenzaA__ALA08580
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgagauccagcggacggauuacaguuuccaccaagggcucucagcaagccgugaucccgaauaucgggagccgcccccggauuagagauaucccuucccgcauuagcaucuacuggacaauugucaagcccggagacauccuccugaucaacucuaccggcaaucugauugcuccuagaggguauuuuaaaauccgguccggaaagagcucuauuaugcgcagcgacgcccccaucggcaaauguaaguccgaaugcauuaccccgaacggcucuaucccuaaugauaagcccuuccagaacgugaauagaaucacauacggggcuuguccucgguaugugaaacacagcacgcucaagcuggccaccggaaugcgcaacguccccgagaaacagacaagaggcauuuuuggggcgaucgccggauucauugaaaauggcugggaggggaugguugacggaugguacggcuuucggcaccagaacuccgagggcagagggcaagcugccgaucuuaagagcacccaggcugccaucgaccagauuaauggaaaacugaaccgccucaucggcaagacaaaugaaaaauuccaucaaauugagaaggaguucucugaaguggaagggcggauccaggaucuggagaaguauguggaggacaccaaaaucgaucuuugguccuacaacgccgaacugcucgucgcucuggagaaucagcacacgauugaccugacagauagcgaaaugaacaagcucuuugagaaaaccaagaaacagcugagagaaaacgcggaggacaugggaaauggcugcuucaagaucuaucauaagugugauaacgccugcauugggucuauccgcaauggcaccuacgaccacaacguguaccgggacgaggcucuuaauaacagauuucaaauuaaaggaguugaacugaaguccggcuauaaagauuggauccucuggaucagcuucgccauuuccugcuuucugcuuuguguggcccugcucggguucaucaugugggcuugccagaagggaaauauucgcuguaacaucugcauuuga

SEQ ID NO: 196081 - RNA, 1701 nt, Artificial Sequence
  derived and/or modified sequence opt5 from hemagglutinin__InfluenzaA__ALA08582
augaagaccaucauugcccugagcuacauccucugccugguguucgcucagaaacuucccgagaacgacaauuccacagccacgcugugucucggccaccaugcggucccuaacgggaccauuguuaagacaaucaccaaugauagaauugaagugacaaacgcuaccgagcuggugcaaaauucuagcaucggagaaaucugcgacuccccgcaccagauucuugauggcaaaaacuguacacugaucgacgcccuccugggggauccccagugcgacggauuucagaauaagaaaugggaucuguucgucgagcggucuaaggccuauagcaacuguuacccuuaugacgugcccgauuacgcuucccuccgcucucugguugccagcuccggcacccuugaauuuaaugacgagagcuucaacugggcuggggugacgcaaaauggaaccucuuccgccugcauuagaggcagcaacucuuccuuuuucagccggcugaauuggcucacacauucuaacuuuaaguauccugcgcugaaugucaccaugcccaacaacgagcaguucgauaaacuuuacaucuggggcgugcaccauccugggacagacaaggaucagauuuuucuguaugcccaguccagcggacgcaucaccguuuccacgaaaagaucucaacaggcugugauuccgaauaucggcagccggccccgcaucagaaacauuccuucccggaucagcauuuacuggacaaucgucaagcccggggacauucuccugaucaauucuaccggaaaccugaucgccccucgcggcuacuucaaaauuagauccgggaaguccucuaucaugcggagcgacgcucccauuggaaaguguaaauccgaaugcaucacaccgaauggcucuauuccuaacgauaagcccuuucagaaugugaaccgcaucaccuauggcgccuguccuagauacgugaaacagagcacccucaagcuggcgacagggaugcggaauguccccgagaaacaaacgcgcggaaucuucggcgccauugcuggguuuaucgaaaacggaugggagggcaugaaggacgggugguauggauucagacaccagaauagcgagggccggggccaggccgcugaucuuaaaagcacccaagccgccauugaccagaucaacgggaagcugaauagacucauuggaaagacaaacgaaaaauuccaccagaucgagaaggaauuuucugagguugaaggccgcauucaggaucuggagaaauacguggaggacaccaagaucgaucuuugguccuauaaugcugaacugcucguggcgcuggagaaccaacauacaaucgaccugaccgauagcgaaaugaacaaacucuucgagaagacgaagaaacagcugcgggaaaaugccgaggacauggggaacggaugcuuuaagauuuaccacaaaugugauaaugcuugcaucggcucuauuagaaacgggacauaugaccaugacgucuaccgcgaugaggcccuuaauaaccgguuccagaucaagggcguggaacugaaauccggauacaaggacuggauucucuggaucagcuuugccaucuccugcuuccugcuuuguguugcucugcucggcuuuauuaugugggccugccagaaggggaauaucagauguaacauuugcaucuga

SEQ ID NO: 196082 - RNA, 1701 nt, Artificial Sequence; identical to SEQ ID NO: 196081
  derived and/or modified sequence opt5 from hemagglutinin__InfluenzaA__ALA08583

SEQ ID NO: 196083 - RNA, 1701 nt, Artificial Sequence; identical to SEQ ID NO: 196081
  derived and/or modified sequence opt5 from hemagglutinin__InfluenzaA__ALA08584

SEQ ID NO: 196084 - RNA, 1701 nt, Artificial Sequence; identical to SEQ ID NO: 196081
  derived and/or modified sequence opt5 from hemagglutinin__InfluenzaA__ALA08585

SEQ ID NO: 196085 - RNA, 1701 nt, Artificial Sequence; identical to SEQ ID NO: 195465
  derived and/or modified sequence opt5 from hemagglutinin__InfluenzaA__ALA08586

SEQ ID NO: 196086 - RNA, 1701 nt, Artificial Sequence; identical to SEQ ID NO: 196081
  derived and/or modified sequence opt5 from hemagglutinin__InfluenzaA__ALA08587

SEQ ID NO: 196087 - RNA, 1701 nt, Artificial Sequence; identical to SEQ ID NO: 195465
  derived and/or modified sequence opt5 from hemagglutinin__InfluenzaA__ALA08588

SEQ ID NO: 196088 - RNA, 1701 nt, Artificial Sequence; identical to SEQ ID NO: 195465
  derived and/or modified sequence opt5 from hemagglutinin__InfluenzaA__ALA08589

SEQ ID NO: 196089 - RNA, 1701 nt, Artificial Sequence; identical to SEQ ID NO: 196081
  derived and/or modified sequence opt5 from hemagglutinin__InfluenzaA__ALA08590

SEQ ID NO: 196090 - RNA, 1701 nt, Artificial Sequence; identical to SEQ ID NO: 195465
  derived and/or modified sequence opt5 from hemagglutinin__InfluenzaA__ALA08591

SEQ ID NO: 196091 - RNA, 1701 nt, Artificial Sequence; identical to SEQ ID NO: 196022
  derived and/or modified sequence opt5 from hemagglutinin__InfluenzaA__ALA08592

SEQ ID NO: 196092 - RNA, 1701 nt, Artificial Sequence
  derived and/or modified sequence opt5 from hemagglutinin__InfluenzaA__ALA08594
augaagaccaucauugcccugagcuacauccucugccugguguucgcucagaaacuucccgagaacgacaauuccacagccacgcugugucucggccaccaugcggucccuaacgggaccauuguuaagacaaucaccucugauagaauugaagugacaaaugcuaccgagcuggugcaaaacagcuccaucggagaaaucugcgacucuccgcaccagauucuugauggcaaaaauuguacacugaucgacgcccuccugggggauccccagugcgacggauuucagaacaagaaaugggaucuguucgucgagcggagcaaggccuauuccaauuguuacccuuaugacgugcccgauuacgcuucucuccgcagccugguugccuccagcggcacccuugaauuuaacgacgagucuuucaauugggcuggggugacgcaaaacggaaccuccagcgccugcauuagaggcucuaauuccagcuuuuucucucggcugaacuggcucacacauuccaauuuuaaguauccugcgcugaacgucaccaugcccaauaacgagcaguucgauaaacuuuacaucuggggcgugcaccauccugggacagacaaggaucagauuuuucuguaugcccagagcuccggacgcaucaccguuucuacgaaaagaagccaacaggcugugauuccgaacaucggcucccggccccgcaucagaaauauuccuagccggaucucuauuuacuggacaaucgucaagcccggggacauucuccugaucaacuccaccggaaaucugaucgccccucgcggcuacuucaaaauuagaagcgggaagucuagcaucaugcgguccgacgcucccauuggaaaguguaaaucugaaugcaucacaccgaacggcagcauuccuaaugauaagcccuuucagaacgugaaucgcaucaccuauggcgccuguccuagauacgugaaacaguccacccucaagcuggcgacagggaugcggaacguccccgagaaacaaacgcgcggaaucuucggcgccauugcuggguuuaucgaaaauggaugggagggcaugaaggacgggugguauggauucagacaccagaacagcgagggccggggccaggccgcugaucuuaaaucuacccaagccgccauugaccagaucaaugggaagcugaacagacucauuggaaagacaaaugaaaaauuccaccagaucgagaaggaauuuuccgagguugaaggccgcauucaggaucuggagaaauacguggaggacaccaagaucgaucuuuggagcuauaacgcugaacugcucguggcgcuggagaaucaacauacaaucgaccugaccgauucugaaaugaacaaacucuucgagaagacgaagaaacagcugcgggaaaacgccgaggacauggggaauggaugcuuuaagauuuaccacaaaugugauaacgcuugcaucggcuccauuagaaaugggacauaugaccaugacgucuaccgcgaugaggcccuuaacaaucgguuccagaucaagggcguggaacugaaaagcggauacaaggacuggauucucuggaucuccuuugccaugucuugcuuccugcuuuguguugcucugcucggcuuuaucaugugggccugccagaaggggaacauuagauguaauaucugcauuuga

SEQ ID NO: 196093 - RNA, 1701 nt, Artificial Sequence; identical to SEQ ID NO: 195465
  derived and/or modified sequence opt5 from hemagglutinin__InfluenzaA__ALA08595

SEQ ID NO: 196094 - RNA, 1701 nt, Artificial Sequence; identical to SEQ ID NO: 195465
  derived and/or modified sequence opt5 from hemagglutinin__InfluenzaA__ALA08596

SEQ ID NO: 196095 - RNA, 1701 nt, Artificial Sequence
  derived and/or modified sequence opt5 from hemagglutinin__InfluenzaA__ALA08597
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgcccccaucggaaaauguaaguccgaaugcauuaccccgaacggcucuaucccuaaugauaagcccuuccagaacgugaauagaaucacauacggcgcuuguccucgguaugugaaacacagcacgcucaagcuggccaccgggaugcgcaacguccccgagaaacagacaagaggaauuuuuggcgcgaucgccggguucauugaaaauggaugggagggcaugguugacgggugguacggauuucggcaccaaaacuccgagggcagaggccaggcugccgaucuuaagagcacccaggcugccaucgaccaaauuaaugggaaacugaaccgccucaucggaaagacaaaugaaaaauuccaucagauugagaaggaguucucugaaguggaaggccggauccaggaucuggagaaguauguggaggacaccaaaaucgaucuuugguccuacaacgccgaacugcucgucgcucuggagaaucagcacacgauugaccugacagauagcgaaaugaacaagcucuuugagaaaaccaagaaacaacugagagaaaacgcggaggacauggggaauggaugcuucaagaucuaucauaagugugauaacgccugcauuggcucuauccgcaaugggaccuacgaccacaacguguaccgggacgaggcucuuaauaacagauuucagauuaaaggcguugaacugaaguccggauauaaagauuggauccucuggaucagcuucgccauuuccugcuuucugcuuuguguggcccugcucggcuucaucaugugggcuugccagaaugggaacauucgcuguaauaucugcauuuga

SEQ ID NO: 196096 - RNA, 1701 nt, Artificial Sequence
  derived and/or modified sequence opt5 from hemagglutinin__InfluenzaA__ALA08598
augaagaccaucauugccagcuccuacauccugugccucguguucgcucagaaaauucccggcaacgacaauucuacagccacgcugugucuugggcaccaugcggucccuaacggaaccaucguuaagacaauuaccaaugauagaaucgaggugacaaacgcuaccgaacuggugcaaaauagcuccaucggcgagauuugcgacucuccgcaccagauccucgauggggaaaacuguacacugauugacgcccuucugggagauccccagugcgacggcuuucagaauaaaaagugggaucucuucgucgagcggagcaaagccuauuccaacuguuacccuuaugacgugcccgauuacgcuucucugcgcagccugguugccuccagcgggacccucgaauuuaauaacgagucuuucaauuggacgggagugacccaaaacggcacauccagcgcuugcaucagacggucuuccagcucuuucuucucccgccugaauuggcuuacccaucugaacuauacauacccugcccucaaugucaccaugcccaacaacgagcaguuugacaagcuguauauuuggggcgugcaccauccugggacggauaaggaccagaucuuccuuuacgcgcagagcuccggaagaauuacaguuucuaccaaacggagccaacaggccgugaucccgaauaucggcucccgcccccggauuagagauaucccuagccgcauuucuaucuacuggacaauugucaagcccggggacauccugcucaucaacuccaccggaaaucugauugcuccuagaggcuauuuuaaaauccggagcgggaagucuagcauuaugcgcuccgacgcccccaucggaaaauguaagucugaaugcauuaccccgaacggcagcaucccuaaugauaagcccuuccagaacgugaauagaaucacauacggcgcuuguccucgguaugugaaacacuccacgcugaagcucgccaccgggaugcgcaacguccccgagaaacagacaagaggaauuuuuggcgcgaucgccggguucauugaaaauggaugggagggcaugguugacgggugguacggauuucggcaccaaaacagcgagggcagaggccaggcugccgaucugaagucuacccaggcugccaucgaccaaauuaaugggaaacuuaaccgccugaucggaaagacaaaugaaaaauuccaucagauugagaaggaauuuuccgagguggaaggccggauccaggaucucgagaaguauguggaggacaccaaaaucgaucuguggagcuacaacgccgaacuucuggucgcucucgagaaucagcacacgauugaccugacagauucugaaaugaacaagcuguuugagaaaaccaagaaacaacucagagaaaacgcggaggacauggggaauggaugcuucaagaucuaucauaagugugauaacgccugcauuggcuccauccgcaaugggaccuacgaccacaacguguaccgggacgaggcucugaauaacagauuucagauuaaaggcguugaacuuaagagcggauauaaagauuggauccuguggaucuccuucgccauuucuugcuuucuccuguguguggcccuucugggcuucaucaugugggcuugccagaaggggaauauucgcuguaacaucugcauuuga

SEQ ID NO: 196097 - RNA, 1701 nt, Artificial Sequence; identical to SEQ ID NO: 195465
  derived and/or modified sequence opt5 from hemagglutinin__InfluenzaA__ALA08599

SEQ ID NO: 196098 - RNA, 1701 nt, Artificial Sequence
  derived and/or modified sequence opt5 from hemagglutinin__InfluenzaA__ALA08600
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauagauacccugcccugaaugucacaaugcccaacaacgagcaguuugacaagcuguauauuuggggcgugcaccauccugggaccgauaaggaccagaucucccuguacgcgcagagcuccggacggauuacgguuucuacaaaacgcagccaacaggccgugaucccgaauaucggcuccagaccccggauucgcgauaucccuagcagaauuucuaucuacuggaccauugucaagcccggggacauccuccugaucaacuccacaggaaaucugauugcuccucggggcuauuucaaaauccgcagcgggaagucuagcauuaugagauccgacgcccccaucggaaaauguaagucugaaugcauuaccccgaacggcagcaucccuaaugauaagcccuuucagaacgugaaucggaucaccuacggcgcuuguccucgcuaugugaaacacuccacacucaagcuggccacggggaugagaaacguccccgagaaacagacccggggaauuuucggcgcgaucgccggguuuauugaaaauggaugggagggcaugguugacgggugguacggauucagacaccaaaacagcgagggccgcggccaggcugccgaucuuaagucuacacaggcugccaucgaccaaauuaaugggaaacugaaccggcucaucggaaagaccaaugaaaaauuucaucagauugagaaggaguucuccgaaguggaaggcagaauccaggaucuggagaaguauguggaggacacaaaaaucgaucuuuggagcuacaacgccgaacugcucgucgcucuggagaaucagcacaccauugaccugacggauucugaaaugaacaaacucuucgagaagacaaagaaacaacugcgcgaaaacgcggaggacauggggaauggaugcuuuaagaucuaucauaagugugauaacgccugcauuggcuccauccggaaugggaccuacgaccacaacguguacagagacgaggcucuuaauaaccgcuuccagauuaaaggcguugaacuuaagagcggauauaaagauuggauccucuggaucuccuuugccauuucuugcuuccugcuuuguguggcccugcucggcuuuaucaugugggcuugccagaaggggaauauucgguguaacaucugcauuuga

SEQ ID NO: 196099 - RNA, 1701 nt, Artificial Sequence; identical to SEQ ID NO: 195465
  derived and/or modified sequence opt5 from hemagglutinin__InfluenzaA__ALA08601

SEQ ID NO: 196100 - RNA, 1701 nt, Artificial Sequence
  derived and/or modified sequence opt5 from hemagglutinin__InfluenzaA__ALA08602
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacgauuuucagaauaaaaagugggaccuguucgucgagcggucuaaagccuauagcaacuguuacccuuaugaugugcccgacuacgcuucccugcgcucucucguugccagcuccggcacccuggaauuuaauaacgagagcuucaauuggacgggggugacccaaaacggaacaucuuccgcuugcaucagacggucuagcuccagcuuuuucucucgccuuaauuggcugacccaucucaacuauacauacccugcccugaaugucaccaugcccaacaacgagcaguuugauaagcuguauauuuggggcgugcaccauccuggcacggacaaggaucagaucucccuguacgcgcagagcuccgggagaauuacaguuucuaccaaacggagccaacaggccgugaucccgaauaucggaucccgcccccggauuagagacaucccuagccgcauuucuaucuacuggacaauugucaagcccggcgacauccuccugaucaacuccaccgggaaucugauugcuccuagaggauauuucaaaauccggagcggcaagucuagcauuaugcgcuccgaugcccccaucgggaaauguaagucugaaugcauuaccccgaacggaagcaucccuaaugacaagcccuuucagaacgugaauagaaucacauacggcgcuuguccucgguaugugaaacacuccacgcucaagcuggccaccggcaugcgcaacguccccgagaaacagacaagagggauuuucggagcgaucgccggcuuuauugaaaaugggugggagggaaugguugauggcugguacggguuccggcaccaaaacagcgagggaagaggccaggcugccgaccuuaagucuacccaggcugccaucgaucaaauuaauggcaaacugaaccgccucaucgggaagacaaaugaaaaauuucaucagauugagaaggaguucuccgaaguggaaggacggauccaggaccuggagaaguauguggaggauaccaaaaucgaccuuuggagcuacaacgccgaacugcucgucgcucuggagaaucagcacacgauugaucugacagacucugaaaugaacaaacucuucgagaagaccaagaaacaacugagagaaaacgcggaggauaugggcaaugggugcuuuaagaucuaucauaagugugacaacgccugcauuggauccauccgcaauggcaccuacgaccacaacguguaccgggaugaggcucuuaauaacagauuccagauuaaagggguugaacuuaagagcggcuauaaagacuggauccucuggaucuccuuugccauuucuugcuuccugcuuuguguggcccugcucggauuuaucaugugggcuugccagaagggcaauauucgcuguaacaucugcauuuga

SEQ ID NO: 196101 - RNA, 1701 nt, Artificial Sequence
  derived and/or modified sequence opt5 from hemagglutinin__InfluenzaA__ALA08603
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauauuuacccugcccugaaugucacaaugcccaacaacgagcaguuugacaaacuuuauaucuggggcgugcaccauccugggaccgauaaggaccagauuuuccuguacgcgcaguccagcggaagaaucacgguuuccacaaagcggucucaacaggccgugaucccgaauauuggcagccgccccagaauccgggauauuccuucccgcaucagcauuuacuggaccaucgucaagcccggggacauccuccugauuaacucuacaggaaaucugaucgcuccuagaggcuauuuuaaaauucgguccgggaagucuucuaucaugcgcagcgacgcccccauuggaaaauguaaguccgaaugcaucaccccgaacggcucuaucccuaaugauaagcccuuccagaacgugaauagaauuaccuacggcgcuuguccucgguaugugaaacacagcacacucaagcuggccacggggaugcgcaacguccccgagaaacagaccagaggaaucuuuggcgcgauugccggguucaucgaaaauggaugggagggcaugguugacgggugguacggauuucggcaccaaaacuccgagggcagaggccaggcugccgaucuuaagagcacacaggcugccauugaccaaaucaaugggaaacugaaccgccucauuggaaagaccaaugaaaaauuccaucagaucgagaaggaguucucugaaguggaaggccggauccaggaucuggagaaguauguggaggacacaaaaauugaucuuugguccuacaacgccgaacugcucgucgcucuggagaaucagcacaccaucgaccugacggauagcgaaaugaacaagcucuuugagaaaacaaagaaacaacugagagaaaacgcggaggacauggggaauggaugcuucaagauuuaucauaagugugauaacgccugcaucggcucuauucgcaaugggaccuacgaccacaacguguaccgggacgaggcucuuaauaacagauuucagaucaaaggcguugaacugaaguccggauauaaagauuggauccucuggauuagcuucgccaucuccugcuuucugcuuuguguggcccugcucggcuucauuaugugggcuugccagaaggggaauauccgcuguaacauuugcaucuga

SEQ ID NO: 196102 - RNA, 1701 nt, Artificial Sequence; identical to SEQ ID NO: 195465
  derived and/or modified sequence opt5 from hemagglutinin__InfluenzaA__ALA08605

SEQ ID NO: 196103 - RNA, 1701 nt, Artificial Sequence; identical to SEQ ID NO: 195465
  derived and/or modified sequence opt5 from hemagglutinin__InfluenzaA__ALA08606

SEQ ID NO: 196104 - RNA, 1701 nt, Artificial Sequence; identical to SEQ ID NO: 196080
  derived and/or modified sequence opt5 from hemagglutinin__InfluenzaA__ALA08607

SEQ ID NO: 196105 - RNA, 1701 nt, Artificial Sequence
  derived and/or modified sequence opt5 from hemagglutinin__InfluenzaA__ALA08609
augaagaccaucauugcccugggcuacauccucugccugguguucgcucagaaaauucccgggaacgacaauagcacagccacgcuuugucugggacaccaugcggucccuaacggcaccaucguuaagacaauuaccaaugauagaaucgaggugacaaacgcuaccgaacucgugcaaaauuccucuaucggggagauuugcgacagcccgcacaaaauccuggauggagaaaacuguacacuuauugacgcccugcucggcgauccccagugcgacggguuucagaauaagaaaugggaucuguucgucgagcgguccaaggccuauucuaacuguuacccuuaugacgugcccgauuacgcuagccugcgcucccucguugccucuagcggaacccuggaauuuaauaacgaguccuucaauuggacgggcgugacccagaacggcacaagcucugcuugcaucagacgguccucuagcuccuuuuucagccgccuuaauuggcugacccaucucaacuauacauacccugcccugaaugucaccaugcccaacaacgagcaauuugacaaacuuuauauuuggggagugcaccauccugggacggauaaggaccagaucuuccuguacgcgcagucuuccggcagaauuacaguuagcaccaagcggucccagcaagccgugaucccgaauaucgggucucgcccccggauuagagauaucccuagccgcauuuccaucuacuggacaauugucaaacccggagacauccuccugaucaacagcaccggcaaucugauugcuccuagaggguauuuuaagauccggucuggaaaauccagcauuaugcgcucugacgcccccaucggcaaguguaagagcgaaugcauuaccccgaacggcuccaucccuaaugauaaacccuuccagaacgugaauagaaucacauacggggcuuguccucgguaugugaagcacucuacgcucaaacuggccaccggaaugcgcaacguccccgagaagcagacaagaggcauuuuuggggcgaucgccggauucauugaaaauggcugggaggggaugguugacggaugguacggcuuucggcaccagaacagcgagggcagagggcaagcugccgaucuuaaauccacccaggcugccaucgaccagauuaauggaaagcugaaccgccucaucggcaaaacaaaugaaaaguuccaucaaauugagaaggaguucagcgaaguggaagggcggauccaggaucuggacaaauauguggaggauaccaagaucgaccuuuggucuuacaacgccgagcugcucgucgcucuggaaaaucagcacacgauugaucugacagacuccgagaugaacaaacucuuugaaaagaccaaaaagcagcugagagagaacgcggaagauaugggaaauggcugcuucaagaucuaucauaaaugugacaacgccugcauugggagcauccgcaauggcaccuacgaccacaacguguaccgggaugaggcucuuaauaacagauuucaaauuaagggaguugagcugaaaucuggcuauaaggacuggauccucuggaucuccuucgccauuagcugcuuucugcuuuguguggcccugcucggguucaucaugugggcuugccagaaaggaaauauucgcuguaacaucugcauuuga

SEQ ID NO: 196106 - RNA, 1701 nt, Artificial Sequence; identical to SEQ ID NO: 196022
  derived and/or modified sequence opt5 from hemagglutinin__InfluenzaA__ALA08610

SEQ ID NO: 196107 - RNA, 1701 nt, Artificial Sequence
  derived and/or modified sequence opt5 from hemagglutinin__InfluenzaA__ALA08611
augaagaucauuaucgcccugagcuacauucucugccugguguucgcucagaaaauccccggcaacgacaauuccaccgccacacuuugucuggggcaccaugcggucccuaacggaacgauuguuaagaccaucacaaaugauagaaucgaggugaccaacgcuacagaacucgugcaaaauucuagcauuggcgagaucugcgacuccccgcaccggauucuggauggggaaaacuguacccuuaucgacgcccugcucggagauccccagugcgacggcuuucagaauaaaaagugggaucuguucgucgagcgcucuaaagccuauagcaacuguuacccuuaugacgugcccgauuacgcuucccugagaucucucguugccagcuccgggacacuggaauuuaauaacgagagcuucaauuggaccggagugacgcagaacggcaccucuuccgcuugcauucggcgcagcagcuccagcuuuuucucuagacuuaauuggcugacacaucucaacuauaccuacccugcccugaaugucacaaugcccaacaacgagcaauuugacaaacuuuauaucuggggcgugcaccauccugggaccgauaaggaccagauuuuccuguacgcgcaguccagcggacggaucacgguuuccacaaagcgcucucagcaagccgugaucccgaauauuggcagcagaccccggauccgcgauauuccuuccagaaucagcauuuacuggaccaucgucaagcccggggacauccuccugauuaacucuacaggaaaucugaucgcuccucggggcuauuuuaaaauucgcuccgggaagucuucuaucaugagaagcgacgcccccauuggaaaauguaaguccgaaugcaucaccccgaacggcucuaucccuaaugauaagcccuuccagaacgugaaucggauuaccuacggcgcuuguccucgcuaugugaaacacagcacacucaagcuggccacggggaugagaaacguccccgagaaacagacccggggaaucuuuggcgcgauugccggguucaucgaaaauggaugggagggcaugguugacgggugguacggauuuagacaccagaacuccgagggccgcggccaagcugccgaucuuaagagcacacaggcugccauugaccagaucaaugggaaacugaaccggcucauuggaaagaccaaugaaaaauuccaucaaaucgagaaggaguucucugaaguggaaggcagaauccaggaucuggagaaguauguggaggacacaaaaauugaucuuugguccuacaacgccgaacugcucgucgcucuggagaaucagcacaccaucgaccugacggauagcgaaaugaacaagcucuuugagaaaacaaagaaacagcugcgcgaaaacgcggaggacauggggaauggaugcuucaagauuuaucauaagugugauaacgccugcaucggcucuauucggaaugggaccuacgaccacaacguguacagagacgaggcucuuaauaaccgcuuucaaaucaaaggcguugaacugaaguccggauauaaagauuggauccucuggauuagcuucgccaucuccugcuuucugcuuuguguggcccugcucggcuucauuaugugggcuugccagaaggggaauauccgguguaacauuugcaucuga

SEQ ID NO: 196108 - RNA, 1701 nt, Artificial Sequence; identical to SEQ ID NO: 196080
  derived and/or modified sequence opt5 from hemagglutinin__InfluenzaA__ALA08612

SEQ ID NO: 196109 - RNA, 1701 nt, Artificial Sequence; identical to SEQ ID NO: 195465
  derived and/or modified sequence opt5 from hemagglutinin__InfluenzaA__ALA08614

SEQ ID NO: 196110 - RNA, 1701 nt, Artificial Sequence; identical to SEQ ID NO: 195465
  derived and/or modified sequence opt5 from hemagglutinin__InfluenzaA__ALA08615

SEQ ID NO: 196111 - RNA, 1701 nt, Artificial Sequence; identical to SEQ ID NO: 195465
  derived and/or modified sequence opt5 from hemagglutinin__InfluenzaA__ALA08616

SEQ ID NO: 196112 - RNA, 1701 nt, Artificial Sequence; identical to SEQ ID NO: 196005
  derived and/or modified sequence opt5 from hemagglutinin__InfluenzaA__ALA08617

SEQ ID NO: 196113 - RNA, 1701 nt, Artificial Sequence
  derived and/or modified sequence opt5 from hemagglutinin__InfluenzaA__ALA08619
augaagaccgugaucgcccugagcuacauucucugccuggucuucgcucagaaaauccccggcaacgacaauuccacagccacgcuuugucuggggcaccaugcgguuccuaacggaaccauugugaagacaaucaccaaugauagaauugaggugacaaacgcuaccgaacucguccaaaauucuagcaucggcgagaucugcgacuccccgcaccagauucuggauggggaaaacuguacacuuaucgacgcccugcucggagauccccagugcgacggcuuucagaauaaaaagugggaucuguucguggagcggucuaaagccuauagcaacuguuacccuuaugacguucccgauuacgcuucccugcgcucucucauugccagcuccgggacccuggaauuuaauaacgagagcuucaauuggacgggagugacccaaaacggcacaucuuccgcuugcaucagaaagucuagcuccagcuuuuucucucggcuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcgcuccagcggaagaauuacaguuuccaccaagcggucucagcaagccgugaucccgaauaucggcagccgcccccggauuagagauaucccuucccgcauuagcaucuacuggacaauugucaaacccggggacauccuccugaucaacucuaccggaaaucugauugcuccuagaggcuauuuuaagauccgguccgggaaaagcucuauuaugcgcagcgacgcccccaucggaaaguguaaguccgaaugcauuaccccgaacggcucuaucccuaaugagaaacccuuccagaacgugaauagaaucacauacggcgcuuguccucgguaugugaagcacagcacgcucaaacuggccaccgggaugcgcaacguccccgaaaagcagacaagaggaauuuuuggcgcgaucgccggguucauugagaauggaugggagggcaugguugaugggugguacggauuucggcaccagaacuccgaaggcagaggccaagcugccgaccuuaaaagcacccaggcugccaucgaucagauuaaugggaagcugaaccgccucaucggaaaaacaaaugagaaguuccaucaaauugaaaaggaguucucugaaguggagggccggauccaggaccuggagaaauauguggaagauaccaagaucgaccuuugguccuacaacgccgagcugcucgucgcucuggaaaaucagcacacgauugaucugacagacagcgagaugaacaaacucuuugaaaagaccaaaaagcagcugagagagaacgcggaggauauggggaauggaugcuucaagaucuaucauaaaugugacaacgccugcauuggcucuauccgcaaugggauuuacgaucacaacguguaccgggacgaagcucuuaauaacagauuucaaaucaagggcguugagcugaaauccggauauaaggacuggauccucuggauuagcuucgccaucuccugcuuucugcuuuguguggcccugcucggcuucauuaugugggcuugccagaaagggaauauccgcuguaacauuugcaucuga

SEQ ID NO: 196114 - RNA, 1701 nt, Artificial Sequence; identical to SEQ ID NO: 196080
  derived and/or modified sequence opt5 from hemagglutinin__InfluenzaA__ALA08620

SEQ ID NO: 196115 - RNA, 1701 nt, Artificial Sequence; identical to SEQ ID NO: 196071
  derived and/or modified sequence opt5 from hemagglutinin__InfluenzaA__ALA08621

SEQ ID NO: 196116 - RNA, 1701 nt, Artificial Sequence
  derived and/or modified sequence opt5 from hemagglutinin__InfluenzaA__ALA08622
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauaaguacccugcccugaaugucacaaugcccaacaacgagcaguuugacaaacuuuauauuuggggcgugcaccauccugggaccgauaaagaccagaucuuccuguacgcgcaguccagcggaagaauuacgguuuccacaaagcggucucaacaggccgugaucccgaauaucggcagccgcccccggauuagagauaucccuucccgcauuagcaucuacuggaccauugucaaacccggggacauccuccugaucaacucuacaggaaaucugauugcuccuagaggcuauuuuaagauccgguccgggaaaagcucuauuaugcgcagcgacgcccccaucggaaaguguaaguccgaaugcauuaccccgaacggcucuaucccuaaugauaaacccuuccagaacgugaauagaaucaccuacggcgcuuguccucgguaugugaagcacagcacacucaaacuggccacggggaugcgcaacguccccgagaagcagaccagaggaauuuuuggcgcgaucgccggguucauugaaaauggaugggagggcaugguugacgggugguacggauuucggcaccaaaacuccgagggcagaggccaggcugccgaucuuaaaagcacacaggcugccaucgaccaaauuaaugggaagcugaaccgccucaucggaaaaaccaaugaaaaguuccaucagauugagaaggaguucucugaaguggaaggccggauccaggaucuggagaaauauguggaggacacaaagaucgaucuuugguccuacaacgccgaacugcucgucgcucuggagaaucagcacaccauugaccugacggauagcgaaaugaacaaacucuuugagaagacaaagaagcaacugagagaaaacgcggaggacauggggaauggaugcuucaagaucuaucauaaaugugauaacgccugcauuggcucuauccgcaaugggaccuacgaccacaacguguaccgggacgaggcucuuaauaacagauuucagauuaagggcguugaacugaaauccggauauaaggauuggauccucuggaucagcuucgccauuuccugcuuucugcuuuguguggcccugcucggcuucaucaugugggcuugccagaaagggaauauucgcuguaacaucugcauuuga

SEQ ID NO: 196117 - RNA, 1701 nt, Artificial Sequence; identical to SEQ ID NO: 195465
  derived and/or modified sequence opt5 from hemagglutinin__InfluenzaA__ALA08623

SEQ ID NO: 196118 - RNA, 1701 nt, Artificial Sequence; identical to SEQ ID NO: 196071
  derived and/or modified sequence opt5 from hemagglutinin__InfluenzaA__ALA08624

SEQ ID NO: 196119 - RNA, 1701 nt, Artificial Sequence; identical to SEQ ID NO: 195465
  derived and/or modified sequence opt5 from hemagglutinin__InfluenzaA__ALA08625

SEQ ID NO: 196120 - RNA, 1701 nt, Artificial Sequence; identical to SEQ ID NO: 195465
  derived and/or modified sequence opt5 from hemagglutinin__InfluenzaA__ALA08626

SEQ ID NO: 196121 - RNA, 1701 nt, Artificial Sequence; identical to SEQ ID NO: 195465
  derived and/or modified sequence opt5 from hemagglutinin__InfluenzaA__ALA08627

SEQ ID NO: 196122 - RNA, 1701 nt, Artificial Sequence; identical to SEQ ID NO: 196009
  derived and/or modified sequence opt5 from hemagglutinin__InfluenzaA__ALA08629

SEQ ID NO: 196123 - RNA, 1701 nt, Artificial Sequence
  derived and/or modified sequence opt5 from hemagglutinin__InfluenzaA__ALA08630
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaaagucuagcuccagcuuuuucucucggcuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcgcuccagcggaagaauuacaguuuccaccaagcggucucagcaagccgugaucccgaauaucggcagccgcccccggauuagagauaucccuucccgcauuagcaucuacuggacaauugucaaacccggggacauccuccugaucaacucuaccggaaaucugauugcuccuagaggcuauuuuaagauccgguccgggaaaagcucuauuaugcgcagcgacgcccccaucggaaaguguaaguccgaaugcauuaccccgaacggcucuaucccuaaugauaaacccuuccagaacgugaauagaaucacauacggcgcuuguccucgguaugugaagcacagcacgcucaaacuggccaccgggaugcgcaacguccccgagaagcagacaagaggaauuuuuggcgcgaucgccggguucauugaaaauggaugggagggcaugguugacgggugguacggauuucggcaccagaacuccgagggcagaggccaagcugccgaucuuaaaagcacccaggcugccaucgaccagauuaaugggaagcugaaccgccucaucggaaaaacaaaugaaaaguuccaucaaauugagaaggaguucucugaaguggaaggccggauccaggaucuggagaaauauguggaggacaccaagaucgaucuuugguccuacaacgccgaacugcucgucgcucuggagaaucagcacacgauugaccugacagauagcgaaaugaacaaacucuuugagaagaccaaaaagcagcugagagaaaacgcggaggacauggggaauggaugcuucaagaucuaucauaaaugugauaacgccugcauuggcucuauccgcaaugggaccuacgaccacaacguguaccgggacgaggcucuuaauaacagauuucaaauuaagggcguugaacugaaauccggauauaaggauuggauccucuggaucagcuucgccauuuccugcuuucugcuuuguguggcccugcucggcuucaucaugugggcuugccagaaagggaauauucgcuguaacaucugcauuuga

SEQ ID NO: 196124 - RNA, 1701 nt, Artificial Sequence
  derived and/or modified sequence opt5 from hemagglutinin__InfluenzaA__ALA08631
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauacauacccugcccugaaugucaccaugcccaacaaggagcaguuugacaaacuuuauauuuggggcgugcaccauccugggacggauaaggaccagaucuuccuguacgcgcaguccagcggaagaauuacaguuuccaccaagcggucucaacaggccgugaucccgaacaucggcagccgcccccggauuagagauaucccuucccgcauuagcaucuacuggacaauugucaaacccggggacauccuccugaucaauucuaccggaaaccugauugcuccuagaggcuauuuuaagauccgguccgggaaaagcucuauuaugcgcagcgacgcccccaucggaaaguguaaguccgaaugcauuaccccgaauggcucuaucccuaacgauaaacccuuccagaaugugaacagaaucacauacggcgcuuguccucgguaugugaagcacagcacgcucaaacuggccaccgggaugcgcaauguccccgagaagcagacaagaggaauuuuuggcgcgaucgccggguucauugaaaacggaugggagggcaugguugacgggugguacggauuucggcaccaaaauuccgagggcagaggccaggcugccgaucuuaaaagcacccaggcugccaucgaccaaauuaacgggaagcugaaucgccucaucggaaaaacaaacgaaaaguuccaucagauugagaaggaguucucugaaguggaaggccggauccaggaucuggagaaauauguggaggacaccaagaucgaucuuugguccuacaaugccgaacugcucgucgcucuggagaaccagcacacgauugaccugacagauagcgaaaugaauaaacucuuugagaagaccaaaaagcaacugagagaaaacgcggaggacauggggaacggaugcuucaagaucuaucauaaaugugauaaugccugcauuggcucuauccgcaacgggaccuacgaccacaauguguaccgggacgaggcucuuaacaauagauuucagauuaagggcguugaacugaaauccggauauaaggauuggauccucuggaucagcuucgccauuuccugcuuucugcuuuguguggcccugcucggcuucaucaugugggcuugccagaaagggaacauucgcuguaauaucugcauuuga

SEQ ID NO: 196125 - RNA, 1701 nt, Artificial Sequence
  derived and/or modified sequence opt5 from hemagglutinin__InfluenzaA__ALA08632
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagggcucucaacaggccgugaucccgaaugucgggagccggccccgcaucagagauauuccuucccggaucagcauuuacuggacaaucgugaagcccggagacauucuccugaucaacucuaccggcaaucugaucgcuccucgcggguauuuuaaaauuagauccggaaagagcucuaucaugcggagcgacgcccccauuggcaaauguaaguccgaaugcaucaccccgaacggcucuauuccuaaugauaagcccuuccagaacgugaaucgcaucacauacggggcuuguccuagauaugucaaacacagcacgcucaagcuggccaccggaaugcggaacguucccgagaaacagacacgcggcaucuuuggggcgauugccggauucaucgaaaauggcugggaggggaugguggacggaugguacggcuuuagacaccaaaacuccgagggccgggggcaggcugccgaucuuaagagcacccaggcugccauugaccaaaucaauggaaaacugaacagacucauuggcaagacaaaugaaaaauuccaucagaucgagaaggaguucucugaaguggaagggcgcauucaggaucuggagaaguaugucgaggacaccaaaaucgaucuuugguccuacaacgccgaacugcucguggcucuggagaaucagcacacgaucgaccugacagauagcgaaaugaacaagcucuuugagaaaaccaagaaacaacugcgggaaaacgcggaggacaugggaaauggcugcuucaagauuuaucauaagugugauaacgccugcaucgggucuauuagaaauggcaccuacgaccacaacguuuaccgcgacgaggcucuuaauaaccgguuucagaucaaaggaguggaacugaaguccggcuauaaagauuggauucucuggaucagcuucgccaucuccugcuuucugcuuugugucgcccugcucggguucauuaugugggcuugccagaagggaaauaucagauguaacauuugcaucuga

SEQ ID NO: 196126 - RNA, 1701 nt, Artificial Sequence; identical to SEQ ID NO: 196022
  derived and/or modified sequence opt5 from hemagglutinin__InfluenzaA__ALA08634

SEQ ID NO: 196127 - RNA, 1701 nt, Artificial Sequence; identical to SEQ ID NO: 195465
  derived and/or modified sequence opt5 from hemagglutinin__InfluenzaA__ALA08635

SEQ ID NO: 196128 - RNA, 1701 nt, Artificial Sequence
  derived and/or modified sequence opt5 from hemagglutinin__InfluenzaA__ALA08636
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcauccaccauccugggacggauaaggaccagauuuuccuguacgcgcaguccagcggaagaaucacaguguccaccaagcggucucaacaggccguuaucccgaauauuggcagccgccccagaauccgggauauuccuucccgcaucagcauuuacuggacaaucgugaagcccggggacauccuccugauuaacucuaccggaaaucugaucgcuccuagaggcuauuuuaaaauucgguccgggaagucuucuaucaugcgcagcgacgcccccauuggaaaauguaaguccgaaugcaucaccccgaacggcucuaucccuaaugauaagcccuuccagaacgucaauagaauuacauacggcgcuuguccucgguaugugaaacacagcacgcucaagcuggccaccgggaugcgcaacgugcccgagaaacagacaagaggaaucuuuggcgcgauugccggguucaucgaaaauggaugggagggcauggucgacgggugguacggauuucggcaccaaaacuccgagggcagaggccaggcugccgaucuuaagagcacccaggcugccauugaccaaaucaaugggaaacugaaccgccucauuggaaagacaaaugaaaaauuccaucagaucgagaaggaguucucugaaguugaaggccggauccaggaucuggagaaguauguggaggacaccaaaauugaucuuugguccuacaacgccgaacugcucguggcucuggagaaucagcacacgaucgaccugacagauagcgaaaugaacaagcucuuugagaaaaccaagaaacaacugagagaaaacgcggaggacauggggaauggaugcuucaagauuuaucauaagugugauaacgccugcaucggcucuauucgcaaugggaccuacgaccacaacgucuaccgggacgaggcucuuaauaacagauuucagaucaaaggcguggaacugaaguccggauauaaagauuggauccucuggauuagcuucgccaucuccugcuuucugcuuuguguugcccugcucggcuucauuaugugggcuugccagaaggggaauauccgcuguaacauuugcaucuga

SEQ ID NO: 196129 - RNA, 1701 nt, Artificial Sequence; identical to SEQ ID NO: 196022
  derived and/or modified sequence opt5 from hemagglutinin__InfluenzaA__ALA08637

SEQ ID NO: 196130 - RNA, 1701 nt, Artificial Sequence
  derived and/or modified sequence opt5 from hemagglutinin__InfluenzaA__ALA08638
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaggcagcaauucuuccuuuuucagccggcuuaacuggcugacccauucuaauuuuaaguauccugcccucaacgucacaaugcccaacaaugagcaguucgacaagcuguacauuuggggagugcaccauccugggaccgauaaagaccagaucuuucuuuaugcgcaguccagcggccgcauuacgguuuccacaaagagaucucaacaggccgugaucccgaacaucgggagccggccccgcauuagagauaucccuucccggauuagcaucuacuggaccauugucaaacccggagacauccugcucaucaauucuacaggcaaccugauugcuccucgcggguacuucaagaucagauccggaaaaagcucuauuaugcggagcgacgcccccaucggcaaguguaaguccgaaugcauuaccccgaauggcucuaucccuaacgauaaacccuuucagaaugugaaccgcaucaccuauggggcuuguccuagauacgugaagcacagcacacugaaacucgccacgggaaugcggaauguccccgagaagcagacccgcggcauuuucggggcgaucgccggauuuauugaaaacggcugggaggggaugguugacggaugguauggcuucagacaccaaaauuccgagggccgggggcaggcugccgaucugaaaagcacacaggcugccaucgaccaaauuaacggaaaacuuaauagacugaucggcaaaaccaacgaaaaguuccaucagauugagaaggaauuuucugagguggaagggcgcauccaggaucucgagaaauacguggaggacacaaagaucgaucugugguccuauaaugccgaacuucuggucgcucucgagaaccagcacaccauugaccugacggauagcgaaaugaacaaacuguucgagaagacaaagaagcaacuccgggaaaaugcggaggacaugggaaacggcugcuuuaagaucuaccauaaaugugauaaugccugcauugggucuaucagaaacggcaccuaugaccacaauguguaccgcgacgaggcucugaacaaucgguuccagauuaagggaguugaacuuaaauccggcuacaaggauuggauccuguggaucagcuuugccauuuccugcuuccuccuguguguggcccuucugggguuuaucaugugggcuugccagaaaggaaacauuagauguaauaucugcauuuga

SEQ ID NO: 196131 - RNA, 1701 nt, Artificial Sequence; identical to SEQ ID NO: 196022
  derived and/or modified sequence opt5 from hemagglutinin__InfluenzaA__ALA08639

SEQ ID NO: 196132 - RNA, 1701 nt, Artificial Sequence; identical to SEQ ID NO: 196022
  derived and/or modified sequence opt5 from hemagglutinin__InfluenzaA__ALA08640

SEQ ID NO: 196133 - RNA, 1701 nt, Artificial Sequence; identical to SEQ ID NO: 196022
  derived and/or modified sequence opt5 from hemagglutinin__InfluenzaA__ALA08641

SEQ ID NO: 196134 - RNA, 1701 nt, Artificial Sequence; identical to SEQ ID NO: 196022
  derived and/or modified sequence opt5 from hemagglutinin__InfluenzaA__ALA08642

SEQ ID NO: 196135 - RNA, 1701 nt, Artificial Sequence; identical to SEQ ID NO: 196022
  derived and/or modified sequence opt5 from hemagglutinin__InfluenzaA__ALA08643

SEQ ID NO: 196136 - RNA, 1701 nt, Artificial Sequence; identical to SEQ ID NO: 195465
  derived and/or modified sequence opt5 from hemagglutinin__InfluenzaA__ALA08644

SEQ ID NO: 196137 - RNA, 1701 nt, Artificial Sequence
  derived and/or modified sequence opt5 from hemagglutinin__InfluenzaA__ALA08645
augaagaccaucauugcccugagcuacauccucugccugguguucgcucagaaacuucccgagaacgacaauuccacagccacgcugugucucggccaccaugcggucccuaacgggaccauuguuaagacaaucaccucugauagaauugaagugacaaaugcuaccgagcuggugcaaaacagcuccaucggagaaaucugcgacucuccgcaccagauucuugauggcaaaaauuguacacugaucgacgcccuccugggggauccccagugcgacggauuucagaacaagaaaugggaucuguucgucgagcggagcaaggccuauuccaauuguuacccuuaugacgugcccgauuacgcuucucuccgcagccugguugccuccagcggcacccuugaauuuaacgacgagucuuucaauugggcuggggugacgcaaaacggaaccuccagcgccugcauuagaggcucuaauuccagcuuuuucucucggcugaacuggcucacacauuccaauuuuaaguauccugcgcugaacgucaccaugcccaauaacgagcaguucgauaaacuuuacaucuggggcgugcaccauccugggacagacaaggaucagauuuuucuguaugcccagagcuccggacgcaucaccguuucuacgaaaagaagccaacaggcugugauuccgaacaucggcucccggccccgcaucagaaauauuccuagccggaucucuauuuacuggacaaucgucaagcccggggacauucuccugaucaacuccaccggaaaucugaucgccccucgcggcuacuucaaaauuagaagcgggaagucuagcaucaugcgguccgacgcucccauuggaaaguguaaaucugaaugcaucacaccgaacggcagcauuccuaaugauaagcccuuucagaacgugaaucgcaucaccuauggcgccuguccuagauacgugaaacaguccacccucaagcuggcgacagggaugcggaacguccccgagaaacaaacgcgcggaaucuucggcgccauugcuggguuuaucgaaaauggaugggagggcaugaaggacgggugguauggauucagacaccagaacagcgagggccggggccaggccgcugaucuuaaaucuacccaagccgccauugaccagaucaaugggaagcugaacagacucauuggaaagacaaaugaaaaauuccaccagaucgagaaggaauuuuccgagguugaaggccgcauucaggaucuggagaaauacguggaggacaccaagaucgauaucuggagcuauaacgcugaacuucugguggcgcucgagaaucaacauacaauugaccugaccgauucugaaaugaacaaacuguucgagaagacgaagaaacagcuccgggaaaacgccgaggacauggggaauggaugcuuuaagaucuaccacaaaugugauaacgcuugcauuggcuccaucagaaaugggacauaugaccaugacgucuaccgcgaugaggcccugaacaaucgguuccagauuaagggcguggaacuuaaaagcggauacaaggacuggauccuguggaucuccuuugccauuucuugcuuccuccuguguguugcccuucugggcuuuaucaugugggcuugccagaaggggaacauuagauguaauaucugcauuuga

SEQ ID NO: 196138 - RNA, 1701 nt, Artificial Sequence; identical to SEQ ID NO: 195465
  derived and/or modified sequence opt5 from hemagglutinin__InfluenzaA__ALA08646

SEQ ID NO: 196139 - RNA, 1701 nt, Artificial Sequence; identical to SEQ ID NO: 195465
  derived and/or modified sequence opt5 from hemagglutinin__InfluenzaA__ALA08647

SEQ ID NO: 196140 - RNA, 1701 nt, Artificial Sequence; identical to SEQ ID NO: 196022
  derived and/or modified sequence opt5 from hemagglutinin__InfluenzaA__ALA08648

SEQ ID NO: 196141 - RNA, 1701 nt, Artificial Sequence
  derived and/or modified sequence opt5 from hemagglutinin__InfluenzaA__ALA08650
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugagagaaucgaagugacaaacgcuaccgagcucgugcaaaauucuagcaucggcgaaauuugcgauuccccgcaccagauccuggacggggagaacuguacacuuauugaugcccugcucggagacccccagugcgauggcuuucagaauaaaaagugggaccuguucgucgaacggucuaaagccuauagcaacuguuacccuuaugaugugcccgacuacgcuucccugcgcucucucguugccagcuccgggacccuggaguuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgaacaguuugauaaacuuuauauuuggggcgugcaccauccugggacggacaaggaucagaucuuccuguacgcgcaguccagcggaagaauuacaguuuccaccaaacggucucaacaggccgugaucccgaauaucggcagccgcccccggauuagagacaucccuucccgcauuagcaucuacuggacaauugucaagcccggggauauccuccugaucaacucuaccggaaaucugauugcuccuagaggcuauuuuaaaauccgguccgggaagucuucuauuaugcgcagcgacgcccccaucggaaaauguaaguccgagugcauuaccccgaacggcucuaucccuaaugacaagcccuuccagaacgugaauagaaucacauacggcgcuuguccucgguaugugaaacacagcacgcucaagcuggccaccgggaugcgcaacguccccgaaaaacagacaagaggaauuuuuggcgcgaucgccggguucauugagaauggaugggagggcaugguugaugggugguacggauuucggcaccaaaacuccgaaggcagaggccaggcugccgaccuuaagagcacccaggcugccaucgaucaaauuaaugggaaacugaaccgccucaucggaaagacaaaugagaaauuccaucagauugaaaaggaguucucugaaguggagggccggauccaggaccuggagaaguauguggaagauaccaaaaucgaccuuugguccuacaacgccgagcugcucgucgcucuggaaaaucagcacacgauugaucugacagacagcgagaugaacaagcucuuugaaaagaccaagaaacaacugagagagaacgcggaggauauggggaauggaugcuucaagaucuaucauaagugugacaacgccugcauuggcucuauccgcaaugggaccuacgaucacaacguguaccgggacgaagcucuuaauaacagauuucagauuaaaggcguugagcugaaguccggauauaaagacuggauccucuggaucagcuucgccauuuccugcuuucugcuuuguguggcccugcucggcuucaucaugugggcuugccagaaggggaauauucgcuguaacaucugcauuuga

SEQ ID NO: 196142 - RNA, 1701 nt, Artificial Sequence; identical to SEQ ID NO: 196022
  derived and/or modified sequence opt5 from hemagglutinin__InfluenzaA__ALA08652

SEQ ID NO: 196143 - RNA, 1701 nt, Artificial Sequence; identical to SEQ ID NO: 195465
  derived and/or modified sequence opt5 from hemagglutinin__InfluenzaA__ALA08653

SEQ ID NO: 196144 - RNA, 1701 nt, Artificial Sequence
  derived and/or modified sequence opt5 from hemagglutinin__InfluenzaA__ALA08654
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgcccccaucggaaaauguaaguccgaaugcauuaccccgaacggcucuaucccuaaugauaagcccuuccagaacgugaauagaaucacauacggcgcuuguccucgguaugugaaacacagcacgcucaagcuggccaccgggaugcgcaacguccccgagaaacagacaagaggaauuuuuggcgcgaucgccggguucauugaaaauggaugggagggcaugguugacgggugguacggauuucggcaccaaaacuccgagggcagaggccaggcugccgaucuuaagagcacccaggcugccaucgaccaaauuaaugggaaacugaaccgccucaucggaaagacaaaugaaaaauuccaucagauugagaaggaguucucugaaguggaaggccggauccaggaucuggagaaguauguggaggacaccaaaaucgaucuuugguccuacaacgccgaacugcucgucgcucuggagaaucagcacacgauugaccugacagauagcgaaaugaacaagcucuuugagaaaaccaagaaacaacugagagaaaacgcggaggacauggggaauggaugcuucaagaucuaucauaagugugauaacgccugcauuggcucuauccgcaaugggaccuacgaccacaacguguaccgggacgaggcucuuaauaacagauuucagauuaaaggcguugaacugaaguccggauauaaagauuggauccucuggaucagcuucgccaaguccugcuuucugcuuuguguggcccugcucggcuucauuaugugggcuugccagaaagggaauauccgcuguaacauuugcaucuga

SEQ ID NO: 196145 - RNA, 1701 nt, Artificial Sequence; identical to SEQ ID NO: 196022
  derived and/or modified sequence opt5 from hemagglutinin__InfluenzaA__ALA08655

SEQ ID NO: 196146 - RNA, 1701 nt, Artificial Sequence; identical to SEQ ID NO: 196022
  derived and/or modified sequence opt5 from hemagglutinin__InfluenzaA__ALA08656

SEQ ID NO: 196147 - RNA, 1701 nt, Artificial Sequence
  derived and/or modified sequence opt5 from hemagglutinin__InfluenzaA__ALA08657
augaagaccaucauugcccugagcuacauccucugccugguguucgcucagaaacuucccgagaacgacaauuccacagccacgcugugucucggccaccaugcggucccuaacgggaccauuguuaagacaaucaccucugauagaauugaagugacaaaugcuaccgagcuggugcaaaacagcuccaucggagaaaucugcgacucuccgcaccagauucuugauggcaaaaauuguacacugaucgacgcccuccugggggauccccagugcgacggauuucagaacaagaaaugggaucuguucauugagcggagcaaggccuauuccaauuguuacccuuaugacguccccgauuacgcuucucuccgcagccugguggccuccagcggcacccuugaauuuaacgacgagucuuucaauugggcugggguuacgcaaaacggaaccuccagcgccugcaucagaggcucuaauuccagcuuuuucucucggcugaacuggcucacacauuccaauuuuaaguauccugcgcugaacgugaccaugcccaauaacgagcaguucgauaaacuuuacauuuggggcguccaccauccugggacagacaaggaucagaucuuucuguaugcccagagcuccggacgcauuaccgugucuacgaaaagaagccaacaggcuguuaucccgaacaucggcucccggccccgcauuagaaauaucccuagccggauuucuaucuacuggacaauugugaagcccggggacauccuccugaucaacuccaccggaaaucugauugccccucgcggcuacuucaaaaucagaagcgggaagucuagcauuaugcgguccgacgcucccaucggaaaguguaaaucugaaugcauuacaccgaacggcagcaucccuaaugauaagcccuuucagaacgucaaucgcaucaccuauggcgccuguccuagauacgugaaacaguccacccucaagcuggcgacagggaugcggaacgugcccgagaaacaaacgcgcggaauuuucggcgccaucgcuggguuuauugaaaauggaugggagggcaugaaggacgggugguauggauucagacaccagaacagcgagggccggggccaggccgcugaucuuaaaucuacccaagccgccaucgaccagauuaaugggaagcugaacagacucaucggaaagacaaaugaaaaauuccaccagauugagaaggaauuuuccgaggucgaaggccgcauccaggaucuggagaaauacguugaggacaccaagaucgaucuuuggagcuauaacgcugaacugcucguggcgcuggagaaucaacauacaauugaccugaccgauucugaaaugaacaaacucuucgagaagacgaagaaacagcugcgggaaaacgccgaggacauggggaauggaugcuuuaagaucuaccacaaaugugauaacgcuugcauuggcuccaucagaaaugggacauaugaccaugacguguaccgcgaugaggcccuuaacaaucgguuccagauuaagggcgucgaacugaaaagcggauacaaggacuggauccucuggaucuccuuugccauuucuugcuuccugcuuuguguggcucugcucggcuuuaucaugugggccugccagaaggggaacauuagauguaauaucugcauuuga

SEQ ID NO: 196148 - RNA, 1701 nt, Artificial Sequence; identical to SEQ ID NO: 196022
  derived and/or modified sequence opt5 from hemagglutinin__InfluenzaA__ALA08658

SEQ ID NO: 196149 - RNA, 1701 nt, Artificial Sequence; identical to SEQ ID NO: 196009
  derived and/or modified sequence opt5 from hemagglutinin__InfluenzaA__ALA08659

SEQ ID NO: 196150 - RNA, 1701 nt, Artificial Sequence
  derived and/or modified sequence opt5 from hemagglutinin__InfluenzaA__ALA08660
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgcccccaucggaaaauguaaguccgaaugcauuaccccgaacggcucuaucccuaaugauaagcccuuccagaacgugaauagaaucacauacggcgcuuguccucgguaugugaaacacgggacgcucaagcuggccaccggaaugcgcaacguccccgagaaacagacaagaggcauuuuuggggcgaucgccggauucauugaaaauggcugggaggggaugguugacggaugguacggcuuucggcaccaaaacagcgagggcagagggcaggcugccgaucuuaaguccacccaggcugccaucgaccaaauuaauggaaaacugaaccgccucaucggcaagacaaaugaaaaauuccaucagauugagaaggaguucagcgaaguggaagggcggauccaggaucuggagaaguauguggaggacaccaaaaucgaucuuuggucuuacaacgccgaacugcucgucgcucuggagaaucagcacacgauugaccugacagauuccgaaaugaacaagcucuuugagaaaaccaagaaacaacugagagaaaacgcggaggacaugggaaauggcugcuucaagaucuaucauaagugugauaacgccugcauugggagcauccgcaauggcaccuacgaccacaacguguaccgggacgaggcucuuaauaacagauuucagauuaaaggaguugaacugaagucuggcuauaaagauuggauccucuggaucuccuucgccauuagcugcuuucugcuuuguguggcccugcucggguucaucaugugggcuugccagaagggaaauauucgcuguaacaucugcauuuga

SEQ ID NO: 196151 - RNA, 1701 nt, Artificial Sequence
  derived and/or modified sequence opt5 from hemagglutinin__InfluenzaA__ALA08662
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaagcuguauauuuggggcgugcaccauccugggacggauaaggaccagaucuuccuguacgcgcaguccagcggaagaauuacaguuuccaccaaacggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccucuccgggaagucuucuauuaugcggagcgacgcccccaucggaaaauguaaguccgaaugcauuaccccgaacggcucuaucccuaaugauaagcccuuccagaacgugaaucgcaucacauacggcgcuuguccuagauaugugaaacacagcacgcugaaacuugccaccgggaugcggaacguccccgagaagcagacacgcggaauuuuuggcgcgaucgccggguucauugaaaauggaugggagggcaugguugacgggugguacggauuuagacaccaaaacuccgagggccggggccaggcugccgaucuuaagagcacccaggcugccaucgaccaaauuaaugggaaacucaacagacugaucggaaagacaaaugaaaaauuccaucagauugagaaggaguucucugaaguggaaggccgcauccaggaucuugagaaguauguggaggacuccaaaaucgaucuguggagcuacaacgccgaacuccuggucgcucuggagaaucagcacaccauugaccucacggauucugaaaugaacaagcuguuugagaaaacaaagaaacaacuucgggaaaacgcggaggacauggggaauggaugcuucaagaucuaucauaagugugauaacgccugcauuggcuccaucagaaaugggaccuacgaccacaacguguaccgcgacgaggcucugaauaaccgguuucagauuaaaggcguugaacucaagagcggauauaaagauuggauccuguggaucuccuucgccauuucuugcuuucuucuguguguggcccuccugggcuucaucaugugggcuugccagaaggggaauauuagauguaacaucugcauuuga

SEQ ID NO: 196152 - RNA, 1701 nt, Artificial Sequence; identical to SEQ ID NO: 196123
  derived and/or modified sequence opt5 from hemagglutinin__InfluenzaA__ALA08663

SEQ ID NO: 196153 - RNA, 1701 nt, Artificial Sequence; identical to SEQ ID NO: 196151
  derived and/or modified sequence opt5 from hemagglutinin__InfluenzaA__ALA08665

SEQ ID NO: 196154 - RNA, 1701 nt, Artificial Sequence
  derived and/or modified sequence opt5 from hemagglutinin__InfluenzaA__ALA08666
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugguugauggaugguauggcuucagacaccagaacagcgagggccgggggcaggccgcugaccugaaauccacccaagccgccauugaucagaucaauggaaagcucaacagacugauuggcaaaacaaaugaaaaguuccaccagaucgagaaggaauuuagcgagguggaagggcgcauucaggaccuugagaaauacguggaggauaccaagaucgaccuguggucuuauaacgcugaacuccuggucgcgcuggagaaccaacauacaaucgaucucaccgacuccgaaaugaauaaacuguucgagaagacgaaaaagcagcuucgggaaaacgccgaggauaugggaaauggcugcuuuaagauuuaccacaaaugugacaacgcuugcaucgggagcauuagaaauggcacauaugaucaugacguguaccgcgacgaggcccugaacaaucgguuccagaucaagggaguugaacucaaaucuggcuacaaggauuggauucuguggaucuccuuugccaugagcugcuuccuucuguguguggcucuccugggguuuaucaugugggccugccagaaaggaaacauuagauguaauaucugcauuuga

SEQ ID NO: 196155 - RNA, 1701 nt, Artificial Sequence
  derived and/or modified sequence opt5 from hemagglutinin__InfluenzaA__ALA08667
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaaagagcagcuccagcuuuuucucucggcuuaauuggcugacccaucucaacuauaaguacccugcccugaaugucacaaugcccaacaacgagcaguuugacaaacuuuauauuuggggcgugcaccauccugggaccgauaaggaccagaucuuccuguacgcgcgcuccagcggaagaauuacgguuuccacaaaacggucucagcaagccgugaucccgaauaucggcagccgcccccggauuagagauaucccuucccgcauuagcaucuacuggaccauugucaagcccggggacauccuccugaucaacucuacaggaaaucugauugcuccuagaggcuauuuuaaaauccgguccgggaagucuucuauuaugcgcagcgacgcccccaucggaaaguguaaauccgaaugcauuaccccgaacggcucuaucccuaaugauaagcccuuccagaacgugaauagaaucaccuacggcgcuuguccucgguaugugaaacacagcacacucaagcuggccacggggaugcgcaacguccccgagaaacagaccagaggaauuuuuggcgcgaucgccggguucauugaaaauggaugggagggcaugguugacgggugguacggauuucggcaccagaacuccgagggcagaggccaagcugccgaucuuaagagcacacaggcugccaucgaccagauuaaugggaaacugaaccgccucaucggaaagaccaaugaaaaguuccaucaaauugagaaagaguucucugaaguggaaggccggauccaggaucuggagaaguauguggaggacacaaaaaucgaucuuugguccuacaacgccgaacugcucgucgcucuggagaaucagcacaccauugaccugacggauagcgaaaugaacaagcucuuugagaaaacaaagaagcagcugagagaaaacgcggaggacauggggaauggaugcuucaaaaucuaucauaagugugauaacgccugcauuggcucuauccgcaaugggaccuacgaccacaacguguaccgggacgaggcucuuaauaacagauuucaaauuaaaggcguugaacugaaguccggauauaaagauuggauccucuggaucagcuucgccauuuccugcuuucugcuuuguguggcccugcucggcuucaucaugugggcuugccagaaggggaauauucgcuguaacaucugcauuuga

SEQ ID NO: 196156 - RNA, 1701 nt, Artificial Sequence
  derived and/or modified sequence opt5 from hemagglutinin__InfluenzaA__ALA08668
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgcccccaucggaaaauguaaguccgaaugcauuaccccgaacggcucuaucccuaaugauaagcccuuccagaacgugaauagaaucacauacggcgcuuguccucgguaugugaaacacagcacgcucaagcuggccaccgggaugcgcaacguccccgagaaacagacaagaggaauuuuuggcgcgaucgccggguucauugaaaauggaugggagggcaugguugacgggugguacggauuucggcaccaaaacuccgagggcagaggccaggcugccgaucuuaagagcacccaggcugccaucgaccaaauuaaugggaaacugaaccgccucaucggaaagacaaaugaaaaauuccaucagauugagaaggaguucucugaaguggaaggccggauccaggaucuggagaaguauguggaggacaccaaaaucgaucuuugguccuacaacgccgaacugcucgucgcucuggagaaucagcacacgauugaccugacagauagcgaaaugaacaagcucuuugagaaaaccaagaaacaacugagagaaaacgcggaggacauggggaauggaugcuucaagaucuaucauaagugugauaacgccugcauuggcucuauccgcaaugggaccuacgaccacaacguguaccgggacgaggcuauuaauaacagauuucagaucaaaggcguugaacuuaaguccggauauaaagauuggauccuguggauuagcuucgccaucuccugcuuucuccuguguguggcccuucugggcuucauuaugugggcuugccagaaggggaauauccgcuguaacauuugcaucuga

SEQ ID NO: 196157 - RNA, 1701 nt, Artificial Sequence; identical to SEQ ID NO: 196123
  derived and/or modified sequence opt5 from hemagglutinin__InfluenzaA__ALA08669

SEQ ID NO: 196158 - RNA, 1701 nt, Artificial Sequence; identical to SEQ ID NO: 196016
  derived and/or modified sequence opt5 from hemagglutinin__InfluenzaA__ALA08670

SEQ ID NO: 196159 - RNA, 1701 nt, Artificial Sequence; identical to SEQ ID NO: 196123
  derived and/or modified sequence opt5 from hemagglutinin__InfluenzaA__ALA08671

SEQ ID NO: 196160 - RNA, 1701 nt, Artificial Sequence; identical to SEQ ID NO: 196123
  derived and/or modified sequence opt5 from hemagglutinin__InfluenzaA__ALA08672

SEQ ID NO: 196161 - RNA, 1701 nt, Artificial Sequence; identical to SEQ ID NO: 196016
  derived and/or modified sequence opt5 from hemagglutinin__InfluenzaA__ALA08673

SEQ ID NO: 196162 - RNA, 1701 nt, Artificial Sequence; identical to SEQ ID NO: 196123
  derived and/or modified sequence opt5 from hemagglutinin__InfluenzaA__ALA08674

SEQ ID NO: 196163 - RNA, 1701 nt, Artificial Sequence; identical to SEQ ID NO: 195465
  derived and/or modified sequence opt5 from hemagglutinin__InfluenzaA__ALA08675

SEQ ID NO: 196164 - RNA, 1701 nt, Artificial Sequence; identical to SEQ ID NO: 196123
  derived and/or modified sequence opt5 from hemagglutinin__InfluenzaA__ALA08676

SEQ ID NO: 196165 - RNA, 1701 nt, Artificial Sequence; identical to SEQ ID NO: 196123
  derived and/or modified sequence opt5 from hemagglutinin__InfluenzaA__ALA08677

SEQ ID NO: 196166 - RNA, 1701 nt, Artificial Sequence; identical to SEQ ID NO: 196123
  derived and/or modified sequence opt5 from hemagglutinin__InfluenzaA__ALA08678

SEQ ID NO: 196167 - RNA, 1701 nt, Artificial Sequence; identical to SEQ ID NO: 196123
  derived and/or modified sequence opt5 from hemagglutinin__InfluenzaA__ALA08679

SEQ ID NO: 196168 - RNA, 1701 nt, Artificial Sequence; identical to SEQ ID NO: 196123
  derived and/or modified sequence opt5 from hemagglutinin__InfluenzaA__ALA08680

SEQ ID NO: 196169 - RNA, 1701 nt, Artificial Sequence; identical to SEQ ID NO: 196022
  derived and/or modified sequence opt5 from hemagglutinin__InfluenzaA__ALA08681

SEQ ID NO: 196170 - RNA, 1701 nt, Artificial Sequence; identical to SEQ ID NO: 196101
  derived and/or modified sequence opt5 from hemagglutinin__InfluenzaA__ALA08682

SEQ ID NO: 196171 - RNA, 1701 nt, Artificial Sequence; identical to SEQ ID NO: 196022
  derived and/or modified sequence opt5 from hemagglutinin__InfluenzaA__ALA08683

SEQ ID NO: 196172 - RNA, 1701 nt, Artificial Sequence
  derived and/or modified sequence opt5 from hemagglutinin__InfluenzaA__ALA08684
augaagaccaucauugcccugagccacauccucugccugguguucgcucagaaaauucccggcaacgacaauuccacagccacgcuuugucuggggcaucacgcggucccuaacggaaccaucguuaagacaauuaccaaugauagaaucgaggugacaaacgcuaccgaacucgugcaaaauucuagcaucggcgagauuugcgacuccccgcaucagauccuggauggggaaaacuguacacuuauugacgcccugcucggagauccccagugcgacggcuuucagaauaaaaagugggaucuguucgucgagcggucuaaagccuacagcaacuguuauccuuacgacgugcccgauuaugcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaccucaacuacaaguauccugcccugaaugucacaaugcccaacaacgagcaguuugacaaacuuuacauuuggggcgugcaucacccugggaccgauaaagaccagaucuuccuguaugcgcaguccagcggaagaauuacgguuuccacaaagggcucucaacaggccgugaucccgaauaucgggagccggccccgcauuagagauaucccuucccggauuagcaucuacuggaccauugucaaacccggagacauccuccugaucaacucuacaggcaaucugauugcuccucgcggguacuuuaagaucagauccggaaaaagcucuauuaugcggagcgacgcccccaucggcaaguguaaguccgaaugcauuaccccgaacggcucuaucccuaaugauaaacccuuccagaacgugaaucgcaucaccuauggggcuuguccuagauacgugaagcacagcacacucaaacuggccacgggaaugcggaacguccccgagaagcagacccgcggcauuuuuggggcgaucgccggauucauugaaaauggcugggaggggaugguugacggaugguauggcuuuagacaucaaaacuccgagggccgggggcaggcugccgaucuuaaaagcacacaggcugccaucgaccaaauuaauggaaagcugaacagacucaucggcaaaaccaaugaaaaguuccaccagauugagaaggaguucucugaaguggaagggcgcauccaggaucuggagaaauacguggaggacacaaagaucgaucuuugguccuauaacgccgaacugcucgucgcucuggagaaucagcauaccauugaccugacggauagcgaaaugaacaaacucuuugagaagacaaagaagcaacugcgggaaaacgcggaggacaugggaaauggcugcuucaagaucuaccacaaaugugauaacgccugcauugggucuaucagaaauggcaccuaugaccacaacguguaccgcgacgaggcucuuaauaaccgguuucagauuaagggaaucgaacugaaauccggcuacaaggauuggauccucuggauuagcuucgccaucuccugcuuucugcuuuguguugcccugcucggguucauuaugugggcuugccagaaaggaaauaucagauguaacauuugcaucuga

SEQ ID NO: 196173 - RNA, 1701 nt, Artificial Sequence; identical to SEQ ID NO: 195465
  derived and/or modified sequence opt5 from hemagglutinin__InfluenzaA__ALA08686

SEQ ID NO: 196174 - RNA, 1701 nt, Artificial Sequence
  derived and/or modified sequence opt5 from hemagglutinin__InfluenzaA__ALA08687
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucaucgccagcuccgggacccuggaauuuaauaacgagagcuucaauuggacgggaguuacccaaaacggcacaucuuccgcuugcauuagacggagcagcuccagcuuuuucucucgccuuaauuggcugacccaucucaacuauacauacccugcccugaaugugaccaugcccaacaacgagcaguuugacaaacuuuauaucuggggcguccaccauccugggacggauaaggaccagauuuuccuguacgcgcaguccagcggaagaaucacaguguccaccaagcggucucaacaggccguuaucccgaauauuggcagccgccccagaauccgggauauuccuucccgcaucagcauuuacuggacaaucgugaagcccggggacauccuccugauuaacucuaccggaaaucugaucgcuccuagaggcuauuuuaaaauucgguccgggaagucuucuaucaugcgcagcgacgcccccauuggaaaauguaaguccgaaugcaucaccccgaacggcucuaucccuaaugauaagcccuuccagaacgucaauagaauuacauacggcgcuuguccucgguaugugaaacacagcacgcucaagcuggccaccgggaugcgcaacgugcccgagaaacagacaagaggaaucuuuggcgcgauugccggguucaucgaaaauggaugggagggcauggucgacgggugguacggauuucggcaccaaaacuccgagggcagaggccaggcugccgaucuuaagagcacccaggcugccauugaccaaaucaaugggaaacugaaccgccucauuggaaagacaaaugaaaaauuccaucagaucgagaaggaguucucugaaguugaaggccggauccaggaucuggagaaguauguggaggacaccaaaauugaucuuugguccuacaacgccgaacugcucguggcucuggagaaucagcacacgaucgaccugacagauagcgaaaugaacaagcucuuugagaaaaccaagaaacaacugagagaaaacgcggaggacauggggaauggaugcuucaagauuuaucauaagugugauaacgccugcaucggcucuauucgcaaugggaccuacgaccacaacgucuaccgggacgaggcucuuaauaacagauuucagaucaaaggcguggaacugaaguccggauauaaagauuggauccucuggauuagcuucgccaucuccugcuuucugcuuuguguugcccugcucggcuucauuaugugggcuugccagaaggggaauauccgcuguaacauuugcaucuga

SEQ ID NO: 196175 - RNA, 1701 nt, Artificial Sequence; identical to SEQ ID NO: 196116
  derived and/or modified sequence opt5 from hemagglutinin__InfluenzaA__ALA08688

SEQ ID NO: 196176 - RNA, 1701 nt, Artificial Sequence; identical to SEQ ID NO: 195465
  derived and/or modified sequence opt5 from hemagglutinin__InfluenzaA__ALE31612

SEQ ID NO: 196177 - RNA, 1701 nt, Artificial Sequence
  derived and/or modified sequence opt5 from hemagglutinin__InfluenzaA__ALE31613
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauacauacccugcccugaaugucaccaugcccaacaacgagcaguuugacaagcuguauauuuggggcgugcaccauccugggacggauaaggaccagaucuuccuguacgcgcaguccagcggaagaauuacaguuuccaccaaaggcucucaacaggccgugaucccgaauaucgggagccggccccgcauuagagauaucccuucccggauuagcaucuacuggacaauugucaagcccggagacauccuccugaucucuuccaccggcaaccugauugcuccucgcggguauuuuaaaaucagaagcggaaagucuagcauuaugcgguccgacgcccccaucggcaaauguaagucugaaugcauuaccccgaauggcagcaucccuaacgauaagcccuuccagaaugugaaccgcaucacauacggggcuuguccuagauaugugaaacacuccacgcucaagcuggccaccggaaugcggaauguccccgagaaacagacacgcggcauuuuuggggcgaucgccggauucauugaaaacggcugggaggggaugguugacggaugguacggcuuuagacaccaaaauagcgagggccgggggcaggcugccgaucuuaagucuacccaggcugccaucgaccaaauuaacggaaaacugaauagacucaucggcaagacaaacgaaaaauuccaucagauugagaaggaguucuccgaaguggaagggcgcauccaggaucuggagaaguauguggaggacaccaaaaucgaucuuuggagcuacaaugccgaacugcucgucgcucuggagaaccagcacacgauugaccugacagauucugaaaugaauaagcucuuugagaaaaccaagaaacaacugcgggaaaacgcggaggacaugggaaacggcugcuucaagaucuaucauaagugugauaaugccugcauuggguccaucagaaacggcaccuacgaccacaauguguaccgcgacgaggcucuuaacaaucgguuucagauuaaaggaguugaacuuaagagcggcuauaaagauuggauccucuggaucuccuucgccauuucuugccugcuucuguguguggcccuccugggguuuaucaugugggcuugccagaagggaaacauuagauguaauaucugcauuuga

SEQ ID NO: 196178 - RNA, 1701 nt, Artificial Sequence
  derived and/or modified sequence opt5 from hemagglutinin__InfluenzaA__ALE31614
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcaaaauuugcgacuccccgcaccagauccuggauggggagaacuguacacuuauugacgcccugcucggagauccccagugcgacggcuuucagaauaagaaaugggaucuguucgucgaacggucuaaggccuauagcaacuguuacccuuaugacgugcccgauuacgcuucccugcgcucucucguugccagcuccgggacccuggaguuuaauaacgaaucuuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaaacccggggacauccuccugaucaacucuaccggaaaucugauugcuccuagaggcuauuuuaagauccgguccgggaaaagcucuauuaugcgcagcgacgcccccaucggaaaguguaaguccgagugcauuaccccgaacggcucuaucccuaaugauaaacccuuccagaacgugaauagaaucacauacggcgcuuguccucgguaugugaagcacagcacgcucaaacuggccaccgggaugcgcaacguccccgaaaagcagacaagaggaauuuuuggcgcgaucgccggguucauugagaauggaugggaaggcaugguugacgggugguacggauuucggcaccaaaacuccgagggcagaggccaggcugccgaucuuaaaagcacccaggcugccaucgaccaaauuaaugggaagcugaaccgccucaucggaaaaacaaaugagaaguuccaucagauugaaaaggaguucucugaaguggagggccggauccaggaucuggaaaaauauguggaggacaccaagaucgaucuuugguccuacaacgccgagcugcucgucgcucuggaaaaucagcacacgauugaccugacagauagcgagaugaacaaacucuuugaaaagaccaaaaagcaacugagagagaacgcggaagacauggggaauggaugcuucaagaucuaucauaaaugugauaacgccugcauuggcucuauccgcaaugggaccuacgaccacaacguguaccgggacgaggcucuuaauaacagauuucagauuaagggcguugagcugaaauccggauauaaggauuggauccucuggaucagcuucgccauuuccugcuuucugcuuuguguggcccugcucggcuucaucaugugggcuugccagaaagggaauauucgcuguaacaucugcauuuga

SEQ ID NO: 196179 - RNA, 1701 nt, Artificial Sequence
  derived and/or modified sequence opt5 from hemagglutinin__InfluenzaA__ALE31615
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugguugauggaugguauggcuucagacaccagaacagcgagggccgggggcaggccgcugaccugaaauccacccaagccgccauugaucagaucaauggaaagcucaacagacugauuggcaaaacaaaugaaaaguuccaccagaucgagaaggaauuuagcgagguggaagggcgcauucaggaccuugagaaauacguggaggauaccaagaucgaccuguggucuuauaacgcugaacuccuggucgcgcuggagaaccaacauacaaucgaucucaccgacuccgaaaugaauaaacuguucgagaagacgaaaaagcagcuucgggaaaacgccgaggauaugggaaauggcugcuuuaagauuuaccacaaaugugacaacgcuugcaucgagagcauuagaaaugggacauaugaucaugacguguaccgcgacgaagcccugaacaaucgguuccagaucaagggcguugagcucaaaucuggauacaaggauuggauucuguggaucuccuuugccaucagcugcuuccuucuguguguggcucuccugggcuuuauuaugugggccugccagaaagggaacaucagauguaauauuugcaucuga

SEQ ID NO: 196180 - RNA, 1701 nt, Artificial Sequence; identical to SEQ ID NO: 195465
  derived and/or modified sequence opt5 from hemagglutinin__InfluenzaA__ALE31616

SEQ ID NO: 196181 - RNA, 1701 nt, Artificial Sequence; identical to SEQ ID NO: 195465
  derived and/or modified sequence opt5 from hemagglutinin__InfluenzaA__ALE31617

SEQ ID NO: 196182 - RNA, 1701 nt, Artificial Sequence; identical to SEQ ID NO: 195465
  derived and/or modified sequence opt5 from hemagglutinin__InfluenzaA__ALE31618

SEQ ID NO: 196183 - RNA, 1701 nt, Artificial Sequence; identical to SEQ ID NO: 196123
  derived and/or modified sequence opt5 from hemagglutinin__InfluenzaA__ALE31619

SEQ ID NO: 196184 - RNA, 1701 nt, Artificial Sequence; identical to SEQ ID NO: 195465
  derived and/or modified sequence opt5 from hemagglutinin__InfluenzaA__ALE31620

SEQ ID NO: 196185 - RNA, 1701 nt, Artificial Sequence
  derived and/or modified sequence opt5 from hemagglutinin__InfluenzaA__ALE31622
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgugcccaucggaaaauguaaguccgaaugcauuaccccgaacggcucuaucccuaaugauaagcccuuccagaacgugaauagaaucacauacggcgccuguccucgguaugucaaacacagcacgcucaagcuggcuaccgggaugcgcaacguucccgagaaacagacaagaggaauuuuuggcgccaucgcgggguucauugaaaauggaugggagggcaugguggacgggugguacggauuucggcaccaaaacuccgagggcagaggccaggccgcugaucuuaagagcacccaggccgcuaucgaccaaauuaaugggaaacugaaccgccucaucggaaagacaaaugaaaaauuccaucagauugagaaggaguucucugaaguggaaggccggauccaggaucuggagaaguaugucgaggacaccaaaaucgaucuuugguccuacaacgccgaacugcucguggcccuggagaaucagcacacgauugaccugacagauagcgaaaugaacaagcucuuugagaaaaccaagaaacaacugagagaaaacgcugaggacauggggaauggaugcuucaagaucuaucauaagugugauaacgcgugcauuggcucuauccgcaaugggaccuacgaccacaacguuuaccgggacgaggcccuuaauaacagauuucagauuaaaggcguggaacugaaguccggauauaaagauuggauccucuggaucagcuucgcuauuuccugcuuucugcuuugugucgcccugcucggcuucaucaugugggccugccagaaggggaauauucgcuguaacaucugcauuuga

SEQ ID NO: 196186 - RNA, 1701 nt, Artificial Sequence; identical to SEQ ID NO: 195465
  derived and/or modified sequence opt5 from hemagglutinin__InfluenzaA__ALE31623

SEQ ID NO: 196187 - RNA, 1701 nt, Artificial Sequence; identical to SEQ ID NO: 195465
  derived and/or modified sequence opt5 from hemagglutinin__InfluenzaA__ALE31625

SEQ ID NO: 196188 - RNA, 1701 nt, Artificial Sequence; identical to SEQ ID NO: 195465
  derived and/or modified sequence opt5 from hemagglutinin__InfluenzaA__ALE31626

SEQ ID NO: 196189 - RNA, 1701 nt, Artificial Sequence; identical to SEQ ID NO: 195465
  derived and/or modified sequence opt5 from hemagglutinin__InfluenzaA__ALE31627

SEQ ID NO: 196190 - RNA, 1701 nt, Artificial Sequence; identical to SEQ ID NO: 195465
  derived and/or modified sequence opt5 from hemagglutinin__InfluenzaA__ALE31628

SEQ ID NO: 196191 - RNA, 1701 nt, Artificial Sequence; identical to SEQ ID NO: 195465
  derived and/or modified sequence opt5 from hemagglutinin__InfluenzaA__ALE31629

SEQ ID NO: 196192 - RNA, 1701 nt, Artificial Sequence; identical to SEQ ID NO: 195465
  derived and/or modified sequence opt5 from hemagglutinin__InfluenzaA__ALE31632

SEQ ID NO: 196193 - RNA, 1701 nt, Artificial Sequence
  derived and/or modified sequence opt5 from hemagglutinin__InfluenzaA__ALE31634
augaagaccaucauugcccugagcuacauccucugccuggugcuugcucagaaaauucccggcaacgacaauuccacagccacgcugugucucgggcaccaugcggucccuaacggaaccaucguuaagacaauuaccaaugauagaaucgaggugacaaacgcuaccgaacuggugcaaaauucuagcaucggcgagauuugcgacuccccgcaccagauccuugauggggaaaacuguacacugauugacgcccuccugggagauccccagugcgacggcuuccagaauaaaaagugggaucuguuugucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcaucagacggagcagcuccagcuucuuuucucgccugaauuggcucacccaucugaacuauacauacccugcccuuaaugucaccaugcccaacaacgagcaguucgacaagcuguauauuuggggcgugcaccauccugggacggauaaggaccagaucuuucucuacgcgcaguccagcggaagaauuacaguuuccaccaaacggucucaacaggccgugaucccgaauaucggcagccgcccccggauuagagauaucccuucccgcauuagcaucuacuggacaauugucaagcccggggacauccugcugaucaacucuaccggaaaucucauugcuccuagaggcuauuucaaaauccgguccgggaagucuucuauuaugcgcagcgacgcccccaucggaaaauguaaguccgaaugcauuaccccgaacggcucuaucccuaaugauaagcccuuucagaacgugaauagaaucacauacggcgcuuguccucgguaugugaaacacagcacgcugaagcuggccaccgggaugcgcaacguccccgagaaacagacaagaggaauuuucggcgcgaucgccggguuuauugaaaauggaugggagggcaugguugacgggugguacggauuccggcaccaaaacuccgagggcagaggccaggcugccgaucuuaagagcacccaggcugccaucgaccaaauuaaugggaaacucaaccgccugaucggaaagacaaaugaaaaauuucaucagauugagaaggaguucucugaaguggaaggccggauccaggaucuugagaaguauguggaggacaccaaaaucgaucugugguccuacaacgccgaacuccuggucgcucuggagaaucagcacacgauugaccucacagauagcgaaaugaacaagcuguucgagaaaaccaagaaacaacuuagagaaaacgcggaggacauggggaauggaugcuuuaagaucuaucauaagugugauaacgccugcauuggcucuauccgcaaugggaccuacgaccacaacguguaccgggacgaggcucugaauaacagauuccagauuaaaggcguugaacucaaguccggauauaaagauuggauccuguggaucagcuuugccauuuccugcuuccuucuguguguggcccuccugggcuuuaucaugugggcuugccagaaggggaauauucgcuguaacaucugcauuuga

SEQ ID NO: 196194 - RNA, 1701 nt, Artificial Sequence; identical to SEQ ID NO: 195465
  derived and/or modified sequence opt5 from hemagglutinin__InfluenzaA__ALE31635

SEQ ID NO: 196195 - RNA, 1701 nt, Artificial Sequence; identical to SEQ ID NO: 195465
  derived and/or modified sequence opt5 from hemagglutinin__InfluenzaA__ALE31636

SEQ ID NO: 196196 - RNA, 1701 nt, Artificial Sequence
  derived and/or modified sequence opt5 from hemagglutinin__InfluenzaA__ALE31638
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgcccccaucggaaaauguaaguccgaaugcauuaccccgaacggcucuaucccuaauggcaagcccuuccagaacgugaauagaaucacauacggggcuuguccucgguaugugaaacacagcacgcucaagcuggccaccggaaugcgcaacguccccgagaaacagacaagaggcauuuuuggggcgaucgccggauucauugaaaauggcugggaggggaugguugauggaugguacggcuuucggcaccaaaacuccgagggcagagggcaggcugccgaccuuaagagcacccaggcugccaucgaucaaauuaauggaaaacugaaccgccucaucggcaagacaaaugaaaaauuccaucagauugagaaggaguucucugaaguggaagggcggauccaggaccuggagaaguauguggaggauaccaaaaucgaccuuugguccuacaacgccgaacugcucgucgcucuggagaaucagcacacgauugaucugacagacagcgaaaugaacaagcucuuugagaaaaccaagaaacaacugagagaaaacgcggaggauaugggaaauggcugcuucaagaucuaucauaagugugacaacgccugcauugggucuauccgcaauggcaccuacgaucacaacguguaccgggacgaggcucuuaauaacagauuucagauuaaaggaguugaacugaaguccggcuauaaagacuggauccucuggaucagcuucgccauuuccugcuuucugcuuuguguggcccugcucggguucaucaugugggcuugccagaagggaaauauucgcuguaacaucugcauuuga

SEQ ID NO: 196197 - RNA, 1701 nt, Artificial Sequence; identical to SEQ ID NO: 195465
  derived and/or modified sequence opt5 from hemagglutinin__InfluenzaA__ALE31639

SEQ ID NO: 196198 - RNA, 1701 nt, Artificial Sequence; identical to SEQ ID NO: 196016
  derived and/or modified sequence opt5 from hemagglutinin__InfluenzaA__ALE31640

SEQ ID NO: 196199 - RNA, 1701 nt, Artificial Sequence; identical to SEQ ID NO: 196022
  derived and/or modified sequence opt5 from hemagglutinin__InfluenzaA__ALE31641

SEQ ID NO: 196200 - RNA, 1701 nt, Artificial Sequence; identical to SEQ ID NO: 196022
  derived and/or modified sequence opt5 from hemagglutinin__InfluenzaA__ALE31642

SEQ ID NO: 196201 - RNA, 1701 nt, Artificial Sequence
  derived and/or modified sequence opt5 from hemagglutinin__InfluenzaA__ALE31643
augaagaccaucauugcccugagcuacauccucugccugguguucgcucagaaacuucccgagaacgacaauuccacagccacgcugugucucggccaccaugcggucccuaacgggaccauuguuaagacaaucaccucugauagaauugaagugacaaaugcuaccgagcuggugcaaaacagcuccaucggagaaaucugcgacucuccgcaccagauucuugauggcaaaaauuguacacugaucgacgcccuccugggggauccccagugcgacggauuucagaacaagaaaugggaucuguucgucgagcggagcaccgccuauuccaauuguuacccuuaugacgugcccgauuacgcuucucuccgcagccugguugccuccagcggcacgcuugaauuuaacgacgagucuuucaauugggcuggggugacccaaaacggaacauccagcgccugcauuagaggcucuaauuccagcuuuuucucucggcugaacuggcucacccauuccaauuuuaaguauccugcgcugaacgucacaaugcccaauaacgagcaguucgauaagcuguacaucuggggcgugcaccauccugggaccgacaaagaucagauuuuucuguaugcccagagcuccggacgcaucacgguuucuacaaagagaagccaacaggcugugauuccgaacaucggcucccggccccgcaucagaaauauuccuagccggaucucuauuuacuggaccaucgucaaacccggggacauucuccugaucaacuccacaggaaaucugaucgccccucgcggcuacuucaagauuagaagcgggaaaucuagcaucaugcgguccgacgcucccauuggaaaguguaagucugaaugcaucaccccgaacggcagcauuccuaaugauaaacccuuucagaacgugaaucgcaucaccuauggcgccuguccuagauacgugaagcaguccacacucaaacuggcgacggggaugcggaacguccccgagaagcaaacccgcggaaucuucggcgccauugcuggguuuaucgaaaauggaugggagggcaugaaagacgggugguauggauucagacaccagaacagcgagggccggggccaggccgcugaucuuaagucuacacaagccgccauugaccagaucaaugggaaacugaacagacucauuggaaagaccaaugaaaaguuccaccagaucgagaaagaauuuuccgagguugaaggccgcauucaggaucuggagaaguacguggaggacacaaaaaucgaucuuuggagcuauaacgcugaacugcucguggcgcuggagaaucaacauaccaucgaccugacggauucugaaaugaacaaacucuucgagaagacaaagaagcagcugcgggaaaacgccgaggacauggggaauggaugcuuuaaaauuuaccacaagugugauaacgcuugcaucggcuccauuagaaaugggaccuaugaccaugacgucuaccgcgaugaggcccuuaacaaucgguuccagaucaaaggcguggaacuuaagagcggauacaaagacuggauucucuggaucuccuuugccaucucuugcuuccugcuuuguguugcucugcucggcuuuauuaugugggccugccagaaggggaacaucagauguaauauuugcaucuga

SEQ ID NO: 196202 - RNA, 1701 nt, Artificial Sequence; identical to SEQ ID NO: 195465
  derived and/or modified sequence opt5 from hemagglutinin__InfluenzaA__ALE31644

SEQ ID NO: 196203 - RNA, 1701 nt, Artificial Sequence; identical to SEQ ID NO: 195465
  derived and/or modified sequence opt5 from hemagglutinin__InfluenzaA__ALE31645

SEQ ID NO: 196204 - RNA, 1701 nt, Artificial Sequence; identical to SEQ ID NO: 195465
  derived and/or modified sequence opt5 from hemagglutinin__InfluenzaA__ALE31646

SEQ ID NO: 196205 - RNA, 1701 nt, Artificial Sequence; identical to SEQ ID NO: 196022
  derived and/or modified sequence opt5 from hemagglutinin__InfluenzaA__ALE31647

SEQ ID NO: 196206 - RNA, 1701 nt, Artificial Sequence
  derived and/or modified sequence opt5 from hemagglutinin__InfluenzaA__ALE31648
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcagccguccggaagaauuacaguuagcaccaagcggucccaacaggccgugauccccaauaucggcucucgcccucggauuagagauauccccagccgcauuuccaucuacuggacaauugucaagccuggggacauccuccugaucaacagcaccggaaaucugauugcucccagaggcuauuuuaaaauccggucugggaaguccagcauuaugcgcucugacgccccgaucggaaaauguaagagcgaaugcauuaccccuaacggcuccauccccaaugauaagccuuuccagaacgugaauagaaucacauacggcgcuuguccccgguaugugaaacacucuacgcucaagcuggccaccgggaugcgcaacguccccgagaaacagacaagaggaauuuuuggcgcgaucgccggguucauugaaaauggaugggagggcaugguugacgggugguacggauuucggcaccaaaacagcgagggcagaggccaggcugccgaucuuaaguccacccaggcugccacagaccaaaucaaugggaaacugaaccgccucauuggaaagaccaaugaaaaauuccaucagaucgagaaggaguucagcgaaguggaaggccggauucaggaucuggagaaguauguggaggacacgaaaaucgaucuuuggucuuacaacgccgaacugcucgucgcucuggagaaucagcacacaaucgaccugaccgauuccgaaaugaacaagcucuuugagaaaaccaagaaacaacugagagaaaacgcggaggacauggggaauggaugcuucaagauuuaucauaagugugauaacgccugcaucggcagcauucgcaaugggacauacgaccacaacguguaccgggacgaggcucuuaauaacagauuucagaucaaaggcguugaacugaagucuggauauaaagauuggauucucuggaucuccuucgccaucagcugcuuucugcuuuguguggcccugcucggcuucauuaugugggcuugccagaaggggaauauccgcuguaacauuugcaucuga

SEQ ID NO: 196207 - RNA, 1701 nt, Artificial Sequence; identical to SEQ ID NO: 195465
  derived and/or modified sequence opt5 from hemagglutinin__InfluenzaA__ALE31649

SEQ ID NO: 196208 - RNA, 1701 nt, Artificial Sequence; identical to SEQ ID NO: 196022
  derived and/or modified sequence opt5 from hemagglutinin__InfluenzaA__ALE31650

SEQ ID NO: 196209 - RNA, 1701 nt, Artificial Sequence
  derived and/or modified sequence opt5 from hemagglutinin__InfluenzaA__ALE31652
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauaaguacccugcccugaaugucacaaugcccaacaacgagcaguuugacaaacuuuauauuuggggcgugcaccauccugggaccgauaaagaccagaucucccuguacgcgcagagcuccggaagaauuacgguuucuacaaagcggagccaacaggccgugaucccgaauaucggcucccgcccccggauuagagauaucccuagccgcauuucuaucuacuggaccauugucaaacccggggacauccuccugaucaacuccacaggaaaucugauugcuccuagaggcuauuucaagauccggagcgggaaaucuagcauuaugcgcuccgacgcccccaucggaaaguguaagucugaaugcauuaccccgaacggcagcaucccuaaugauaaacccuuucagaacgugaauagaaucaccuacggcgcuuguccucgguaugugaagcacuccacacucaaacuggccacggggaugcgcaacguccccgagaagcagaccagaggaauuuucggcgcgaucgccggguuuauugaaaauggaugggagggcaugguugacgggugguacggauuccggcaccaaaacagcgagggcagaggccaggcugccgaucuuaaaucuacacaggcugccaucgaccaaauuaaugggaagcugaaccgccucaucggaaaaaccaaugaaaaguuucaucagauugagaaggaguucuccgaaguggaaggccggauccaggaucuggagaaauauguggaggacacaaagaucgaucuuuggagcuacaacgccgaacugcucgucgcucuggagaaucagcacaccauugaccugacggauucugaaaugaacaaacucuucgagaagacaaagaagcaacugagagaaaacgcggaggacauggggaauggaugcuuuaagaucuaucauaaaugugauaacgccugcauuggcuccauccgcaaugggaccuacgaccacaacguguaccgggacgaggcucuuaauaacagauuccagauuaagggcguugaacugaaaagcggauauaaggauuggauccucuggaucuccuuugccauuucuugcuuccugcuuuguguggcccugcucggcuuuaucaugugggcuugccagaaagggaauauucgcuguaacaucugcauuuga

SEQ ID NO: 196210 - RNA, 1701 nt, Artificial Sequence; identical to SEQ ID NO: 196116
  derived and/or modified sequence opt5 from hemagglutinin__InfluenzaA__ALE31653

SEQ ID NO: 196211 - RNA, 1701 nt, Artificial Sequence; identical to SEQ ID NO: 195465
  derived and/or modified sequence opt5 from hemagglutinin__InfluenzaA__ALE31654

SEQ ID NO: 196212 - RNA, 1701 nt, Artificial Sequence; identical to SEQ ID NO: 195465
  derived and/or modified sequence opt5 from hemagglutinin__InfluenzaA__ALE31655

SEQ ID NO: 196213 - RNA, 1701 nt, Artificial Sequence
  derived and/or modified sequence opt5 from hemagglutinin__InfluenzaA__ALE31656
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggauaucuucgucgagcggucuaaagccuauagcaacuguuacccuuaugacgugcccgauuacgcuucccugcgcucucugguugccagcuccgggacccucgaauuuaauaacgagagcuucaauuggacgggagugacccaaaacggcacaucuuccgcuugcauuagacggagcagcuccagcuuuuucucucgccugaauuggcuuacccaucugaacuauacauacccugcccucaaugucaccaugcccaacaacgagcaguuugacaagcuguauaucuggggcgugcaccauccugggacggauaaggaccagauuuuccuuuacgcgcaguccagcggaagaaucacaguuuccaccaaacggucucaacaggccgugaucccgaauauuggcagccgccccagaauccgggauauuccuucccgcaucagcauuuacuggacaaucgucaagcccggggacauccugcucauuaacucuaccggaaaucugaucgcuccuagaggcuauuuuaaaauucgguccgggaagucuucuaucaugcgcagcgacgcccccauuggaaaauguaaguccgaaugcaucaccccgaacggcucuaucccuaaugauaagcccuuccagaacgugaauagaauuacauacggcgcuuguccucgguaugugaaacacagcacgcugaagcucgccaccgggaugcgcaacguccccgagaaacagacaagaggaaucuuuggcgcgauugccggguucaucgaaaauggaugggagggcaugauggacgggugguacggauuucggcaccaaaacuccgagggcagaggccaggcugccgaucuuaagagcacccaggcugccauugaccaaaucaaugggaaacugaaccgccugauuggaaagacaaaugaaaaauuccaucagaucgagaaggaguucucugaaguugaaggccggauccaggaucucgagaaguauguggaggacaccaaaauugaucugugguccuacaacgccgaacuucugguggcucucgagaaucagcacacgaucgaccugacagauagcgaaaugaacaagcuguuugagaaaaccaagaaacaacucagagaaaacgcggaggacauggggaauggaugcuucaagauuuaucauaagugugauaacgccugcaucggcucuauucgcaaugggaccuacgaccacaacgucuaccgggacgaggcucugaauaacagauuucagaucaaaggcguggaacuuaaguccggauauaaagauuggauccuguggauuagcuucgccaucuccugcuuucuccuguguguugcccuucugggcuucauuaugugggcuugccagaaggggaauauccgcuguaacauuugcaucuga

SEQ ID NO: 196214 - RNA, 1701 nt, Artificial Sequence
  derived and/or modified sequence opt5 from hemagglutinin__InfluenzaA__ALE31657
augaagaccaucauugcccugagcuacauccucugccugguguccgcucagaaaauucccggcaacgacaauucuacagccacgcuuugucuggggcaccaugcggucccuaacggaaccaucguuaagacaauuaccaaugauagaaucgaggugacaaacgcuaccgaacucgugcaaaauagcuccaucggcgagauuugcgacucuccgcaccagauccuggauggggaaaacuguacacuuauugacgcccugcucggagauccccagugcgacggcuuccagaauaaaaagugggaucuguuugucgagcggagcaaagccuauuccaacuguuacccuuaugacgugcccgauuacgcuucucugcgcagccucguugccuccagcgggacccuggaguucaauaacgaaucuuuuaauuggacgggagugacccaaaacggcacauccagcgcuugcaucagacggucuuccagcucuuucuuuucccgccuuaauuggcugacccaucucaacuauacauacccugcccugaaugucaccaugcccaacaacgagcaguucgacaagcuguauauuuggggcgugcaccauccugggacggauaaggaccagaucuuucuguacgcgcagagcuccggaagaauuacaguuucuaccaaacggagccaacaggccgugaucccgaauaucggcucccgcccccggauuagagauaucccuagccgcauuucuaucuacuggacaauugucaagcccggggacauccuccugaucaacuccaccggaaaucugauugcuccuagaggcuauuucaaaauccggagcgggaagucuagcauuaugcgcuccgacgcccccaucggaaaauguaagucugaaugcauuaccccgaacggcagcaucccuaaugauaagcccuuucagaacgugaauagaaucacauacggcgcuuguccucgguaugugaaacacuccacgcucaagcuggccaccgggaugcgcaacguccccgagaaacagacaagaggaauuuucggcgcgaucgccggguuuauugaaaauggaugggagggcaugguugacgggugguacggauuccggcaccaaaacagcgagggcagaggccaggcugccgaucuuaagucuacccaggcugccaucgaccaaauuaaugggaaacugaaccgccucaucggaaagacaaaugaaaaauuucaucagauugagaaggaguucuccgaaguggaaggccggauccaggaucuggagaaguauguggaggacaccaaaaucgaucuuuggagcuacaacgccgaacugcucgucgcucuggagaaucagcacacgauugaccugacagauucugaaaugaacaaacucuucgagaagaccaagaaacaacugagagaaaacgcggaggacauggggaauggaugcuuuaagaucuaucauaagugugauaacgccugcauuggcuccauccgcaaugggaccuacgaccacaacguguaccgggacgaggcucuuaauaacagauuccagauuaaaggcguugaacuuaagagcggauauaaagauuggauccucuggaucuccuuugccauuucuugcuuccugcuuuguguggcccugcucggcuuuaucaugugggcuugccagaaggggaauauucgcuguaacaucugcauuuga

SEQ ID NO: 196215 - RNA, 1701 nt, Artificial Sequence; identical to SEQ ID NO: 195465
  derived and/or modified sequence opt5 from hemagglutinin__InfluenzaA__ALE31658

SEQ ID NO: 196216 - RNA, 1701 nt, Artificial Sequence; identical to SEQ ID NO: 196080
  derived and/or modified sequence opt5 from hemagglutinin__InfluenzaA__ALE31659

SEQ ID NO: 196217 - RNA, 1701 nt, Artificial Sequence; identical to SEQ ID NO: 196009
  derived and/or modified sequence opt5 from hemagglutinin__InfluenzaA__ALE31660

SEQ ID NO: 196218 - RNA, 1701 nt, Artificial Sequence
  derived and/or modified sequence opt5 from hemagglutinin__InfluenzaA__ALE31661
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagaagucucaacaggccgugaucccgaauaucggcagccggccccgcauuagagauaucccuucccggauuagcaucuacuggacaauugucaaacccggggacauccuccugaucaacucuaccggaaaucugauugcuccucgcggcuauuuuaagaucagauccgggaaaagcucuauuaugcggagcgacgcccccaucggaaaguguaaguccgaaugcauuaccccgaacggcucuaucccuaaugauaaacccuuccagaacgugaaucgcaucacauacggcgcuuguccuagauaugugaagcacagcacgcucaaacuggccaccgggaugcggaacguccccgagaagcagacacgcggaauuuuuggcgcgaucgccggguucauugaaaauggaugggagggcaugguugacgggugguacggauuuagacaccaaaacuccgagggccggggccaggcugccgaucuuaaaagcacccaggcugccaucgaccaaauuaaugggaagcugaacagacucaucggaaaaacaaaugaaaaguuccaucagauugagaaggaguucucugaaguggaaggccgcauccaggaucuggagaaauauguggaggacaccaagaucgaucuuugguccuacaacgccgaacugcucgucgcucuggagaaucagcacacgauugaccugacagauagcgaaaugaacaaacucuuugagaagaccaaaaagcaacugcgggaaaacgcggaggacauggggaauggaugcuucaagaucuaucauaaaugugauaacgccugcauuggcucuaucagaaaugggaccuacgaccacaacguguaccgcgacgaggcucuuaauaaccgguuucagauuaagggcguugaacugaaauccggauauaaggauuggauccucuggaucagcuucgccauuuccugcuuucugcuuuguguggcccugcucggcuucaucaugugggcuugccagaaagggaauauuagauguaacaucugcauuuga

SEQ ID NO: 196219 - RNA, 1701 nt, Artificial Sequence
  derived and/or modified sequence opt5 from hemagglutinin__InfluenzaA__ALE31662
augaagaccaucauugcccugagcuacauccucugccugguguucgcucagaaaauucccggcaacgacaauuccacagccacgcuuugucuggggcaccaugcggucccuaacggaaccaucguuaagacaauugcuaaugauagaaucgaggugaccaacgccacagaacucgugcaaaauucuagcaucggcgagauuugcgacuccccgcaccagauccuggauggggaaaacuguacccuuauugacgcccugcucggagauccccagugcgacggcuuucagaauaaaaagugggaucuguucgucgagcggucuaaggcuuauagcaacuguuacccuuaugacgugcccgauuacgccucccugcgcucucucguugcuagcuccgggacacuggaauuuaauaacgagagcuucaauuggaccggagugacgcaaaacggcaccucuuccgccugcaucagacggucuagcuccagcuuuuucucucgccuuaauuggcugacacaucucaacuauaccuacccugcgcugaaugucacaaugcccaacaacgagcaguuugacaaacuuuauauuuggggcgugcaccauccugggaccgauaaggaccagaucuuccuguacgcccaguccagcggaagaauuacgguuuccacaaaaggcucucaacaggcugugaucccgaauaucgggagccggccccgcauuagagauaucccuucccggauuagcaucuacuggaccauugucaagcccggagacauccuccugaucaacucuacaggcaaucugauugccccucgcggguauuuuaaaaucagauccggaaagagcucuauuaugcggagcgacgcucccaucggcaaauguaaguccgaaugcauuaccccgaacggcucuaucccuaaugauaagcccuuccagaacgugaaucgcaucaccuacggggccuguccuagauaugugaaacacagcacacucaagcuggcgacgggaaugcggaacguccccgagaaacagacccgcggcauuuuuggggccaucgcuggauucauugaaaauggcugggaggggaugguugacggaugguacggcuuuagacaccaaaacuccgagggccgggggcaggccgcugaucuuaagagcacacaggccgccaucgaccaaauuaauggaaaacugaacagacucaucggcaagaccaaugaaaaauuccaucagauugagaaggaguucucugaaguggaagggcgcauccaggaucuggagaaguauguggaggacacaaaaaucgaucuuugguccuacaacgcugaacugcucgucgcgcuggagaaucagcacaccauugaccugacggauagcgaaaugaacaagcucuuugagaaaacaaagaaacaacugcgggaaaacgccgaggacaugggaaauggcugcuucaagaucuaucauaagugugauaacgcuugcauugggucuaucagaaauggcaccuacgaccacaacguguaccgcgacgaggcccuuaauaaccgguuucagauuaaaggaguugaacugaaguccggcuauaaagauuggauccucuggaucagcuucgccauuuccugccugcuucuguguguggcucuccugggguuuaucaugugggccugccagaagggaaauauuagauguaacaucugcauuuga

SEQ ID NO: 196220 - RNA, 1701 nt, Artificial Sequence; identical to SEQ ID NO: 195451
  derived and/or modified sequence opt5 from hemagglutinin__InfluenzaA__ALE31663

SEQ ID NO: 196221 - RNA, 1701 nt, Artificial Sequence
  derived and/or modified sequence opt5 from hemagglutinin__InfluenzaA__ALE31666
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaaaguccucuuccagcuuuuucucucggcuuaauuggcugacccaucucaaguauacauacccugcccugaacgucaccaugcccaauaacgagcaguuugacaaacuuuauauuuggggcgugcaccauccugggacggauaaggaccagaucuuccuguacgcgcgcuccagcggaagaauuacaguuuccaccaaacggucucagcaagccgugaucccgaacaucggcagccgcccccggauuagagauaucccuucccgcauuagcaucuacuggacaauugucaagcccggggacauccuccugaucaauucuaccggaaaccugauugcuccuagaggcuauuuuaaaauccgguccggaaagagcucuauuaugcgcagcgacgcccccaucgggaaguguaaauccgaaugcauuaccccgaauggcucuaucccuaacgauaagcccuuccagaaugugaacagaaucacauacggcgcuuguccucgguaugugaaacacagcacgcucaagcuggccaccgggaugcgcaauguccccgagaaacagacaagaggaauuuuuggcgcgaucgccggguucauugaaaacggaugggagggcaugguugacgggugguacggauuucggcaccagaauagcgagggcagaggccaagcugccgaucuuaagagcacccaggcugccaucgaccagauuaacgggaaacugaaucgccucaucggaaagacaaacgaaaaguuccaucaaauugagaaagaguucucugaaguggaaggccggauccaggaucuggagaaguauguggaggacaccaaaaucgaucuuugguccuacaaugccgaacugcucgucgcucuggagaaccagcacacgauugaccugacagauagcgaaaugaauaagcucuuugagaaaaccaagaagcagcugagagaaaacgcggaggacauggggaacggaugcuucaaaaucuaucauaagugugauaaugccugcauuggcucuauccgcaacgggaccuacgaccacaauguguaccgggacgaggcucuuaacaauagauuucaaauuaaaggcguugaacugaaguccggauauaaagauuggauccucuggaucagcuucgccauuuccugcuuucugcuuuguguggcccugcucggcuucaucaugugggcuugccagaaggggaacauucgcuguaauaucugcauuuga

SEQ ID NO: 196222 - RNA, 1701 nt, Artificial Sequence
  derived and/or modified sequence opt5 from hemagglutinin__InfluenzaA__ALE31667
augaagaccaucauugcccugagcuacauccucugccugguguucgcucagaaaauucccggcaacgacaauuccacagccacgcuuugucuggggcaccaugcgguccucaacggaaccaucguuaagacaauuaccaaugauagaaucgaggugacaaacgcuaccgaacuggugcaaaauucuagcaucggcgagauuugcgacuccccucaccagauccuugauggggaaaacuguacacugauugacgcccuccugggagauccgcagugcgacggcuuucagaauaaaaagugggaucuguucgucgagcggucuaaagccuauagcaacuguuaccccuaugacgugccugauuacgcuucccuccgcucucugguugccagcuccgggacccuugaauuuaauaacgagagcuucaauuggacgggagugacccaaaacggcacaucuuccgcuugcaucagaaagucuagcuccagcuuuuucucucggcugaauuggcucacccaucugaacuauacauaccccgcccuuaaugucaccaugccuaacaacgagcaguuugacaagcuguauauuuggggcgugcaccaucccgggacggauaaagaccagaucuuccucuacgcgcgcuccagcggaagaauuacaguuuccaccaagcggucucagcaagccgugaucccuaauaucggcagccgcccgcggauuagagauauccccucccgcauuagcaucuacuggacaauugucaaaccuggggacauccugcugaucaacucuaccggaaaucucauugcucccagaggcuauuuuaagauccgguccgggaaaagcucuauuaugcgcagcgacgccccuaucggaaaguguaaguccgaaugcauuacccccaacggcucuaucccgaaugauaaaccuuuccagaacgugaauagaaucacauacggcgcuuguccccgguaugugaagcacagcacgcugaaacuugccaccgggaugcgcaacgucccugagaagcagacaagaggaauuuuuggcgcgaucgccggguucauugaaaauggaugggagggcaugguugacgggugguacggauuucggcaccagaacuccgagggcagaggccaagcugccgaucugaaaagcacccaggcugccaucgaccagauuaaugggaagcucaaccgccugaucggaaaaacaaaugaaaaguuccaucaaauugagaaggaguucucugaaguggaaggccggauccaggaucuugagaaauauguggaggacaccaagaucgaucugugguccuacaacgccgaacuccuggucgcucuggagaaucagcacacgauugaccucacagauagcgaaaugaacaaacuguuugagaagaccaaaaagcagcuuagagaaaacgcggaggacauggggaauggaugcuucaagaucuaucauaaaugugauaacgccugcauuggcucuauccgcaaugggaccuacgaccacaacguguaccgggacgaggcucugaauaacagauuucaaauuaagggcguugaacucaaauccggauauaaggauuggauccuguggaucagcuucgccauuuccugcuuucuucuguguguggcccuccugggcuucaucaugugggcuugccagaaagggaauauucgcuguaacaucugcauuuga

SEQ ID NO: 196223 - RNA, 1701 nt, Artificial Sequence; identical to SEQ ID NO: 195465
  derived and/or modified sequence opt5 from hemagglutinin__InfluenzaA__ALE31668

SEQ ID NO: 196224 - RNA, 1701 nt, Artificial Sequence; identical to SEQ ID NO: 195465
  derived and/or modified sequence opt5 from hemagglutinin__InfluenzaA__ALE31669

SEQ ID NO: 196225 - RNA, 1701 nt, Artificial Sequence
  derived and/or modified sequence opt5 from hemagglutinin__InfluenzaA__ALE31670
augaagaccaucauugcccugagcuacauccucugccugguguucgcucagaaacuucccgagaacgacaauuccacagccacgcugugucucggccaccaugcggucccuaacgggaccauuguuaagacaaucaccucugauagaauugaagugacaaaugcuaccgagcuggugcaaaacagcuccaucggagaaaucugcgacucuccgcaccagauucuugauggcaaaaauuguacacugaucgacgcccuccugggggauccccagugcgacggauuucagaacaagaaaugggaucuguucgucgagcggagcaaggccuauuccaauuguuacccuuaugacgugcccgauuacgcuucucuccgcagccugguugccuccagcggcacccuugaauuuaacgacgagucuuucaauugggcuggggugacgcaaaacggaaccuccagcgccugcauuagaggcucuaauuccagcuuuuucucucggcugaacuggcucacacauuccaauuuuaaguauccugcgcugaacgucaccaugcccaauaacgagcaguucgauaaacuuuacaucuggggcgugcaccauccugggacagacaaggaucagauuuuucuguaugcccagagcuccggacgcaucaccguuucuacgaaaagaagccaacaggcugugauuccgaacaucggcucccggccccgcaucagaaauauuccuagccggaucucuauuuacuggacaaucgucaagcccggggacauucuccugaucaacuccaccggaaaucugaucgccccucgcggcuacuucaaaauuagaagcgggaagucuagcaucaugcgguccgacgcucccauuggaaaguguaaaucugaaugcaucacaccgaacggcagcauuccuaaugauaagcccuuucagaacgugaaucgcaucaccuauggcgccuguccuagauacgugaaacaguccacccucaagcuggcgacagggaugcggaacguccccgagaaacaaacgcgcggaaucuucggcgccauugcuggguuuaucgaaaauggaugggagggcaugaaggacgggugguauggauucagacaccagaacagcgagggccggggccaggccgcugaucuuaaaucuacccaagccgccauugaccagaucaaugggaagcugaacagacucauuggaaagacaaaugaaaaauuccaccagaucgagaaggaauuuuccgagguugaaggccgcauucaggaucuggagaaauacguggaggacaccaagaucgaucuuuggagcuauaacgcugaacugcucguggcgcuggagaaucaacauacaaucgaccugaccgauucugaaaugaacaaacucuucgagaagacgaagaaacagaugcgggaaaacgccgaggacauggggaauggaugcuuuaagauuuaccacaaaugugauaacgcuugcaucggcuccauuagaaaugggacauaugaccaugacgucuaccgcgaugaggcccugaacaaucgguuccagaucaagggcguggaacuuaaaagcggauacaaggacuggauucuguggaucuccuuugccaucucuugcuuccuccuguguguugcccuucugggcuuuauuaugugggcuugccagaaggggaacaucagauguaauauuugcaucuga

SEQ ID NO: 196226 - RNA, 1701 nt, Artificial Sequence; identical to SEQ ID NO: 195465
  derived and/or modified sequence opt5 from hemagglutinin__InfluenzaA__ALE31671

SEQ ID NO: 196227 - RNA, 1701 nt, Artificial Sequence; identical to SEQ ID NO: 195465
  derived and/or modified sequence opt5 from hemagglutinin__InfluenzaA__ALE31672

SEQ ID NO: 196228 - RNA, 1701 nt, Artificial Sequence; identical to SEQ ID NO: 196022
  derived and/or modified sequence opt5 from hemagglutinin__InfluenzaA__ALE31673

SEQ ID NO: 196229 - RNA, 1701 nt, Artificial Sequence
  derived and/or modified sequence opt5 from hemagglutinin__InfluenzaA__ALE31674
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcacuccagcggaagaauuacaguuuccaccaagcggucucagcaagccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgcccccaucggaaaauguaaguccgaaugcauuaccccgaacggcucuaucccuaaugauaagcccuuccagaacgugaauagaaucacauacggcgcuuguccucgguaugugaaacacagcacgcucaagcuggccaccgggaugcgcaacguccccgagaaacagacaagaggaauuuuuggcgcgaucgccggguucauugaaaauggaugggagggcaugguugacgggugguacggauuucggcaucagaacuccgagggcagaggccaagcugccgaucuuaagagcacccaggcugccaucgaccagauuaaugggaaacugaaccgccucaucggaaagacaaaugaaaaauuccaccaaauugagaaggaguucucugaaguggaaggccggauccaggaucuggagaaguauguggaggacaccaaaaucgaucuuugguccuacaacgccgaacugcucgucgcucuggagaaucagcauacgauugaccugacagauagcgaaaugaacaagcucuuugagaaaaccaagaaacagcugagagaaaacgcggaggacauggggaauggaugcuucaagaucuaucacaagugugauaacgccugcauuggcucuauccgcaaugggaccuacgaccacaacguguaccgggacgaggcucuuaauaacagauuucaaauuaaaggcguugaacugaaguccggauauaaagauuggauccucuggaucagcuucgccauuuccugcuuucugcuuuguguggcccugcucggcuucaucaugugggcuugccagaaggggaauauucgcuguaacaucugcauuuga

SEQ ID NO: 196230 - RNA, 1701 nt, Artificial Sequence
  derived and/or modified sequence opt5 from hemagglutinin__InfluenzaA__ALE31675
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcaacuccccgcaccagauccuggacggggaaaauuguacacuuauugaugcccugcucggagacccccagugcgauggcuuucagaacaaaaagugggaccuguucgucgagcggucuaaagccuauagcaauuguuacccuuaugaugugcccgacuacgcuucccugcgcucucucguugccagcuccgggacccuggaauuuaacaaugagagcuucaacuggacgggagugacccaaaauggcacaucuuccgcuugcaucagacggucuagcuccagcuuuuucucucgccuuaacuggcugacccaucucaauuauacauacccugcccugaacgucaccaugcccaacaaugagcaguuugauaaacuuuauauuuggggcgugcaccauccugggacggacaaggaucagaucuuccuguacgcgcaguccagcggaagaauuacaguuuccaccaagggcucucaacaggccgugaucccgaacaucgggagccggccccgcauuagagacaucccuucccggauuagcaucuacuggacaauugucaagcccggagauauccuccugaucaauucuaccggcaaccugauugcuccucgcggguauuuuaaaaucagauccggaaagagcucuauuaugcggagcgacgcccccaucggcaaauguaaguccgaaugcauuaccccgaauggcucuaucccuaacgacaagcccuuccagaaugugaaccgcaucacauacggggcuuguccuagauaugugaaacacagcacgcucaagcuggccaccggaaugcggaauguccccgagaaacagacacgcggcauuuuuggggcgaucgccggauucauugaaaacggcugggaggggaugguugauggaugguacggcuuuagacaccaaaauuccgagggccgggggcaggcugccgaccuuaagagcacccaggcugccaucgaucaaauuaacggaaaacugaauagacucaucggcaagacaaacgaaaaauuccaucagauugagaaggaguucucugaaguggaagggcgcauccaggaccuggagaaguauguggaggauaccaaaaucgaccuuugguccuacaaugccgaacugcucgucgcucuggagaaccagcacacgauugaucugacagacagcgaaaugaacaagcucuuugagaaaaccaagaaacaacugcgggaaaaugcggaggauaugggaaacggcugcuucaagaucuaucauaagugugacaaugccugcauugggucuaucagaaacggcaccuacgaucacaauguguaccgcgacgaggcucuuaacaaucgguuucagauuaaaggaguugaacugaaguccggcuauaaagacuggauccucuggaucagcuucgccauuuccugcuuucugcuuuguguggcccugcucggguucaucaugugggcuugccagaagggaaacauuagauguaauaucugcauuuga

SEQ ID NO: 196231 - RNA, 1701 nt, Artificial Sequence
  derived and/or modified sequence opt5 from hemagglutinin__InfluenzaA__ALE31676
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaaacggucucaacaggccgugaucccgaauaucggcagccgccccaagauuagagauaucccuucccggauuagcaucuacuggacaauugucaaacccggggacauccuccugaucaacucuaccggaaaucugauugcuccucgcggcuauuuuaagauccucuccgggaaaagcucuauuaugagaagcgacgcccccaucggaaaguguaaguccgaaugcauuaccccgaacggcucuaucccuaaugauaaacccuuccagaacgugaaucggaucacauacggcgcuuguccucgcuaugugaagcacagcacgcugaaacuugccaccgggaugagaaacguccccgagaagcagacacggggaauuuuuggcgcgaucgccggguucauugaaaauggaugggagggcaugguugacgggugguacggauuucgccaccaaaacuccgagggcagaggccaggcugccgaucugaaaagcacccaggcugccaucgaccaaauuaaugggaagcucaaccggcugaucggaaaaacaaaugaaaaguuccaucagauugagaaggaguucucugaaguggaaggcagaauccaggaucuugagaaauauguggaggacuccaagaucgaucuguggagcuacaacgccgaacuccuggucgcucuggagaaucagcacaccauugaccucacggauucugaaaugaacaaacuguuugagaagacaaagaagcaacuucgcgaaaacgcggaggacauggggaauggaugcuucaagaucuaucauaaaugugauaacgccugcauuggcuccauccggaaugggaccuacgaccacaacguguacagagacgaggcucugaauaaccgcuuucagauuaagggcguugaacucaaaagcggauauaaggauuggauccuguggaucuccuucgccauuucuugcuuucuucuguguguggcccuccugggcuucaucaugugggcuugccagaaagggaauauucgguguaacaucugcauuuga

SEQ ID NO: 196232 - RNA, 1701 nt, Artificial Sequence; identical to SEQ ID NO: 196123
  derived and/or modified sequence opt5 from hemagglutinin__InfluenzaA__ALE31677

SEQ ID NO: 196233 - RNA, 1701 nt, Artificial Sequence; identical to SEQ ID NO: 195465
  derived and/or modified sequence opt5 from hemagglutinin__InfluenzaA__ALE31678

SEQ ID NO: 196234 - RNA, 1701 nt, Artificial Sequence; identical to SEQ ID NO: 195465
  derived and/or modified sequence opt5 from hemagglutinin__InfluenzaA__ALE31679

SEQ ID NO: 196235 - RNA, 1701 nt, Artificial Sequence; identical to SEQ ID NO: 196081
  derived and/or modified sequence opt5 from hemagglutinin__InfluenzaA__ALE31680

SEQ ID NO: 196236 - RNA, 1701 nt, Artificial Sequence; identical to SEQ ID NO: 196080
  derived and/or modified sequence opt5 from hemagglutinin__InfluenzaA__ALE31681

SEQ ID NO: 196237 - RNA, 1701 nt, Artificial Sequence; identical to SEQ ID NO: 195465
  derived and/or modified sequence opt5 from hemagglutinin__InfluenzaA__ALE31682

SEQ ID NO: 196238 - RNA, 1701 nt, Artificial Sequence; identical to SEQ ID NO: 195465
  derived and/or modified sequence opt5 from hemagglutinin__InfluenzaA__ALE31683

SEQ ID NO: 196239 - RNA, 1701 nt, Artificial Sequence; identical to SEQ ID NO: 195465
  derived and/or modified sequence opt5 from hemagglutinin__InfluenzaA__ALE31684

SEQ ID NO: 196240 - RNA, 1701 nt, Artificial Sequence; identical to SEQ ID NO: 195465
  derived and/or modified sequence opt5 from hemagglutinin__InfluenzaA__ALE31685

SEQ ID NO: 196241 - RNA, 1701 nt, Artificial Sequence; identical to SEQ ID NO: 195465
  derived and/or modified sequence opt5 from hemagglutinin__InfluenzaA__ALE31686

SEQ ID NO: 196242 - RNA, 1701 nt, Artificial Sequence
  derived and/or modified sequence opt5 from hemagglutinin__InfluenzaA__ALE31687
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgcccccaucggaaaauguaaguccgaaugcauuaccccgaacggcucuaucccuaaugauaagcccuuccagaacgugaauagaaucacauacggcgcuuguccucgguaugugaaacacagcacgcucaagcuggccaccgggaugcgcaacguccccgagaaacagacaagaggaauuuuuggcgcgaucgccggguucauugaaaauggaugggagggcaugguugacgggugguacggauuucggcaccaaaacuccgagggcagaggccaggcugccgaucuuaagagcacccaggcugccaucgaccaaauuaaugggaaacugaaccgccucaucggaaagacaaaugaaaaauuccaucagauugagaaggaguucucugaaguggaaggccggauccaggaucuggagaaguauguggaggacaccaaaaucgaucuuugguccuacaacgccgaacugcucgucgcucuggagaaucagcacacgauugaccugacagauagcgaaaugaacaagcucuuugagaaaaccaagaaacaacugagagaaaacgcggaggacauggggaauggaugcuucaagaucuaucauaagugugauaacgccugcauugagucuauccgcaauggcaccuacgaccacaacguguaccgggacgaagcucuuaauaacagauuucagauuaaagggguugagcugaaguccggcuauaaagauuggauccucuggaucagcuucgccauuuccugcuuucugcuuuguguggcccugcucggauucaucaugugggcuugccagaagggcaauauucgcuguaacaucugcauuuga

SEQ ID NO: 196243 - RNA, 1701 nt, Artificial Sequence
  derived and/or modified sequence opt5 from hemagglutinin__InfluenzaA__ALE31688
augaagaccacaaucgcccugagcuacauucucugccugguguucgcucagaaacuucccgagaacgacaauuccacggccacccugugucucggccaccaugcggucccuaacgggacaaucguuaagaccauuacaucugauagaaucgaagugaccaaugcuacagagcuggugcaaaacagcuccauuggagaaaucugcgacucuccgcaccagauccuugauggcaaaaauuguacccugauugacgcccuccugggggauccccagugcgacggauuucagaacaagaaaugggaucuguucgucgagcggagcaaggccuauuccaauuguuacccuuaugacgugcccgauuacgcuucucuccgcagccugguugccuccagcggcacgcuugaauuuaacgacgagucuuucaauugggcuggggugacccaaaacggaacauccagcgccugcaucagaggcucuaauuccagcuuuuucucucggcugaacuggcucacccauuccaauuuuaaguauccugcgcugaacgucacaaugcccaauaacgagcaguucgauaaacuuuacauuuggggcgugcaccauccugggaccgacaaggaucagaucuuucuguaugcccagagcuccggacgcauuacgguuucuacaaaaagaagccaacaggcugugaucccgaacauuggcucccggccccgcaucagaaauaucccuagccggauuucuaucuacuggaccauugucaagcccggggacauccuccugauuaacuccacaggaaaucugaucgccccucgcggcuacuucaaaaucagaagcgggaagucuagcauuaugcgguccgacgcucccaucggaaaguguaaaucugaaugcauuaccccgaacggcagcaucccuaaugauaagcccuuucagaacgugaaucgcauuaccuauggcgccuguccuagauacgugaaacaguccacacucaagcuggcgacggggaugcggaacguccccgagaaacaaacccgcggaaucuucggcgccaucgcuggguuuauugaaaauggaugggagggcaugaaggacgggugguauggauucagacaccagaacagcgagggccggggccaggccgcugaucuuaaaucuacacaagccgccaucgaccagauuaaugggaagcugaacagacucaucggaaagaccaaugaaaaauuccaccagauugagaaggaauuuuccgagguugaaggccgcauccaggaucuggagaaauacguggaggacacaaagauugaucuuuggagcuauaacgcugaacugcucguggcgcuggagaaucaacauaccaucgaccugacggauucugaaaugaacaaacucuucgagaagacaaagaaacagcugcgggaaaacgccgaggacauggggaauggaugcuuuaagaucuaccacaaaugugauaacgcuugcauuggcuccaucagaaaugggaccuaugaccaugacgucuaccgcgaugaggcccuuaacaaucgguuccagauuaagggcguggaacugaaaagcggauacaaggacuggauccucuggauuuccuuugccaucucuugcuuccugcuuuguguugcucugcucggcuuuaucaugugggccugccagaaggggaacauuagauguaauaucugcauuuga

SEQ ID NO: 196244 - RNA, 1701 nt, Artificial Sequence; identical to SEQ ID NO: 195465
  derived and/or modified sequence opt5 from hemagglutinin__InfluenzaA__ALE31689

SEQ ID NO: 196245 - RNA, 1701 nt, Artificial Sequence
  derived and/or modified sequence opt5 from hemagglutinin__InfluenzaA__ALE31690
augaagaccaucauugcccugagcugcauccucugucugguguucgcucagaaacuucccggcaacgacaauuccacagccacgcugugccucgggcaccaugcggucccuaacggaaccauuguuaagacaaucaccaaugauagaauugaggugacaaacgcuaccgaacuggugcaaaauucuagcaucggcgagaucugugacuccccgcaccagauucuugauggggaaaacugcacacugaucgacgcccuccugggagauccccagugugacggcuuucagaauaaaaagugggaucuguucgucgagcggucuaaagccuacagcaacugcuauccuuacgacgugcccgauuaugcuucccuccgcucucugguugccagcuccgggacccuugaauuuaauaacgagagcuucaauugggcuggagugacgcaaaacggcaccucuuccagcuguauuagaggcucuaauuccagcuuuuucucucggcugaacuggcucacacaucuuaauuccaaguacccugcccugaacgucaccaugcccaacaaugagcaguuugacaagcuguauaucuggggagugcaccauccugggacagauaaagaccagauuuuccucuacgcgcagagcuccggccgcaucaccguuucuacgaagagaagccaacaggccgugauuccgaacaucgggucccggccccgcaucagagauauuccuagccggaucucuauuuauuggacaaucgucaaacccggagacauucugcugaucaauuccaccggcaaccucaucgcuccucgcggguacuuuaagauuagaagcggaaaaucuagcaucaugcgguccgacgcccccauuggcaagugcaagucugaauguaucacaccgaauggcagcauuccuaacgauaaacccuuccagaaugugaaccgcaucaccuacggggcuugcccuagauaugugaagcaguccacccugaaacuugccacaggaaugcggaauguccccgagcgccaaacgagaggcaucuuuggggcgauugccggauucaucgaaaacggcugggaggggaugguugacggaugguacggcuuucggcaccagaauagcgagggcagagggcaggcugccgaucugaagucuacccaagcugccauugaccagaucaacggaaaacucaaucgccugauuggcaagacaaacgaaaaauuccaccagaucgagaaggaguucuccgaaguggaagggcggauucaggaucuugagaaguauguggaggacaccaaaaucgaucuguggagcuacaaugccgaacuccuggucgcucuggagaaccaacauacaaucgaccucaccgauucugaaaugaacaagcuguuugagaaaacgaagaaacagcuuagagaaaaugcggaggacaugggaaacggcuguuucaagauuuaucacaagugcgauaaugccugcaucggguccauucgcaacggcacauacgaccauaauguguaucgggacgaggcucugaacaauagauuucagaucaaaggaguugaacucaagagcggcuacaaagauuggauucuguggaucuccuucgccaucucuuguuuucuucugugcguggcccuccugggguucauuaugugggcuugucagaagggaaacauccgcugcaauauuuguaucuga

SEQ ID NO: 196246 - RNA, 1701 nt, Artificial Sequence; identical to SEQ ID NO: 193018
  derived and/or modified sequence opt5 from hemagglutinin__InfluenzaA__ALE31691

SEQ ID NO: 196247 - RNA, 1701 nt, Artificial Sequence
  derived and/or modified sequence opt5 from hemagglutinin__InfluenzaA__ALE31692
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaaagucuagcuccagcuuuuucucucggcuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcgcuccagcggaagaauuacaguuuccaccaagcggucucagcaagccgugaucccgaauaucggcuaccgcccccggauuagagauaucccuagccgcauuuccaucuauuggacaauugucaaacccggggacauccuccugaucaacagcaccggaaaucugauugcuccuagaggcuacuuuaagauccggucugggaaauccagcauuaugcgcucugacgcccccaucggaaaguguaagagcgaaugcauuaccccgaacggcuccaucccuaaugauaaacccuuccagaacgugaauagaaucacauauggcgcuuguccucgguacgugaagcacucuacgcucaaacuggccaccgggaugcgcaacguccccgagaagcagacaagaggaauuuuuggcgcgaucgccggguucauugaaaauggaugggagggcaugguugacgggugguauggauuucggcaccagaacagcgagggcagaggccaagcugccgaucuuaaauccacccaggcugccaucgaccagauuaaugggaagcugaaccgccucaucggaaaaacaaaugaaaaguuccaucaaauugagaaggaguucagcgaaguggaaggccggauccaggaucuggagaaauacguggaggacaccaagaucgaucuuuggucuuauaacgccgaacugcucgucgcucuggagaaucagcacacgauugaccugacagauuccgaaaugaacaaacucuuugagaagaccaaaaagcagcugagagaaaacgcggaggacauggggaauggaugcuucaagaucuaccauaaaugugauaacgccugcauuggcagcauccgcaaugggaccuacgaccacaacguguaucgggacgaggcucuuaauaacagauuucaaauuaagggcguugaacugaaaucuggauacaaggauuggauccucuggaucuccuucgccauuagcugcuuucugcuuuguguggcccugcucggcuucaucaugugggcuugccagaaagggaauauucgcuguaacaucugcauuuga

SEQ ID NO: 196248 - RNA, 1701 nt, Artificial Sequence; identical to SEQ ID NO: 196247
  derived and/or modified sequence opt5 from hemagglutinin__InfluenzaA__ALE31693

SEQ ID NO: 196249 - RNA, 1701 nt, Artificial Sequence; identical to SEQ ID NO: 195465
  derived and/or modified sequence opt5 from hemagglutinin__InfluenzaA__ALE31694

SEQ ID NO: 196250 - RNA, 1701 nt, Artificial Sequence; identical to SEQ ID NO: 196247
  derived and/or modified sequence opt5 from hemagglutinin__InfluenzaA__ALE31695

SEQ ID NO: 196251 - RNA, 1701 nt, Artificial Sequence; identical to SEQ ID NO: 196123
  derived and/or modified sequence opt5 from hemagglutinin__InfluenzaA__ALE31696

SEQ ID NO: 196252 - RNA, 1701 nt, Artificial Sequence; identical to SEQ ID NO: 196247
  derived and/or modified sequence opt5 from hemagglutinin__InfluenzaA__ALE31697

SEQ ID NO: 196253 - RNA, 1701 nt, Artificial Sequence
  derived and/or modified sequence opt5 from hemagglutinin__InfluenzaA__ALE31698
augaagaccaucauugcccugagcuacauccucugcaugguguucgcucagaaaauucccggcaacgacaauuccacagccacgcugugucuugggcaccaugcggucccuaacggaaccaucguuaagacaauuaccaaugauagaaucgaggugacaaacgcuaccgaacuggugcaaaauucuagcaucggcgagauuugcgacuccccgcaccagauccucgauggggaaaacuguacacugauugacgcccuucugggagauccccagugcgacggcuuucagaauaaaaagugggaucucuucgucgagcggucuaaagccuauagcaacuguuacccuuaugacgugcccgauuacgcuucccugcgcucucugguugccagcuccgggacccucgaauuuaauaacgagagcuucaauuggacgggagugacccaaaacggcacaucuuccgcuugcaucagacggagcagcuccagcuuuuucucucgccugaauuggcuuacccaucugaacuauacauacccugcccucaaugucaccaugcccaacaacgagcaguuugacaagcuguauauuuggggcgugcaccauccugggacggauaaggaccagaucuuccuuuacgcgcaguccagcggaagaauuacaguuuccaccaaacggucucaacaggccgugaucccgaauaucggcagccgcccccggauuagagauaucccuucccgcauuagcaucuacuggacaauugucaagcccggggacauccugcucaucaacucuaccggaaaucugauugcuccuagaggcuauuuuaaaauccgguccgggaagucuucuauuaugcgcagcgacgcccccaucggaaaauguaaguccgaaugcauuaccccgaacggcucuaucccuaaugauaagcccuuccagaacgugaauagaaucacauacggcgcuuguccucgguaugugaaacacagcacgcugaagcucgccaccgggaugcgcaacguccccgagaaacagacaagaggaauuuuuggcgcgaucgccggguucauugaaaauggaugggagggcaugguugacgggugguacggauuucggcaccaaaacuccgagggcagaggccaggcugccgaucuuaagagcacccaggcugccaucgaccaaauuaaugggaaacugaaccgccugaucggaaagacaaaugaaaaauuccaucagauugagaaggaguucucugaaguggaaggccggauccaggaucucgagaaguauguggaggacaccaaaaucgaucugugguccuacaacgccgaacuucuggucgcucucgagaaucagcacacgauugaccugacagauagcgaaaugaacaagcuguuugagaaaaccaagaaacaacucagagaaaacgcggaggacauggggaauggaugcuucaagaucuaucauaagugugauaacgccugcauuggcucuauccgcaaugggaccuacgaccacaacguguaccgggacgaggcucugaauaacagauuucagauuaaaggcguugaacuuaaguccggauauaaagauuggauccuguggaucagcuucgccauuuccugcuuucuccuguguguggcccuucugggcuucaucaugugggcuugccagaaggggaauauucgcuguaacaucugcauuuga

SEQ ID NO: 196254 - RNA, 1701 nt, Artificial Sequence
  derived and/or modified sequence opt5 from hemagglutinin__InfluenzaA__ALE31699
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccaauuacgcuucccugcgcucucucguugccagcuccgggacccuggaauuuaacaaugagagcuucaacuggacgggagugacccaaaauggcacaucuuccgcuugcaucagacggagcagcuccagcuuuuucucucgccuuaacuggcugacccaucucaauuaugccuacccugcgcugaacgucacaaugcccaacaaugagcaguuugauaaacuuuauauuuggggcgugcaccauccugggaccgacaaggaucagaucuuccuguacgcccaguccagcggaagaauuacgguuuccacaaagcggucucaacaggcugugaucccgaacaucggcagccgcccccggauuagagacaucccuucccgcauuagcaucuacuggaccauugucaagcccggggauauccuccugaucaauucuacaggaaaccugauugccccuagaggcuauuuuaaaauccgguccgggaagucuucuauuaugcgcagcgacgcucccaucggaaaauguaaguccgaaugcauuaccccgaauggcucuaucccuaacgacaagcccuuccagaaugugaacagaaucaccuacggcgccuguccucgguaugugaaacacagcacacucaagcuggcgacggggaugcgcaauguccccgagaaacagaccagaggaauuuuuggcgccaucgcuggguucauugaaaacggaugggagggcaugguugaugggugguacggauuucggcaccaaaauuccgagggcagaggccaggccgcugaccuuaagagcacacaggccgccaucgaucaaauuaacgggaaacugaaucgccucaucggaaagaccaacgaaaaauuccaucagauugagaaggaguucucugaaguggaaggccggauccaggaccuggagaaguauguggaggauacaaaaaucgaccuuugguccuacaaugcugaacugcucgucgcgcuggagaaccagcacaccauugaucugacggacagcgaaaugaacaagcucuuugagaaaacaaagaaacaacugagagaaaaugccgaggauauggggaacggaugcuucaagaucuaucauaagugugacaaugcuugcauuggcucuauccgcaacgggaccuacgaucacaauguguaccgggacgaggcccuuaacaauagauuucagauuaaaggcguugaacugaaguccggauauaaagacuggauccucuggaucagcuucgccauuuccugcuuucugcuuuguguggcucugcucggcuucaucaugugggccugccagaaggggaacauucgcuguaauaucugcauuuga

SEQ ID NO: 196255 - RNA, 1701 nt, Artificial Sequence; identical to SEQ ID NO: 195465
  derived and/or modified sequence opt5 from hemagglutinin__InfluenzaA__ALE31700

SEQ ID NO: 196256 - RNA, 1701 nt, Artificial Sequence; identical to SEQ ID NO: 195465
  derived and/or modified sequence opt5 from hemagglutinin__InfluenzaA__ALE31701

SEQ ID NO: 196257 - RNA, 1701 nt, Artificial Sequence; identical to SEQ ID NO: 196022
  derived and/or modified sequence opt5 from hemagglutinin__InfluenzaA__ALE31702

SEQ ID NO: 196258 - RNA, 1701 nt, Artificial Sequence; identical to SEQ ID NO: 195465
  derived and/or modified sequence opt5 from hemagglutinin__InfluenzaA__ALE31703

SEQ ID NO: 196259 - RNA, 1701 nt, Artificial Sequence; identical to SEQ ID NO: 195465
  derived and/or modified sequence opt5 from hemagglutinin__InfluenzaA__ALE31704

SEQ ID NO: 196260 - RNA, 1701 nt, Artificial Sequence; identical to SEQ ID NO: 196022
  derived and/or modified sequence opt5 from hemagglutinin__InfluenzaA__ALE31705

SEQ ID NO: 196261 - RNA, 1701 nt, Artificial Sequence
  derived and/or modified sequence opt5 from hemagglutinin__InfluenzaA__ALE31706
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagggcucucaacaggccgugaucccgaauaucgggagccggccccgcauuagagauaucccuucccggauuagcaucuacuggacaauugucaagcccggagacauccuccugaucaacucuaccggcaaucugauugcuccucgcggguauuuuaaaaucagauccggaaagagcucuauuaugcggagcgacgcccccaucggcaaauguaaguccgaaugcauuaccccgaacggcucuaucccuaaugauaagcccuuccagaacgugaaucgcaucacauacggggcuuguccuagauaugugaaacacagcacgcucaagcuggccaccggaaugcggaacguccccgagaaacagacacgcggcauuuuuggggcgaucgccggauucauugaaaauggcugggaggggaugguugacggaugguacggcuuuagacaccaaaacuccgagggccgggggcaggcugccgaucuuaagagcacccaggcugccaucgaccaaauuaauggaaaacugaacagacucaucggcaagacaaaugaaaaauuccaucagauugagaaggaguucucugaaguggaagggcgcauccaggaucuggagaaguauguggaggacaccaaaaucgaucuuugguccuacaacgccgaacugcucgucgcucuggagaaucagcacacgauugaccugacagauagcgaaaugaacaagcucuuugagaaaaccaagaaacaacugcgggaaaacgcggaggacaugggaaauggcugcuucaagaucuaucauaagugugauaacgccugcauugggucuaucagaaauggcaccuacgaccacaacguguaccgcgacgaggcucuuaauaaccgguuucagauuaaaggaguugaacugaaguccggcuauaaagauuggauccucuggaucagcuucgccauuuccugccugcuucuguguguggcccuccugggguuuaucaugugggcuugccagaagggaaauauuagauguaacaucugcauuuga

SEQ ID NO: 196262 - RNA, 1701 nt, Artificial Sequence; identical to SEQ ID NO: 196151
  derived and/or modified sequence opt5 from hemagglutinin__InfluenzaA__ALE31707

SEQ ID NO: 196263 - RNA, 1701 nt, Artificial Sequence; identical to SEQ ID NO: 196151
  derived and/or modified sequence opt5 from hemagglutinin__InfluenzaA__ALE31708

SEQ ID NO: 196264 - RNA, 1701 nt, Artificial Sequence; identical to SEQ ID NO: 195451
  derived and/or modified sequence opt5 from hemagglutinin__InfluenzaA__ALE31709

SEQ ID NO: 196265 - RNA, 1701 nt, Artificial Sequence
  derived and/or modified sequence opt5 from hemagglutinin__InfluenzaA__ALE31710
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaagcuguauauuuggggcgugcaccauccugggacggauaaggaccagaucuuccuguacgcgcaguccagcggaagaauuacaguuuccaccaaacggucucaacaggccgugaucccgaauaucggcagccgccuccggauuagagauauccccucccgcauuagcaucuacuggacaauugucaagccuggggacauccugcugaucaacucuaccggaaaucucauugcucccagaggcuauuuuaaaauccuguccgggaagucuucuauuaugcggagcgacgccccuaucggaaaauguaaguccgaaugcauuacccccaacggcucuaucccgaaugauaagccuuuccagaacgugaaucgcaucacauacggcgcuugucccagauaugugaaacacagcacgcuuaagcuggccaccgggaugcggaacgucccugagaaacagacacgcggaauuuuuggcgcgaucgccggguucauugaaaauggaugggagggcaugguugacgggugguacggauuuagacaccaaaacuccgagggccggggccaggcugccgaucucaagagcacccaggcugccaucgaccaaauuaaugggaaacugaacagacuuaucggaaagacaaaugaaaaauuccaucagauugagaaggaguucucugaaguggaaggccgcauccaggaucuggagaaguauguggaggacuccaaaaucgaucucuggagcuacaacgccgaacugcuggucgcucucgagaaucagcacaccauugaccugacggauucugaaaugaacaaacuuuuugagaagacaaagaaacaacugcgggaaaacgcggaggacauggggaauggaugcuucaagaucuaucauaagugugauaacgccugcauuggcuccaucagaaaugggaccuacgaccacaacguguaccgcgacgaggcucucaauaaccgguuucagauuaaaggcguugaacuuaagagcggauauaaagauuggauccuuuggaucuccuucgccauuucuugcuuucugcucuguguggcccugcugggcuucaucaugugggcuugccagaaggggaauauuagauguaacaucugcauuuga

SEQ ID NO: 196266 - RNA, 1701 nt, Artificial Sequence; identical to SEQ ID NO: 196151
  derived and/or modified sequence opt5 from hemagglutinin__InfluenzaA__ALE31711

SEQ ID NO: 196267 - RNA, 1701 nt, Artificial Sequence; identical to SEQ ID NO: 196009
  derived and/or modified sequence opt5 from hemagglutinin__InfluenzaA__ALE31712

SEQ ID NO: 196268 - RNA, 1701 nt, Artificial Sequence
  derived and/or modified sequence opt5 from hemagglutinin__InfluenzaA__ALE31713
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaaagucuagcuccagcuuuuucucucggcuuaauuggcugacccaucucaacuauacauacccugcccugaaugucaccaugcccaacaacgagcaguuugacaaacuuuauauuuggggcauccaccauccugggacggauaaggaccagauuuuccuguacgcgcgcuccagcggaagaaucacaguguccaccaagcggucucagcaagccguuaucccgaauauuggcagccgccccagaauccgggauauuccuucccgcaucagcauuuacuggacaaucgugaaacccggggacauccuccugauuaacucuaccggaaaucugaucgcuccuagaggcuauuuuaagauucgguccgggaaaagcucuaucaugcgcagcgacgcccccauuggaaaguguaaguccgaaugcaucaccccgaacggcucuaucccuaaugauaaacccuuccagaacgucaauagaauuacauacggcgcuuguccucgguaugugaagcacagcacgcucaaacuggccaccgggaugcgcaacauccccgagaagcagacaaaaggaauuuuuggcgcgaucgccggguucauugaaaauggaugggagggcaugguggacgggugguacggauuuagacaccagaacuccgagggccggggccaagcugccgaucuuaagagcacccaggcugccaucgaccagauuaaugggaaacugaacagacucaucggaaagacaaaugaaaaguuccaucaaaucgagaaagaguucucugaagucgaaggccgcauucaggaucuggagaaguauguugaggacaccaaaaucgaucuuugguccuacaacgccgaacugcucguggcucuggagaaucagcacacgauugaccugacagauagcgaaaugaacaagcucuuugagaaaaccaagaagcagcugcgggaaaacgcggaggacauggggaauggaugcuucaaaaucuaucauaagugugauaacgccugcauuggcucuaucagaaaugggaccuacgaccacaacguguaccgcgacgaggcucuuaauaaccgguuucaaaucaaaggcgucgaacugaaguccggauauaaagauuggauucucuggaucagcuucgccacauccugcuuucugcuuuguguggcccugcucggcuucauuaugugggcuugccagaaggggaauaucagauguaacauuugcaucuga

SEQ ID NO: 196269 - RNA, 1701 nt, Artificial Sequence; identical to SEQ ID NO: 196123
  derived and/or modified sequence opt5 from hemagglutinin__InfluenzaA__ALE31714

SEQ ID NO: 196270 - RNA, 1701 nt, Artificial Sequence; identical to SEQ ID NO: 196123
  derived and/or modified sequence opt5 from hemagglutinin__InfluenzaA__ALE31715

SEQ ID NO: 196271 - RNA, 1701 nt, Artificial Sequence; identical to SEQ ID NO: 196151
  derived and/or modified sequence opt5 from hemagglutinin__InfluenzaA__ALE31716

SEQ ID NO: 196272 - RNA, 1701 nt, Artificial Sequence
  derived and/or modified sequence opt5 from hemagglutinin__InfluenzaA__ALE31717
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaaagagcagcuccagcuuuuucucucggcuuaauuggcugacccaucucaacuauaaguacccugcccugaaugucacaaugcccaacaacgagcaguuugacaaacuuuauauuuggggcgugcaccauccugggaccgauaaggaccagaucuuccuguacgcgcgcuccagcggaagaauuacgguuuccacaaaaaccucucagcaagccgugaucccgaauaucggcagccggccccgcauuagagauaucccuucccggauuagcaucuacuggacaauugucaagcccggggacauccuccugaucaacucuaccggaaaucugauugcuccucgcggcuauuuuaaaaucagauccgggaagucuucuauuaugcggagcgacgcccccaucggaaaguguaaauccgaaugcauuaccccgaacggcucuaucccuaaugauaagcccuuccagaacgugaaucgcacaacguacggcgcuuguccuagauaugugaaacacagcacccucaagcuggccacagggaugcggaacguccccgagaaacagacccgcggaaucuuuggcgcgauugccggguucaucgaaaauggaugggagggcaugguugacgggugguacggauuuagacaccagaacuccgagggccggggccaagcugccgaucuuaagagcacacaggcugccauugaccagaucaaugggaaacugaacagacucauuggaaagaccaaugaaaaguuccaucaaaucgagaaagaguucucugaaguggaaggccgcauucaggaucuggagaaguauguggaggacacgaaaaucgaucuuugguccuacaacgccgaacugcucgucgcucuggagaaucagcacacaaucgaccugaccgauagcgaaaugaacaagcucuuugagaaaaccaagaagcagcugcgggaaaacgcggaggacauggggaauggaugcuucaaaauuuaucauaagugugauaacgccugcaucggcucuauuagaaaugggacauacgaccacaacguguaccgcgacgaggcucuuaauaaccgguuucaaaucaaaggcguugaacugaaguccggauauaaagauuggauucucuggaucagcuucgccaucuccugcuuucugcuuuguguggcccugcucggcuucauuaugugggcuugccagaaggggaauaucagauguaacauuugcaucuga

SEQ ID NO: 196273 - RNA, 1701 nt, Artificial Sequence; identical to SEQ ID NO: 196123
  derived and/or modified sequence opt5 from hemagglutinin__InfluenzaA__ALE31718

SEQ ID NO: 196274 - RNA, 1701 nt, Artificial Sequence
  derived and/or modified sequence opt5 from hemagglutinin__InfluenzaA__ALE31719
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaaagucuagcuccagcuuuuucucucggcuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcgcuccagcggaagaauuacaguuuccaccaagcggucucagcaagccgugaucccgaauaucggcagccgcccccggauuagagauaucccuucccgcauuagcaucuacuggacaauugucaaacccggggacauccuccugaucaacucuaccggaaaucugauugcuccuagaggcuauuuuaagauccgguccgggaaaagcucuauuaugcgcagcgacgcccccaucggaaaguguaaguccgaaugcauuaccccgaacggcucuaucccuaaugauaaacccuuccagaacgugaauagaaucacauacggcgcuuguccucgguaugugaagcacagcacgcucaaacuggccaccgggaugcgcaacauucccgagaagcagacaagaggaaucuuuggcgcgauugccggguucaucgaaaauggaugggagggcauggucgacgggugguacggauuucggcaccagaacuccgagggcagaggccaagcugccgaucuuaaaagcacccaggcugccauugaccagaucaaugggaagcugaaccgccucauuggaaaaacaaaugaaaaguuccaucaaaucgagaaggaguucucugaaguugaaggccggauccaggaucuggagaaauauguggaggacaccaagauugaucuuugguccuacaacgccgaacugcucguggcucuggagaaucagcacacgaucgaccugacagauagcgaaaugaacaaacucuuugagaagaccaaaaagcagcugagagaaaacgcggaggacauggggaauggaugcuucaagauuuaucauaaaugugauaacgccugcaucggcucuauucgcaaugggaccuacgaccacaacgucuaccgggacgaggcucuuaauaacagauuucaaaucaagggcguggaacugaaauccggauauaaggauuggauccucuggauuagcuucgccaucuccugcuuucugcuuuguguugcccugcucggcuucauuaugugggcuugccagaaagggaauauccgcuguaacauuugcaucuga

SEQ ID NO: 196275 - RNA, 1701 nt, Artificial Sequence; identical to SEQ ID NO: 196009
  derived and/or modified sequence opt5 from hemagglutinin__InfluenzaA__ALE31720

SEQ ID NO: 196276 - RNA, 1701 nt, Artificial Sequence; identical to SEQ ID NO: 196022
  derived and/or modified sequence opt5 from hemagglutinin__InfluenzaA__ALE31721

SEQ ID NO: 196277 - RNA, 1701 nt, Artificial Sequence; identical to SEQ ID NO: 196245
  derived and/or modified sequence opt5 from hemagglutinin__InfluenzaA__ALE31722

SEQ ID NO: 196278 - RNA, 1701 nt, Artificial Sequence
  derived and/or modified sequence opt5 from hemagglutinin__InfluenzaA__ALE31723
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaaagucuagcuccagcuuuuucucucggcuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcgcuccagcggaagaauuacaguuuccaccaagcggucucagcaagccgugaucccgaauaucggcagccgcccccggauuagagauaucccuucccgcauuagcaucuacuggacaauugucaaacccggggacauccuccugaucaacucuaccggaaaucugauugcuccuagaggcuauuuuaagauccgguccgggaaaagcucuauuaugcgcagcgacgcccccaucggaaaguguaaguccgaaugcaccacaccgaacggcucuauuccuaaugauaaacccuuccagaacgugaauagaaucacguacggcgcuuguccucgguaugugaagcacagcacccucaaacuggccacagggaugcgcaacguccccgagaagcagaccagaggaaucuuuggcgcgauugccggguucaucgaaaauggaugggagggcaugguugacgggugguacggauuucggcaccagaacuccgagggcagaggccaagcugccgaucuuaaaagcacacaggcugccauugaccagaucaaugggaagcugaaccgccucauuggaaaaaccaaugaaaaguuccaucaaaucgagaaggaguucucugaaguggaaggccggauucaggaucuggagaaauauguggaggacacgaagaucgaucuuugguccuacaacgccgaacugcucgucgcucuggagaaucagcacacaaucgaccugaccgauagcgaaaugaacaaacucuuugagaagaccaaaaagcagcugagagaaaacgcggaggacauggggaauggaugcuucaagauuuaucauaaaugugauaacgccugcaucggcucuauucgcaaugggacauacgaccacaacguguaccgggacgaggcucuuaauaacagauuucaaaucaagggcguugaacugaaauccggauauaaggauuggauucucuggaucagcuucgccaucuccugcuuucugcuuuguguggcccugcucggcuucauuaugugggcuugccagaaagggaauauccgcuguaacauuugcaucuga

SEQ ID NO: 196279 - RNA, 1701 nt, Artificial Sequence; identical to SEQ ID NO: 195465
  derived and/or modified sequence opt5 from hemagglutinin__InfluenzaA__ALE31724

SEQ ID NO: 196280 - RNA, 1701 nt, Artificial Sequence; identical to SEQ ID NO: 195465
  derived and/or modified sequence opt5 from hemagglutinin__InfluenzaA__ALE31725

SEQ ID NO: 196281 - RNA, 1701 nt, Artificial Sequence; identical to SEQ ID NO: 195465
  derived and/or modified sequence opt5 from hemagglutinin__InfluenzaA__ALE31726

SEQ ID NO: 196282 - RNA, 1701 nt, Artificial Sequence; identical to SEQ ID NO: 195465
  derived and/or modified sequence opt5 from hemagglutinin__InfluenzaA__ALE31727

SEQ ID NO: 196283 - RNA, 1701 nt, Artificial Sequence
  derived and/or modified sequence opt5 from hemagglutinin__InfluenzaA__ALE31728
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccauucccaacaacgagcaguuugacaaacuuuauaucuggggcgugcaccauccugggacggauaaggaccagauuuuccuguacgcgcaguccagcggaagaaucacaguuuccaccaagcggucucaacaggccgugaucccgaauauuggcagccgccccagaauccgggauauuccuucccgcaucagcauuuacuggacaaucgucaagcccggggacauccuccugauuaacucuaccggaaaucugaucgcuccuagaggcuauuuuaaaauucgguccgggaagucuucuaucaugcgcagcgacgcccccauuggaaaauguaaguccgaaugcaucaccccgaacggcucuaucccuaaugauaagcccuuccagaacgugaauagaauuacauacggcgcuuguccucgguaugugaaacacagcacgcucaagcuggccaccgggaugcgcaacguccccgagaaacagacaagaggaaucuuuggcgcgauugccggguucaucgaaaauggaugggagggcaugguugacgggugguacggauuucggcaccaaaacuccgagggcagaggccaggcugccgaucuuaagagcacccaggcugccauugaccaaaucaaugggaaacugaaccgccucauuggaaagacaaaugaaaaauuccaucagaucgagaaggaguucucugaaguggaaggccggauccaggaucuggagaaguauguggaggacaccaaaauugaucuuugguccuacaacgccgaacugcucgucgcucuggagaaucagcacacgaucgaccugacagauagcgaaaugaacaagcucuuugagaaaaccaagaaacaacugagagaaaacgcggaggacauggggaauggaugcuucaagauuuaucauaagugugauaacgccugcaucggcucuauucgcaaugggaccuacgaccacaacguguaccgggacgaggcucuuaauaacagauuucagaucaaaggcguugaacugaaguccggauauaaagauuggauccucuggauuagcuucgccaucuccugcuuucugcuuuguguggcccugcucggcuucauuaugugggcuugccagaaggggaauauccgcuguaacauuugcaucuga

SEQ ID NO: 196284 - RNA, 1701 nt, Artificial Sequence
  derived and/or modified sequence opt5 from hemagglutinin__InfluenzaA__ALE31729
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagaucauugauggggaaaacuguacacugaucgacgcccuucugggagauccccagugcgacggcuuucagaauaaaaagugggaucucuucgucgagcggucuaaagccuauagcaacuguuacccuuaugacgugcccgauuacgcuucccugcgcucucugguugccagcuccgggacccucgaauuuaauaacgagagcuucaauuggacgggagugacccaaaacggcacaucuuccgcuugcauuagacggagcagcuccagcuuuuucucucgccugaauuggcuuacccaucugaacuauacauacccugcccucaaugucaccaugcccaacaacgagcaguuugacaagcuguauaucuggggcgugcaccauccugggacggauaaggaccagauuuuccuuuacgcgcaguccagcggaagaaucacaguuuccaccaaacggucucaacaggccgugaucccgaauauuggcagccgccccagaauccgggauauuccuucccgcaucagcauuuacuggacaaucgucaagcccggggacauccugcucauuaacucuaccggaaaucugaucgcuccuagaggcuauuuuaaaauucgguccgggaagucuucuaucaugcgcagcgacgcccccauuggaaaauguaaguccgaaugcaucaccccgaacggcucuaucccuaaugauaagcccuuccagaacgugaauagaauuacauacggcgcuuguccucgguaugugaaacacagcacgcugaagcucgccaccgggaugcgcaacguccccgagaaacagacaagaggaaucuuuggcgcgauugccggguucaucgaaaauggaugggagggcaugguugacgggugguacggauuucggcaccaaaacuccgagggcagaggccaggcugccgaucuuaagagcacccaggcugccauugaccaaaucaaugggaaacugaaccgccugauuggaaagacaaaugaaaaauuccaucagaucgagaaggaguucucugaaguggaaggccggauccaggaucucgagaaguauguggaggacaccaaaauugaucugugguccuacaacgccgaacuucuggucgcucucgagaaucagcacacgaucgaccugacagauagcgaaaugaacaagcuguuugagaaaaccaagaaacaacucagagaaaacgcggaggacauggggaauggaugcuucaagauuuaucauaagugugauaacgccugcaucggcucuauucgcaaugggaccuacgaccacaacguguaccgggacgaggcucugaauaacagauuucagaucaaaggcguugaacuuaaguccggauauaaagauuggauccuguggauuagcuucgccaucuccugcuuucuccuguguguggcccuucugggcuucauuaugugggcuugccagaaggggaauauccgcuguaacauuugcaucuga

SEQ ID NO: 196285 - RNA, 1701 nt, Artificial Sequence; identical to SEQ ID NO: 195465
  derived and/or modified sequence opt5 from hemagglutinin__InfluenzaA__ALE31730

SEQ ID NO: 196286 - RNA, 1701 nt, Artificial Sequence
  derived and/or modified sequence opt5 from hemagglutinin__InfluenzaA__ALE31731
augaagaccaucauugcccugagcuacauccucugccagguguucgcucaaaagauucccggcaacgacaauuccacagccacgcugugucuugggcaccaugcggucccuaacggaaccaucguuaagacaauuaccaaugauagaaucgaggugacaaacgcuaccgaacuggugcagaauagcagcaucggcgagauuugcgacuccccgcaccagauccucgauggggaaaacuguacacugauugacgcccuucugggagauccccagugcgacggcuuucaaaauaaaaagugggaucucuucgucgagcggucuaaagccuauagcaacuguuacccuuaugacgugcccgauuacgcuucccugcgcucucugguugccagcuccgggacccucgaauuuaauaacgagagcuucaauuggacgggagugacccagaacggcacaucuuccgcuugcaucagaaagucuucuuccagcuuuuucucucggcugaauuggcuuacccaucugaacuauacauacccugcccucaaugucaccaugcccaacaacgagcaguuugacaagcuguauauuuggggcgugcaccauccugggacggauaaagaccagaucuuccuuuacgcgcgcuccagcggaagaauuacaguuuccaccaagcggucucaacaggccgugaucccgaauaucggcagccgcccccggauuagagauaucccuucccgcauuagcaucuacuggacaauugucaaacccggggacauccugcucaucaacucuaccggaaaucugauugcuccuagaggcuauuuuaagauccgguccgggaaaagcucuauuaugcgcagcgacgcccccaucggaaaguguaaguccgaaugcauuaccccgaacggcucuaucccuaaugauaaacccuuccagaacgugaauagaaucacauacggcgcuuguccucgguaugugaagcacagcacgcugaaacucgccaccgggaugcgcaacguccccgagaagcagacaagaggaauuuuuggcgcgaucgccggguucauugaaaauggaugggagggcaugguugacgggugguacggauuucggcaccaaaacuccgagggcagaggccaggcugccgaucugaaaagcacccaggcugccaucgaccaaauuaaugggaaacuuaaccgccugaucggaaaaacaaaugaaaaguuccaucagauugagaaggaguucucugaaguggaaggccggauccaggaucucgagaaauauguggaggacaccaagaucgaucugugguccuacaacgccgaacuucuggucgcucucgagaaucagcacacgauugaccugacagauagcgaaaugaacaaacuguuugagaagaccaaaaagcaacucagagaaaacgcggaggacauggggaauggaugcuucaagaucuaucauaaaugugauaacgccugcauuggcucuauccgcaaugggaccuacgaccacaacguguaccgggacgaggcucugaauaacagauuucagauuaagggcguugaacuuaaauccggauauaaggauuggauccuguggaucagcuucgccauuuccugcuuucuccuguguguggcccuucugggcuucaucaugugggcuugccagaaagggaauauucgcuguaacaucugcauuuga

SEQ ID NO: 196287 - RNA, 1701 nt, Artificial Sequence; identical to SEQ ID NO: 196123
  derived and/or modified sequence opt5 from hemagglutinin__InfluenzaA__ALE31732

SEQ ID NO: 196288 - RNA, 1701 nt, Artificial Sequence; identical to SEQ ID NO: 196123
  derived and/or modified sequence opt5 from hemagglutinin__InfluenzaA__ALE31733

SEQ ID NO: 196289 - RNA, 1701 nt, Artificial Sequence
  derived and/or modified sequence opt5 from hemagglutinin__InfluenzaA__ALE31734
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaaagucuagcuccagcuuuuucucucggcuuaauuggcugacccaucucaaguauacauacccugcccugaacgucaccaugcccaauaacgagcaguuugacaaacuuuauauuuggggcgugcaccauccugggacggauaaggaccagaucuuccuguacgcgcgcuccagcggaagaauuacaguuuccaccaaacggucucagcaagccgugaucccgaacaucggcuuucgcccccggauuagagauaucccuagccgcauuuccaucuacuggacaauugucaagcccggggacauccuccugaucaauagcaccggaaaccugauugcuccuagaggcuauuucaaaauccggucugggaaguccagcauuaugcgcucugacgcccccaucggaaaguguaaaagcgaaugcauuaccccgaauggcuccaucccuaacgauaagcccuuucagaaugugaacagaaucacauacggcgcuuguccucgguaugugaaacacucuacgcucaagcuggccaccgggaugcgcaauguccccgagaaacagacaagaggaauuuucggcgcgaucgccggguuuauugaaaacggaugggagggcaugguugacgggugguacggauuccggcaccagaauagcgagggcagaggccaagcugccgaucuuaaguccacccaggcugccaucgaccagauuaacgggaaacugaaucgccucaucggaaagacaaacgaaaaguuccaucaaauugagaaagaauuuagcgagguggaaggccggauccaggaucuggagaaguauguggaggacaccaaaaucgaucuuuggucuuacaaugccgaacugcucgucgcucuggagaaccagcacacgauugaccugacagauuccgaaaugaauaaacucuucgagaagaccaagaagcagcugagagaaaacgcggaggacauggggaacggaugcuuuaaaaucuaucauaagugugauaaugccugcauuggcagcauccgcaacgggaccuacgaccacaauguguaccgggacgaggcucuuaacaauagauuccaaauuaaaggcguugaacugaagucuggauauaaagauuggauccucuggaucuccuuugccauuagcugcuuccugcuuuguguggcccugcucggcuuuaucaugugggcuugccagaaggggaacauucgcuguaauaucugcauuuga

SEQ ID NO: 196290 - RNA, 1701 nt, Artificial Sequence; identical to SEQ ID NO: 196123
  derived and/or modified sequence opt5 from hemagglutinin__InfluenzaA__ALE31735

SEQ ID NO: 196291 - RNA, 1701 nt, Artificial Sequence; identical to SEQ ID NO: 196022
  derived and/or modified sequence opt5 from hemagglutinin__InfluenzaA__ALE31736

SEQ ID NO: 196292 - RNA, 1701 nt, Artificial Sequence; identical to SEQ ID NO: 196022
  derived and/or modified sequence opt5 from hemagglutinin__InfluenzaA__ALE31737

SEQ ID NO: 196293 - RNA, 1701 nt, Artificial Sequence
  derived and/or modified sequence opt5 from hemagglutinin__InfluenzaA__ALE31738
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauaaguacccugcccugaaugucacaaugcccaacaacgagcaguuugacaaacuuuauauuuggggcgugcaccauccugggaccgauaaagaccagaucuuccuguacgcgcaguccagcggaagaauuacgguuuccacaaagggcucucaacaggccgugaucccgaauaucgggagccggccccgcauuagagauaucccuucccggauuagcaucuacuggaccauugucaaacccggagacauccuccugaucaacucuacaggcaaucugauugcuccucgcggguauuuuaagaucagauccggaaaaagcucuauuaugcggagcgacgcccccaucggcaaguguaaguccgaaugcauuaccccgaacggcucuaucccuaaugauaaacccuuccagaacgugaaucgcaucaccuacggggcuuguccuagauaugugaagcacagcacacucaaacuggccacgggaaugcggaacguccccgagaagcagacccgcggcauuuuuggggcgaucgccggauucauugaaaauggcugggaggggaugguugacggaugguacggcuuuagacaccaaaacuccgagggccgggggcaggcugccgaucuuaaaagcacacaggcugccaucgaccaaauuaauggaaagcugaacagacucaucggcaaaaccaaugaaaaguuccaucagauugagaaggaguucucugaaguggaagggcgcauccaggaucuggagaaauauguggaggacacaaagaucgaucuuugguccuacaacgccgaacugcucgucgcucuggagaaucagcacaccauugaccugacggauagcgaaaugaacaaacucuuugagaagacaaagaagcaacugcgggaaaacgcggaggacaugggaaauggcugcuucaagaucuaucauaaaugugauaacgccugcauugggucuaucagaaauggcaccuacgaccacaacguguaccgcgacgaggcucuuaauaaccgguuucagauuaagggaguugaacugaaauccggcuauaaggauuggauccucuggaucagcuucgccauuuccugcuuucugcuuuguguggcccugcucggguucaucaugugggcuugccagaaaggaaauauuagauguaacaucugcauuuga

SEQ ID NO: 196294 - RNA, 1701 nt, Artificial Sequence; identical to SEQ ID NO: 195465
  derived and/or modified sequence opt5 from hemagglutinin__InfluenzaA__ALE31739

SEQ ID NO: 196295 - RNA, 1701 nt, Artificial Sequence
  derived and/or modified sequence opt5 from hemagglutinin__InfluenzaA__ALE31741
augaagaccaucauugcccugagcuacauccucugccugguguucgcucagaaacuucccgagaacgacaauuccacagccacgcugugucucggccaccaugcggucccuaacgggaccauuguuaagacaaucaccucugauagaauugaagugacaaaugcuaccgagcuggugcaaaacagcuccaucucugaaaucugcgacagcccgcaccagauucuugauggcaaaaauuguacacugaucgacgcccuccugggagauccccagugcgacggguuucagaacaagaaaugggaucuguucgucgagcgguccaaggccuauucuaauuguuacccuuaugacgugcccgauuacgcuagccuccgcucccugguugccagcucuggaacccuugaauuuaacgacgaguccuucaauugggcuggcgugacgcaaaacgggaccagcucugccugcauuagaggauccaauagcuccuuuuucucucggcugaacuggcucacacauagcaauuuuaaguauccugcgcugaacgucaccaugcccaauaacgagcaguucgauaaacuuuacaucuggggcgugcaccauccuggcacagacaaggaucagauuuuucuguaugcccaguccucugggcgcaucaccguuagcacgaaaagaucccaacaggcugugauuccgaacaucggaagccggccccgcaucagaaauauuccuucucggaucuccauuuacuggacaaucgucaagcccggcgacauucuccugaucaacagcaccgggaaucugaucgccccucgcggauacuucaaaauuagaucuggcaagagcuccaucaugcggucugacgcucccauugggaaguguaaaagcgaaugcaucacaccgaacggauccauuccuaaugauaagcccuuucagaacgugaaucgcaucaccuauggcgccuguccuagauacgugaaacagagcacccucaagcuggcgacaggcaugcggaacguccccgagaaacaaacgcgcgggaucuucggagccauugcuggcuuuaucgaaaaugggugggagggaaugaaggacggcugguauggguucagacaccagaacucugagggacggggccaggccgcugaucuuaaauccacccaagccgccauugaccagaucaauggcaagcugaacagacucauugggaagacaaaugaaaaauuccaccagaucgagaaggaauuuagcgagguugaaggacgcauucaggaucuggagaaauacguggaggacaccaagaucgaucuuuggucuuauaacgcugaacugcucguggcgcuggagaaucaacauacaaucgaccugaccgauuccgaaaugaacaaacucuucgagaagacgaagaaacagcugcgggaaaacgccgaggacaugggcaaugggugcuuuaagauuuaccacaaaugugauaacgcuugcaucggaagcauuagaaauggcacauaugaccaugacgucuaccgcgaugaggcccuuaacaaucgguuccagaucaaggggguggaacugaaauccggcuacaaggacuggauucucuggaucucuuuugccaucagcugcuuccugcuuuguguugcucugcucggauuuauuaugugggccugccagaagggcaacaucagauguaauauuugcaucuga

SEQ ID NO: 196296 - RNA, 1701 nt, Artificial Sequence
  derived and/or modified sequence opt5 from hemagglutinin__InfluenzaA__ALE31742
augaagaccaucauugcccugagcuacauccucugccugggcuucgcucagaaaauucccgggaacgacaauuccacagccacgcuuugucugggacaccaugcggugccuaacggcaccaucgucaagacaauuaccaaugauagaaucgagguuacaaacgcuaccgaacucgugcaaaauucuagcaucggggagauuugcgacuccccgcaccagauccuggauggagaaaacuguacacuuauugacgcccugcucggcgauccccagugcgacggguuucagaauaaaaagugggaucuguucguggagcggucuaaagccuauagcaacuguuacccuuaugacguccccgauuacgcuucccugcgcucucucguggccagcuccggaacccuggaauuuaauaacgagagcuucaauuggacgggcguuacccaaaacggcacaucuuccgcuugcaucagacggucuagcuccagcuuuuucucucgccuuaauuggcugacccaucucaacuauacauacccugcccugaaugugaccaugcccaacaacgagcaguuugacaaacuuuauauuuggggaguccaccauccugggacggauaaggaccagaucuuccuguacgcgcaguccagcggcagaauuacaguguccaccaagcggucucaacaggccguuaucccgaauaucgggagccgcccccggauuagagauaucccuucccgcauuagcaucuacuggacaauugugaagcccggagacauccuccugaucaacucuaccggcaaucugauugcuccuagaggguauuuuaaaauccgguccggaaagagcucuauuaugcgcagcgacgcccccaucggcaaauguaaguccgaaugcauuaccccgaacggcucuaucccuaaugauaagcccuuccagaacgucaauagagugacauacggggcuuguccucgguaugugaaacacagcacgcucaagcuggccaccggaaugcgcaacguccccgagaaacagacaagaggcaucuuuggggcgauugccggauucaucgaaaauggcugggaggggaugguugacggaugguacggcuuucggcaccaaaacuccgagggcagagggcaggcugccgaucuuaagagcacccaggcugccauugaccaaaucaauggaaaacugaaccgccucauuggcaagacaaaugaaaaauuccaucagaucgagaaggaguucucugaaguggaagggcggauucaggaucuggagaaguauguggaggacaccaaaaucgaucuuugguccuacaacgccgaacugcucgucgcucuggagaaucagcacacgaucgaccugacagauagcgaaaugaacaagcucuuugagaaaaccaagaaacaacugagagaaaacgcggaggacaugggaaauggcugcuucaagauuuaucauaagugugauaacgccugcaucgggucuauucgcaauggcaccuacgaccacaacguguaccgggacgaggcucuuaauaacagauuucagaucaaaggaguugaacugaaguccggcuauaaagauuggauucucuggaucagcuucgccaucuccugcuuucugcuuuguguggcccugcucggguucauuaugugggcuugccagaagggaaauauccgcuguaacauuugcaucuga

SEQ ID NO: 196297 - RNA, 1701 nt, Artificial Sequence; identical to SEQ ID NO: 196022
  derived and/or modified sequence opt5 from hemagglutinin__InfluenzaA__ALE31743

SEQ ID NO: 196298 - RNA, 1701 nt, Artificial Sequence; identical to SEQ ID NO: 195465
  derived and/or modified sequence opt5 from hemagglutinin__InfluenzaA__ALE31744

SEQ ID NO: 196299 - RNA, 1701 nt, Artificial Sequence
  derived and/or modified sequence opt5 from hemagglutinin__InfluenzaA__ALE31745
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugaugggaaaaacuguacacugaucgacgcccuccugggagauccccagugcgacggcuuucagaauaagcggugggaucuguucgucgaacgcucuaaagccuauagcaacuguuacccuuaugacgugcccgauuacgcuucccucagaucucugguugccagcuccgggacccuugaguuuaaugacgaauccuucaacugggcuggagugacgcaaaauggcaccucuuccgccugcauucggggcagcaacucuuccuuuuucagccgccugaauuggcucacacauucuaacuuuaaguauccugcgcugaaugucaccaugcccaacaacgagcaguucgauaaacuuuacaucuggggagugcaccauccugggacagacaaggaucagauuuuucuguaugcccaguccagcggcagaaucaccguuuccacgaagcggucucaacaggcugugauuccgaauaucgggagccgccucagaauccggaacauucccucccgcaucagcauuuacuggacaaucgucaaaccuggagacauucugcugaucaauucuaccggcaaccucaucgcccccagaggguacuucaagauucaguccggaaaaagcucuaucaugcggagcgacgcuccuauuggcaaguguaaguccgagugcaucacacccaauggcucuauuccgaacgauaaaccuuuucagaaugugaacaagaucaccuauggggccuguccccgcuacgugaaacaaagcacccugaaacuugcgacaggaaugagaaaugucccugaaaagcagacgcggggcaucuucggggccauugcuggauuuaucgagaacggcugggaagggaugaaggacggaugguauggcuuccgccaccagaauagcgagggcagagggcaagccgcugaucugaaaagcacccaggccgccauugaccagaucaacggaaagcucaaucggcugauuggcaagacaaacgagaaauuccaccagaucgaaaaggaguuuucugaaguugaggggcgcauucaagaucuugaaaaauacguggaggacaccaagaucgaucugugguccuauaaugcugagcuccugguggcgcuggaaaaccagcauacaaucgaccucaccgauagcgagaugaacaaacuguucgaaaagacgaagaaacagcuuagagagaaugccgaagacaugggaaacggcugcuuuaagauuuaccacaaaugugauaaugcuugcaucgggucuauucggaacggcacauaugaccaugacgucuacagagaugaggcccugaauaaccgcuuccagaucaagggaguggagcucaaauccggcuacaaggacuggauucuguggaucagcuuugccaucuccugcuuccuucuguguguugcucuccugggguuuauuaugugggccugccaaaagggaaauauccgguguaacauuugcaucuga

SEQ ID NO: 196300 - RNA, 1701 nt, Artificial Sequence
  derived and/or modified sequence opt5 from hemagglutinin__InfluenzaA__ALE31747
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugaugggaaaaacuguacacugaucgacgcccuccugggagauccccagugcgacggcuuucagaauaagcggugggaucuguucgucgaacgcucuaaagccuauagcaacuguuacccuuaugacgugcccgauuacgcuucccucagaucucugguugccagcuccgggacccuugaguuuaaugacgaauccuucaacugggcuggagugacgcaaaauggcaccucuuccgccugcauucggggcagcaacucuuccuuuuucagccgccugaauuggcucacacauucuaacuuuaaguauccugcgcugaaugucaccaugcccaacaacgagcaguucgauaaacuuuacaucuggggagugcaccauccugggacagacaaagaucagauuuuucuguaugcccaguccagcggcagaaucaccguuuccacgaagcggucucaacaggcugugauuccgaauaucgggagccgccccagaauccggaacauuccuucccgcaucagcauuuacuggacaaucgucaaacccggagacauucuccugaucaauucuaccggcaaccugaucgccccuagaggguacuucaagauucaguccggaaaaagcucuaucaugcggagcgacgcucccauuggcaaguguaaguccgagugcaucacaccgaauggcucuauuccuaacgauaaacccuuucagaaugugaaccgcaucaccuauggggccuguccuagauacgugaagcaaagcacccucaaacuggcgacaggaaugcggaauguccccgaaaagcagacgcgcggcaucuucggggccauugcuggauuuaucgagaacggcugggaagggaugaaagacggaugguauggcuucagacaccagaauagcgagggccgggggcaagccgcugaucuuaagagcacccaggccgccauugaccagaucaacggaaaacugaauagacucauuggcaagacaaacgagaaguuccaccagaucgaaaaagaguuuucugaaguugaggggcgcgugcaagaucuggaaaaguacguggaggacaccaaaauugaucuuugguccuauaaugcugagcugcucgucgcgcuggaaaaccagcauacaaucgaccugaccgauagcgagaugaacaaacucuucgaaaagacgaagaagcagcugcgggagaaugccgaagacaugggaaacggcugcuuuaagaucuaccacaagugugauaaugcuugcauugggucuaucagaaacggcacauaugaccaugacguguaccgcgaugaggcccuuaauaaccgguuccagauuaaaggaguugagcugaaguccggcuacaaagacuggauccucuggauuagcuuugccaucuccugcuuccugcuuuguguggcucugcucggguuuaucaugugggccugccaaaagggaaauauuagauguaacaucugcauuuga

SEQ ID NO: 196301 - RNA, 1701 nt, Artificial Sequence; identical to SEQ ID NO: 196022
  derived and/or modified sequence opt5 from hemagglutinin__InfluenzaA__ALE31748

SEQ ID NO: 196302 - RNA, 1701 nt, Artificial Sequence; identical to SEQ ID NO: 195465
  derived and/or modified sequence opt5 from hemagglutinin__InfluenzaA__ALE31749

SEQ ID NO: 196303 - RNA, 1701 nt, Artificial Sequence; identical to SEQ ID NO: 196009
  derived and/or modified sequence opt5 from hemagglutinin__InfluenzaA__ALE31750

SEQ ID NO: 196304 - RNA, 1701 nt, Artificial Sequence
  derived and/or modified sequence opt5 from hemagglutinin__InfluenzaA__ALE31751
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucgacuauacauacccugcccugaacgucaccaugcccaauaacgagcaguuugauaaacuuuauauuuggggcgugcaccauccugggacggacaaggaucagaucuuccuguacgcgcaguccagcggaagaauuacaguuuccaccaagcggucucaacaggccgugaucccgaacaucggcagccgcccccggauuagagacaucccuucccgcauuagcaucuacuggacaauugucaagcccggggacauccuccugaucaauucuaccggaaaccugauugcuccuagaggcuauuuuaaaauccgguccgggaagucuucuauuaugcgcagcgaugcccccaucggaaaauguaaguccgaaugcauuaccccgaauggcucuaucccuaacgacaagcccuuccagaaugugaacagaaucacauacggcgcuuguccucgguaugugaaacacagcacgcucaagcuggccaccgggaugcgcaauguccccgagaaacagacaagaggaauuuuuggcgcgaucgccggguucauugaaaacggaugggagggcaugguugaugggugguacggauuucggcaccaaaauuccgagggcagaggccaggcugccgaccuuaagagcacccaggcugccaucgaucaaauuaacgggaaacugaaucgccucaucggaaagacaaacgaaaaauuccaucagauugagaaggaguucucugaaguggaaggccggauccaggaccuggagaaguauguggaggauaccaaaaucgaccuuugguccuacaaugccgaacugcucgucgcucuggagaaccagcacacgauugaucugacagacagcgaaaugaauaagcucuuugagaaaaccaagaaacaacugagagaaaacgcggaggauauggggaacggaugcuucaagaucuaucauaagugugacaaugccugcauuggcucuauccgcaacgggaccuacgaccacaauguguaccgggaugaggcucuuaacaauagauuucagauuaaaggcguugaacugaaguccggauauaaagacuggauccucuggaucagcuucgccauuuccugcuuucugcuuuguguggcccugcucggcuucaucaugugggcuugccagaaggggaacauucgcuguaauaucugcauuuga

SEQ ID NO: 196305 - RNA, 1701 nt, Artificial Sequence; identical to SEQ ID NO: 195465
  derived and/or modified sequence opt5 from hemagglutinin__InfluenzaA__ALE31752

SEQ ID NO: 196306 - RNA, 1701 nt, Artificial Sequence; identical to SEQ ID NO: 196009
  derived and/or modified sequence opt5 from hemagglutinin__InfluenzaA__ALE31753

SEQ ID NO: 196307 - RNA, 1701 nt, Artificial Sequence; identical to SEQ ID NO: 195465
  derived and/or modified sequence opt5 from hemagglutinin__InfluenzaA__ALE31754

SEQ ID NO: 196308 - RNA, 1701 nt, Artificial Sequence
  derived and/or modified sequence opt5 from hemagglutinin__InfluenzaA__ALE31755
augaagaccaucauugcccugagcuacauccucugccugguguucgcucagaaacuucccgagaacgacaauuccacagccacgcugugucucggccaccaugcggucccuaacgggaccauuguuaagacaaucaccucugaucaaauugaagugacaaaugcuaccgagcuggugcagaacagcuccaucggagaaaucugcgacucuccgcaccagauucuugauggcaaaaauuguacacugaucgacgcccuccugggggauccccagugcgacggauuucaaaacaagaaaugggaucuguucgucgagagaagcaaggccuauuccaauuguuacccuuaugacgugcccgauuacgcuucucuccggagccugguugccuccagcggcacccuugaauuuaacgacgagucuuucaauugggcuggggugacgcagaacggaaccuccagcgccugcauucgcggcucuaauuccagcuuuuucucuagacugaacuggcucacacauuccaauuuuaaguauccugcgcugaacgucaccaugcccaauaacgagcaguucgauaaacuuuacaucuggggcgugcaccauccugggacagacaaggaucagauuuuucuguaugcccaaagcuccggacggaucaccguuucuacgaaacgcagccagcaggcugugauuccgaacaucggcuccagaccccggauccgcaauauuccuagcagaaucucuauuuacuggacaaucgucaagcccggggacauucuccugaucaacuccaccggaaaucugaucgccccucggggcuacuucaaaauucgcagcgggaagucuagcaucaugagauccgacgcucccauuggaaaguguaaaucugaaugcaucacaccgaacggcagcauuccuaaugauaagcccuuucagaacgugaaucggaucaccuauggcgccuguccucgcuacgugaaacaauccacccucaagcuggcgacagggaugagaaacguccccgagaaacagacgcggggaaucuucggcgccauugcuggguuuaucgaaaauggaugggagggcaugaaggacgggugguauggauuccgccaccagaacagcgagggcagaggccaagccgcugaucuuaaaucuacccaggccgccauugaccagaucaaugggaagcugaaccggcucauuggaaagacaaaugaaaaauuccaccagaucgagaaggaauuuuccgagguugaaggccgcauucaagaucuggagaaauacguggaggacaccaagaucgaucuuuggagcuauaacgcugaacugcucguggcgcuggagaaucagcauacaaucgaccugaccgauucugaaaugaacaaacucuucgagaagacgaagaaacagcugagagaaaacgccgaggacauggggaauggaugcuuuaagauuuaccacaaaugugauaacgcuugcaucggcuccauucggaaugggacauaugaccauaacgucuacagagacgaggcccuuaauaaccgcuuccagaucaagggcguggaacugaaaagcggauacaaggauuggauucucuggaucuccuuugccaucucuugcuuccugcuuuguguugcucugcucggcuuuauuaugugggccugccaaaaggggaauauccgguguaacauuugcaucuga

SEQ ID NO: 196309 - RNA, 1701 nt, Artificial Sequence; identical to SEQ ID NO: 196009
  derived and/or modified sequence opt5 from hemagglutinin__InfluenzaA__ALE31756

SEQ ID NO: 196310 - RNA, 1701 nt, Artificial Sequence; identical to SEQ ID NO: 195465
  derived and/or modified sequence opt5 from hemagglutinin__InfluenzaA__ALE31757

SEQ ID NO: 196311 - RNA, 1701 nt, Artificial Sequence
  derived and/or modified sequence opt5 from hemagglutinin__InfluenzaA__ALE31758
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugguggcuccuagaggcuauuuuaaaauucgguccgggaagucuucuaucaugcgcagcgacgcccccauuggaaaauguaaguccgaaugcaucaccccgaacggcucuauuccuaaugauaagcccuuccagaacgugaauagaaucacauacggcgcuuguccucgguaugucaaacacagcacgcucaagcuggccaccgggaugcgcaacguucccgagaaacagacaagaggaaucuuuggcgcgauugccggguucaucgaaaauggaugggagggcaugguggacgggugguacggauuucggcaccaaaacuccgagggcagaggccaggcugccgaucuuaagagcacccaggcugccauugaccaaaucaaugggaaacugaaccgccucauuggaaagacaaaugaaaaauuccaucagaucgagaaggaguucucugaaguggaaggccggauucaggaucuggagaaguaugucgaggacaccaaaaucgaucuuugguccuacaacgccgaacugcucguggcucuggagaaucagcacacgaucgaccugacagauagcgaaaugaacaagcucuuugagaaaaccaagaaacaacugagagaaaacgcggaggacauggggaauggaugcuucaagauuuaucauaagugugauaacgccugcaucggcucuauucgcaaugggaccuacgaccacaacguuuaccgggacgaggcucuuaauaacagauuucagaucaaaggcguggaacugaaguccggauauaaagauuggauucucuggaucagcuucgccaucuccugcuuucugcuuugugucgcccugcucggcuucauuaugugggcuugccagaaggggaauauccgcuguaacauuugcaucuga

SEQ ID NO: 196312 - RNA, 1701 nt, Artificial Sequence
  derived and/or modified sequence opt5 from hemagglutinin__InfluenzaA__ALE31759
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugaugggaaaaacuguacacugaucgacgcccuccugggagauccccagugcgacggcuuucagaauaagcggugggaucuguucgucgaacgcucuaaagccuauagcaacuguuacccuuaugacgugcccgauuacgcuucccucagaucucugguugccagcuccgggacccuugaguuuaaugacgagagcuucaacugggcuggagugacgcaaaauggcaccucuuccgccugcauucggggcagcaacucuuccuuuuucagccgccugaauuggcucacacauucuaacuuuaaguauccugcgcugaaugucaccaugcccaacaacgaacaguucgauaaacuuuacaucuggggagugcaccauccugggacagacaaagaucagauuuuucuguaugcccaguccagcggcagaguuaccguguccacgaagcggucucaacaggcugucaucccgaauauugggagccgccccagaauccggaacaucccuucccgcauuagcaucuacuggacaauugugaaacccggagacauccuccugauuaauucuaccggcaaccugaucgccccuagaggguacuucaagauccaguccggaaaaagcucuauuaugcggagcgacgcucccaucggcaaguguaaguccgagugcauuacaccgaauggcucuaucccuaacaauaaacccuuucagaacgugaaucgcauuaccuauggggccuguccuagauacgucaagcaaagcacccucaaacuggcgacaggaaugcggaacguucccgaaaagcagacgcgcggcaucuucggggccaucgcuggauuuauugagaauggcugggaagggaugaaagauggaugguauggcuucagacaccagaacuccgagggccgggggcaagccgcugaccuuaagagcacccaggccgccaucgaucagauuaauggaaaacugaacagacucaucggcaagacaaaugagaaguuccaccagauugaaaaagaguuuucugaaguggaggggcgcauccaagaccuggaaaaguacguggaggauaccaaaauugaccuuugguccuauaacgcugagcugcucgucgcgcuggaaaaccagcauacaaucgaucugaccgacagcgagaugaauaaacucuucgaaaagacgaagaagcagcugcgggagaacgccgaagauaugggaaauggcugcuuuaagaucuaccacaagugugacaacgcuugcauugggucuaucagaaauggcacauaugaucaugacguguaccgcgacgaggcccuuaacaaucgguuccagauuaaaggaguugagcugaaguccggcuacaaagauuggauccucuggauuagcuuugccaucuccugcuuccugcuuuguguggcucugcucggguuuaucaugugggccugccaaaagggaaacauuagauguaauaucugcauuuga

SEQ ID NO: 196313 - RNA, 1701 nt, Artificial Sequence
  derived and/or modified sequence opt5 from hemagglutinin__InfluenzaA__ALE31760
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcuaccgcccccggauuagagauaucccuagccgcauuuccaucuauuggacaauugucaagcccggggacauccuccugaucaacagcaccggaaaucugauugcuccuagaggcuacuuuaaaauccggucugggaaguccagcauuaugcgcucugacgcccccaucggaaaauguaagagcgaaugcauuaccccgaacggcuccaucccuaaugauaagcccuuccagaacgugaauagaaucacauauggcgcuuguccucgguacgugaaacacucuacgcucaagcuggccaccgggaugcgcaacguccccgagaaacagacaagaggaauuuuuggcgcgaucgccggguucauugaaaauggaugggagggcaugguugacgggugguauggauuucggcaccaaaacagcgagggcagaggccaggcugccgaucuuaaguccacccaggcugccaucgaccaaauuaaugggaaacugaaccgccucaucggaaagacaaaugaaaaauuccaucagauugagaaggaguucagcgaaguggaaggccggauccaggaucuggagaaguacguggaggacgccaaaaucgaucuuuggucuuauaacgcugaacugcucgucgcgcuggagaaucagcacaccauugaccugacggauuccgaaaugaacaagcucuuugagaaaacaaagaaacaacugagagaaaacgccgaggacauggggaauggaugcuucaagaucuaccauaagugugauaacgcuugcauuggcagcauccgcaaugggaccuacgaccacaacguguaucgggacgaggcccuuaauaacagauuucagauuaaaggcguugaacugaagucuggauacaaagauuggauccucuggaucuccuucgccauuagcugcuuucugcuuuguguggcucugcucggcuucaucaugugggccugccagaaggggaauauucgcuguaacaucugcauuuga

SEQ ID NO: 196314 - RNA, 1701 nt, Artificial Sequence; identical to SEQ ID NO: 196009
  derived and/or modified sequence opt5 from hemagglutinin__InfluenzaA__ALE31761

SEQ ID NO: 196315 - RNA, 1701 nt, Artificial Sequence; identical to SEQ ID NO: 195465
  derived and/or modified sequence opt5 from hemagglutinin__InfluenzaA__ALE31762

SEQ ID NO: 196316 - RNA, 1701 nt, Artificial Sequence; identical to SEQ ID NO: 196071
  derived and/or modified sequence opt5 from hemagglutinin__InfluenzaA__ALE31763

SEQ ID NO: 196317 - RNA, 1701 nt, Artificial Sequence; identical to SEQ ID NO: 196123
  derived and/or modified sequence opt5 from hemagglutinin__InfluenzaA__ALE31764

SEQ ID NO: 196318 - RNA, 1701 nt, Artificial Sequence; identical to SEQ ID NO: 195465
  derived and/or modified sequence opt5 from hemagglutinin__InfluenzaA__ALE31765

SEQ ID NO: 196319 - RNA, 1701 nt, Artificial Sequence
  derived and/or modified sequence opt5 from hemagglutinin__InfluenzaA__ALE31774
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagguuuuccuguacgcgcaguccagcggaagaaucacaguguccaccaagcggucucaacaggccgucauuccgaauaucggcagccgccccagaauccgggauauuccuucccgcaucagcauuuacuggacaaucgugaagcccggggacauucuccugaucaacucuaccggaaaucugaucgcuccuagaggcuauuuuaaaauucgguccgggaagucuucuaucaugcgcagcgacgcccccauuggaaaauguaaguccgaaugcaucaccccgaacggcucuauuccuaaugauaagcccuuccagaacgugaauagaaucacauacggcgcuuguccucgguaugucaaacacagcacgcucaagcuggccaccgggaugcgcaacguucccgagaaacagacaagaggaaucuuuggcgcgauugccggguucaucgaaaauggaugggagggcaugguggacgggugguacggauuucggcaccaaaacuccgagggcagaggccaggcugccgaucuuaagagcacccaggcugccauugaccaaaucaaugggaaacugaaccgccucauuggaaagacaaaugaaaaauuccaucagaucgagaaggaguucucugaaguggaaggccggauucaggaucuggagaaguaugucgaggacaccaaaaucgaucuuugguccuacaacgccgaacugcucguggcucuggagaaucagcacacgaucgaccugacagauagcgaaaugaacaagcucuuugagaaaaccaagaaacaacugagagaaaacgcggaggacauggggaauggaugcuucaagauuuaucauaagugugauaacgccugcaucggcucuauucgcaaugggaccuacgaccacaacguuuaccgggacgaggcucuuaauaacagauuucagaucaaaggcguggaacugaaguccggauauaaagauuggauucucuggaucagcuucgccaucuccugcuuucugcuuugugucgcccugcucggcuucauuaugugggcuugccagaaggggaauauccgcuguaacauuugcaucuga

SEQ ID NO: 196320 - RNA, 1701 nt, Artificial Sequence
  derived and/or modified sequence opt5 from hemagglutinin__InfluenzaA__ALE31775
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaaagucuagcuccagcuuuuucucucggcuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcgcuccagcggaagaauuacaguuuccaccaagcggucucagcaagccgugaucccgaauaucggcagccgcccccggauuagagauaucccuucccgcauuagcaucuacuggacaauugucaaacccggggacauccuccugaucaacucuaccggaaaucugauugcuccuagaggcuauuuuaagauccgguccgggaaaagcucuauuaugcgcagcgacgcccccaucggaaaguguaaguccgaaugcauuaccccgaacggcucuaucccuaaugauaaacccuuccagaacgugaauagaaucacauacggcgcuuguccucgguaugugaagcacagcacgcucaaacuggccaccgggaugcgcaacguccccgagaagcagacaagaggaauuuuuggcgcgaucgccggguucauugaaaauggaugggagggcaugguugacgggugguacggauuucggcaccagaacuccgagggcagaggccaagcugccgaucuuaaaagcacccaggcugccaucgaccagauuaaugggaagcugaaccgccucaucggaaaaacaaaugaaaaguuccaucaaauugagaaggaguucucugaaguggaaggccggauccaggaucuggagaaauauguggaggacaccaagaucgaucuuugguccuacaacgccgaauuucuggucgcucucgagaaucagcacacgauugaccugacagauagcgaaaugaacaaacuguucgagaagaccaaaaagcagcucagagaaaacgcggaggacauggggaauggaugcuuuaagaucuaucauaaaugugauaacgccugcauuggcucuauccgcaaugggaccuacgaccacaacguguaccgggacgaggcucugaauaacagauuccaaauuaagggcguugaacuuaaauccggauauaaggauuggauccuguggaucagcuuugccauuuccugcuuccuccuguguguggcccuucugggcuuuaucaugugggcuugccagaaagggaauauucgcuguaacaucugcauuuga

SEQ ID NO: 196321 - RNA, 1701 nt, Artificial Sequence
  derived and/or modified sequence opt5 from hemagglutinin__InfluenzaA__ALE31776
augaagaccaucauugcccugagcuacauccucugccugguguucgcucagaaacuucccgagaacgacaauuccacagccacgcugugucucggccaccaugcggucccuaacgggaccauuguuaagacaaucaccucugauagaauugaagugacaaaugcuaccgagcuggugcaaaacagcuccaucggagaaaucugcgacucuccgcaccagauucuugauggcaaaaauuguacacugaucgacgcccuccugggggauccccagugcgacggauuucagaacaagaaaugggaucuguucgucgagcggagcaaggccuauuccaauuguuacccuuaugacgugcccgauuacgcuucucuccgcagccugguugccuccagcggcacccuugaauuuaacgacgagucuuucaauugggcuggggugacgcaaaacggaaccuccagcgccugcauuagaggcucuaauuccagcuuuuucucucggcugaacuggcucacacauuccaauuuuaaguauccugcgcugaacgucaccaugcccaauaacgagcaguucgauaaacuuuacaucuggggcgugcaccauccugggacagacaaggaucagauuuuucuguaugcccagagcuccggacgcaucaccguuucuacgaaaagaagccaacaggcugugauuccgaacaucggcucccggccccgcaucagaaauauuccuagccggaucucuauuuacuggacaaucgucaagcccggggacauucuccugaucaacuccaccggaaaucugaucgccccucgcggcuacuucaaaauuagaagcgggaagucuagcaucaugcgguccgacgcuucuauuggaaaguguaaaagcgaaugcaucacacccaacggcuccauuccgaaugauaagccuuuucagaacgugaaucgcaucaccuauggcgccugucccagauacgugaaacagagcacccucaagcuggcgacagggaugcggaacgucccugagaaacaaacgcgcggaaucuucggcgccauugcuggguuuaucgaaaauggaugggagggcaugaaggacgggugguauggauucagacaccagaacucugagggccggggccaggccgcugaucuuaaauccacccaagccgccauugaccagaucaaugggaagcugaacagacucauuggaaagacaaaugaaaaauuccaccagaucgagaaggaauuuagcgagguugaaggccgcauucaggaucuggagaaauacguggaggacaccaagaucgaucuuuggucuuauaacgcugaacugcucguggcgcuggagaaucaacauacaaucgaccugaccgauuccgaaaugaacaaacucuucgagaagacgaagaaacagcugcgggaaaacgccgaggacauggggaauggaugcuuuaagauuuaccacaaaugugauaacgcuugcaucggcagcauuagaaaugggacauaugaccaugacgucuaccgcgaugaggcccuuaacaaucgguuccagaucaagggcguggaacugaaauccggauacaaggacuggauucucuggaucucuuuugccaucagcugcuuccugcuuuguguugcucugcucggcuuuauuaugugggccugccagaaggggaacaucagauguaauauuugcaucuga

SEQ ID NO: 196322 - RNA, 1701 nt, Artificial Sequence
  derived and/or modified sequence opt5 from hemagglutinin__InfluenzaA__ALE31777
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccguggucccgaauaucggcagccgccccagaauccgggauauuccuucccgcaucagcauuuacuggacaaucgugaagcccggggacauucuccugaucaacucuaccggaaaucugaucgcuccuagaggcuauuuuaaaauucgguccgggaagucuucuaucaugcgcagcgacgcccccauuggaaaauguaaguccgaaugcaucaccccgaacggcucuauuccuaaugauaagcccuuccagaacgugaauagaaucacauacggcgcuuguccucgguaugucaaacacagcacgcucaagcuggccaccgggaugcgcaacguucccgagaaacagacaagaggaaucuuuggcgcgauugccggguucaucgaaaauggaugggagggcaugguggacgggugguacggauuucggcaccaaaacuccgagggcagaggccaggcugccgaucuuaagagcacccaggcugccauugaccaaaucaaugggaaacugaaccgccucauuggaaagacaaaugaaaaauuccaucagaucgagaaggaguucucugaaguggaaggccggauucaggaucuggagaaguaugucgaggacaccaaaaucgaucuuugguccuacaacgccgaacugcucguggcucuggagaaucagcacacgaucgaccugacagauagcgaaaugaacaagcucuuugagaaaaccaagaaacaacugagagaaaacgcggaggacauggggaauggaugcuucaagauuuaucauaagugugauaacgccugcaucggcucuauucgcaaugggaccuacgaccacaacguuuaccgggacgaggcucuuaauaacagauuucagaucaaaggcguggaacugaaguccggauauaaagauuggauucucuggaucagcuucgccaucuccugcuuucugcuuugugucgcccugcucggcuucauuaugugggcuugccagaaggggaauauccgcuguaacauuugcaucuga

SEQ ID NO: 196323 - RNA, 1701 nt, Artificial Sequence; identical to SEQ ID NO: 196071
  derived and/or modified sequence opt5 from hemagglutinin__InfluenzaA__ALE31778

SEQ ID NO: 196324 - RNA, 1701 nt, Artificial Sequence; identical to SEQ ID NO: 195465
  derived and/or modified sequence opt5 from hemagglutinin__InfluenzaA__ALE31779

SEQ ID NO: 196325 - RNA, 1701 nt, Artificial Sequence
  derived and/or modified sequence opt5 from hemagglutinin__InfluenzaA__ALE31780
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagcccauagcaacuguuauccuuacgacgugcccgauuaugcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaccucaacuacacauauccugcccugaaugucaccaugcccaacaacgagcaguuugacaaacuuuacauuuggggcgugcaucacccugggacggauaaggaccagaucuuccuguaugcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuacuuuaaaauccgguccgggaagucuucuauuaugcgcaccgacgcccccaucggaaaauguaagagcgaaugcauuacaccgaacggcuccaucccuaaugauaagcccuuccagaacgugaauagaaucacguauggcgcuuguccucgguacgugaaacacucuacccucaagcuggccacagggaugcgcaacguccccgagaaacagaccagaggaauuuuuggcgcgaucgccggguucauugaaaauggaugggagggcaugguugacgggugguauggauuucggcaucaaaacagcgagggcagaggccaggcugccgaucuuaaguccacacaggcugccaucgaccaaauuaaugggaaacugaaccgccucaucggaaagaccaaugaaaaauuccaccagauugagaaggaguucagcgaaguggaaggccggauccaggaucuggagaaguacguggaggacacgaaaaucgaucuuuggucuuauaacgccgaacugcucgucgcucuggagaaucagcauacaauugaccugaccgauuccgaaaugaacaagcucuuugagaaaaccaagaaacaacugagagaaaacgcggaggacauggggaauggaugcuucaagaucuaccacaagugugauaacgccugcauuggcagcauccgcaaugggacauaugaccacaacguguaccgggacgaggcucuuaauaacagauuucagauuaaaggcguugaacugaagucuggauacaaagauuggauccucuggaucuccuucgccauuagcugcuuucugcuuuguguggcccugcucggcuucaucaugugggcuugccagaaggggaauauucgcuguaacaucugcauuuga

SEQ ID NO: 196326 - RNA, 1701 nt, Artificial Sequence
  derived and/or modified sequence opt5 from hemagglutinin__InfluenzaA__ALE31781
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcggguccccgcaccagauccuggacggagaaaacuguacacuuauugaugcccugcucggcgacccccagugcgauggguuucagaauaaaaagugggaccuguucgucgagcggucuaaagccuauagcaacuguuacccuuaugaugugcccgacuacgcuucccugcgcucucucguugccagcuccggaacccuggaauuuaauaacgagagcuucaauuggacgggcgugacccaaaacggcacaucuuccgcuugcaucagaaagucuagcuccagcuuuuucucuaagcugaauuggcuuacccaucucaacuauacauacccugcccugaaugucaccaugcccaacaacgagcaguuugauaaacuuuauauuuggggagugcaccauccugggacggacaaggaucagaucuuccuguacgcgcgguccagcggccgcauuacaguuuccaccaaaagaucucagcaagccgugaucccgaauaucgggagccggccccgcauuagagacaucccuucccggauuagcaucuacuggacaauugucaagcccggagauauccuccugaucaacucuaccggcaaucugauugcuccucgcggguauuuuaaaaucagauccggaaagagcucuauuaugcggagcgacgcccccaucggcaaguguaaauccgaaugcauuaccccgaacggcucuaucccuaaugacaagcccuuccagaacgugaaucgcaucacauacggggcuuguccuagauaugugaaacacagcacgcucaagcuggccaccggaaugcggaacguccccgagaaacagacacgcggcauuuuuggggcgaucgccggauucauugaaaauggcugggaggggaugguugauggaugguacggcuuuagacaccagaacuccgagggccgggggcaagcugccgaccuuaagagcacccaggcugccaucgaucagauuaauggaaaacugaacagacucaucggcaagacaaaugaaaaguuccaucaaauugagaaagaguucucugaaguggaagggcgcauccaggaccuggagaaguauguggaggauaccaaaaucgaccuuugguccuacaacgccgaacugcucgucgcucuggagaaucagcacacgauugaucugacagacagcgaaaugaacaagcucuuugagaaaaccaagaagcagcugcgggaaaacgcggaggauaugggaaauggcugcuucaaaaucuaucauaagugugacaacgccugcauugggucuaucagaaauggcaccuacgaucacaacguguaccgcgacgaggcucuuaauaaccgguuucaaauuaaaggaguugaacugaaguccggcuauaaagacuggauccucuggaucagcuucgccauuuccugcuuucugcuuuguguggcccugcucggguucaucaugugggcuugccagaagggaaauauuagauguaacaucugcauuuga

SEQ ID NO: 196327 - RNA, 1701 nt, Artificial Sequence
  derived and/or modified sequence opt5 from hemagglutinin__InfluenzaA__ALE31782
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacguuucccugcgcucucucguggcuagcuccgggacccuggaauuuaauaacgagagcuucaauuggacgggagucacccaaaacggcacaucuuccgccugcaucagacggagcagcuccagcuuuuucucucgccuuaauuggcugacccaucucaacuauacauacccugcucugaaugugaccaugcccaacaacgagcaguuugacaaacuuuauauuuggggcguucaccauccugggacggauaaggaccagaucuuccuguacgcccaguccagcggaagaauuacaguguccaccaagcggucucaacaggcggucaucccgaauaucggcagccgcccccggauuagagauaucccuucccgcauuagcaucuacuggacaauugugaagcccggggacauccuccugaucaacucuaccggaaaucugauugccccuagaggcuauuuuaaaauccgguccgggaagucuucuauuaugcgcagcgacgcucccaucggaaaauguaaguccgaaugcauuaccccgaacggcucuaucccuaaugauaagcccuuccagaacgugaauagaaucacauacggcgccuguccucgguaugucaaacagagcacgcucaagcuggcuaccgggaugcgcaacguucccgagaaacaaacaagaggaauuuuuggcgccaucgcgggguucauugaaaauggaugggagggcaugguggacgggugguacggauuucggcaccagaacuccgagggcagaggccaggccgcugaucuuaagagcacccaagccgcuaucgaccagauuaaugggaaacugaaccgccucaucggaaagacaaaugaaaaauuccaccagauugagaaggaguucucugaaguggaaggccggauccaggaucuggagaaguaugucgaggacaccaaaaucgaucuuugguccuacaacgccgaacugcucguggcccuggagaaucaacauacgauugaccugacagauagcgaaaugaacaagcucuuugagaaaaccaagaaacagcugagagaaaacgcugaggacauggggaauggaugcuucaagaucuaucacaagugugauaacgcgugcauuggcucuauccgcaaugggaccuacgaccauaacguuuaccgggacgaggcccuuaauaacagauuucagauuaaaggcguggaacugaaguccggauauaaagauuggauccucuggaucagcuucgcuauuuccugcuuucugcuuugugucgcccugcucggcuucaucaugugggccugccagaaggggaauauucgcuguaacaucugcauuuga

SEQ ID NO: 196328 - RNA, 1701 nt, Artificial Sequence
  derived and/or modified sequence opt5 from hemagglutinin__InfluenzaA__ALE31783
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccgugcccaacaacgagcaguuugacaaacuuuauauuuggggcguucaccauccugggacggauaaggaccagaucuuccuguacgcgcaguccagcggaagaauuacaguguccaccaagcggucucaacaggccgucaucccgaauaucggcagccgcccccggauuagagauaucccuucccgcauuagcaucuacuggacaauugugaagcccggggacauccuccugaucaacucuaccggaaaucugauugcuccuagaggcuauuuuaaaauccgguccgggaagucuucuauuaugcgcagcgacgcccccaucggaaaauguaaguccgaaugcauuaccccgaacggcucuaucccuaaugauaagcccuuccagaacgugaauagaaucacauacggcgcuuguccucgguaugucaaacacagcacgcucaagcuggccaccgggaugcgcaacguucccgagaaacagacaagaggaauuuuuggcgcgaucgccggguucauugaaaauggaugggagggcaugguggacgggugguacggauuucggcaccaaaacuccgagggcagaggccaggcugccgaucuuaagagcacccaggcugccaucgaccaaauuaaugggaaacugaaccgccucaucggaaagacaaaugaaaaauuccaucagauugagaaggaguucucugaaguggaaggccggauccaggaucuggagaaguaugucgaggacaccaaaaucgaucuuugguccuacaacgccgaacugcucguggcucuggagaaucagcacacgauugaccugacagauagcgaaaugaacaagcucuuugagaaaaccaagaaacaacugagagaaaacgcggaggacauggggaauggaugcuucaagaucuaucauaagugugauaacgccugcauuggcucuauccgcaaugggaccuacgaccacaacguuuaccgggacgaggcucuuaauaacagauuucagauuaaaggcguggaacugaaguccggauauaaagauuggauccucuggaucagcuucgccauuuccugcuuucugcuuugugucgcccugcucggcuucaucaugugggcuugccagaaggggaauauucgcuguaacaucugcauuuga

SEQ ID NO: 196329 - RNA, 1701 nt, Artificial Sequence; identical to SEQ ID NO: 196081
  derived and/or modified sequence opt5 from hemagglutinin__InfluenzaA__ALE31784

SEQ ID NO: 196330 - RNA, 1701 nt, Artificial Sequence; identical to SEQ ID NO: 195465
  derived and/or modified sequence opt5 from hemagglutinin__InfluenzaA__ALE31785

SEQ ID NO: 196331 - RNA, 1701 nt, Artificial Sequence; identical to SEQ ID NO: 196071
  derived and/or modified sequence opt5 from hemagglutinin__InfluenzaA__ALE31786

SEQ ID NO: 196332 - RNA, 1701 nt, Artificial Sequence; identical to SEQ ID NO: 196123
  derived and/or modified sequence opt5 from hemagglutinin__InfluenzaA__ALE31787

SEQ ID NO: 196333 - RNA, 1701 nt, Artificial Sequence; identical to SEQ ID NO: 195565
  derived and/or modified sequence opt5 from hemagglutinin__InfluenzaA__ALE31788

SEQ ID NO: 196334 - RNA, 1701 nt, Artificial Sequence; identical to SEQ ID NO: 195465
  derived and/or modified sequence opt5 from hemagglutinin__InfluenzaA__ALE31789

SEQ ID NO: 196335 - RNA, 1701 nt, Artificial Sequence; identical to SEQ ID NO: 196080
  derived and/or modified sequence opt5 from hemagglutinin__InfluenzaA__ALE31790

SEQ ID NO: 196336 - RNA, 1701 nt, Artificial Sequence; identical to SEQ ID NO: 196201
  derived and/or modified sequence opt5 from hemagglutinin__InfluenzaA__ALE31791

SEQ ID NO: 196337 - RNA, 1701 nt, Artificial Sequence; identical to SEQ ID NO: 196101
  derived and/or modified sequence opt5 from hemagglutinin__InfluenzaA__ALE31792

SEQ ID NO: 196338 - RNA, 1701 nt, Artificial Sequence
  derived and/or modified sequence opt5 from hemagglutinin__InfluenzaA__ALE31793
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauacauacccugcccugaaugucaccaugcccaacaacgagcaguuugacaagcuguauauuuggggcgugcaccauccugggacggauaaggaccagaucucccuguacgcgcagagcuccggaagaauuacaguuucuaccaaacggagccaacaggccgugaucccgaauaucggcucccgcccccggauuagagauaucccuagccgcauuucuaucuacuggacaauugucaagcccggggacauccuccugaucaacuccaccggaaaucugauugcuccuagaggcuauuucaaaauccggagcgggaagucuagcauuaugcgcuccgacgcccccaucggaaaauguaagucugaaugcauuaccccgaacggcagcaucccuaaugauaagcccuuucagaacgugaauagaaucacauacggcgcuuguccucgguaugugaaacacuccacgcucaagcuggccaccgggaugcgcaacguccccgagaaacagacaagaggaauuuucggcgcgaucgccggguuuauugaaaauggaugggagggcaugguugacgggugguacggauuccggcaccaaaacagcgagggcagaggccaggcugccgaucuuaagucuacccaggcugccaucgaccaaauuaaugggaaacugaaccgccucaucggaaagacaaaugaaaaauuucaucagauugagaaggaguucuccgaaguggaaggccggauccaggaucuggagaaguauguggaggacaccaaaaucgaucuuuggagcuacaacgccgaacugcucgucgcucuggagaaucagcacacgauugaccugacagauucugaaaugaacaaacucuucgagaagaccaagaaacaacugagagaaaacgcggaggacauggggaauggaugcuuuaagaucuaucauaagugugauaacgccugcauuggcuccauccgcaaugggaccuacgaccacaacguguaccgggacgaggcucuuaauaacagauuccagauuaaaggcguugaacuuaagagcggauauaaagauuggauccucuggaucuccuuugccauuucuugcuuccugcuuuguguggcccugcucggcuuuaucaugugggcuugccagaaggggaauauucgcuguaacaucugcauuuga

SEQ ID NO: 196339 - RNA, 1701 nt, Artificial Sequence; identical to SEQ ID NO: 195465
  derived and/or modified sequence opt5 from hemagglutinin__InfluenzaA__ALE31794

SEQ ID NO: 196340 - RNA, 1701 nt, Artificial Sequence; identical to SEQ ID NO: 195465
  derived and/or modified sequence opt5 from hemagglutinin__InfluenzaA__ALE31795

SEQ ID NO: 196341 - RNA, 1701 nt, Artificial Sequence; identical to SEQ ID NO: 195465
  derived and/or modified sequence opt5 from hemagglutinin__InfluenzaA__ALE31796

SEQ ID NO: 196342 - RNA, 1701 nt, Artificial Sequence; identical to SEQ ID NO: 196123
  derived and/or modified sequence opt5 from hemagglutinin__InfluenzaA__ALE31797

SEQ ID NO: 196343 - RNA, 1701 nt, Artificial Sequence; identical to SEQ ID NO: 196123
  derived and/or modified sequence opt5 from hemagglutinin__InfluenzaA__ALE31798

SEQ ID NO: 196344 - RNA, 1701 nt, Artificial Sequence; identical to SEQ ID NO: 195465
  derived and/or modified sequence opt5 from hemagglutinin__InfluenzaA__ALE31799

SEQ ID NO: 196345 - RNA, 1701 nt, Artificial Sequence; identical to SEQ ID NO: 196071
  derived and/or modified sequence opt5 from hemagglutinin__InfluenzaA__ALE31800

SEQ ID NO: 196346 - RNA, 1701 nt, Artificial Sequence; identical to SEQ ID NO: 195465
  derived and/or modified sequence opt5 from hemagglutinin__InfluenzaA__ALE31801

SEQ ID NO: 196347 - RNA, 1701 nt, Artificial Sequence; identical to SEQ ID NO: 195465
  derived and/or modified sequence opt5 from hemagglutinin__InfluenzaA__ALE31802

SEQ ID NO: 196348 - RNA, 1701 nt, Artificial Sequence; identical to SEQ ID NO: 196071
  derived and/or modified sequence opt5 from hemagglutinin__InfluenzaA__ALE31803

SEQ ID NO: 196349 - RNA, 1701 nt, Artificial Sequence; identical to SEQ ID NO: 196022
  derived and/or modified sequence opt5 from hemagglutinin__InfluenzaA__ALE31805

SEQ ID NO: 196350 - RNA, 1701 nt, Artificial Sequence
  derived and/or modified sequence opt5 from hemagglutinin__InfluenzaA__ALE31806
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacacccuccugaucaacucuaccggaaaucugaucgcuccuagaggcuauuuuaaaauucgguccgggaagucuucuaucaugcgcagcgacgcccccauuggaaaauguaaguccgaaugcaucacaccgaacggcucuauuccuaaugauaagcccuuccagaacgugaauagaaucacguacggcgcuuguccucgguaugugaaacacagcacccucaagcuggccacagggaugcgcaacguccccgagaaacagaccagaggaaucuuuggcgcgauugccggguucaucgaaaauggaugggagggcaugguugacgggugguacggauuucggcaccaaaacuccgagggcagaggccaggcugccgaucuuaagagcacacaggcugccauugaccaaaucaaugggaaacugaaccgccucauuggaaagaccaaugaaaaauuccaucagaucgagaaggaguucucugaaguggaaggccggauucaggaucuggagaaguauguggaggacacgaaaaucgaucuuugguccuacaacgccgaacugcucgucgcucuggagaaucagcacacaaucgaccugaccgauagcgaaaugaacaagcucuuugagaaaaccaagaaacaacugagagaaaacgcggaggacauggggaauggaugcuucaagauuuaucauaagugugauaacgccugcaucggcucuauucgcaaugggacauacgaccacaacguguaccgggacgaggcucuuaauaacagauuucagaucaaaggcguugaacugaaguccggauauaaagauuggauucucuggaucagcuucgccaucuccugcuuucugcuuuguguggcccugcucggcuucauuaugugggcuugccagaaggggaauauccgcuguaacauuugcaucuga

SEQ ID NO: 196351 - RNA, 1701 nt, Artificial Sequence
  derived and/or modified sequence opt5 from hemagglutinin__InfluenzaA__ALE31807
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcagcuccagcuuuuucucucgccugaauuggcucacccaucugaacuuuacauauccugcccuuaaugucaccaugcccaacaacgagcaguucgacaagcuguacguguggggcguucaccauccugggacggauaaggaccagaucuuucucuaugcgcaguccagcggaagaauuacaguguccaccaaacggucucaacaggccgucaucccgaauauuggcagccgccccagaauccggaacaucccuucccgcauuagcaucuacuggacaauugugaagcccggggauauccugcugauuaauucuaccggaaaccucaucgcuccuagaggcuacuucaaaauccgguccgggaagucuucuauuaugcgcagcgacgcccccaucggaaaauguaaguccgaaugcauuaccccgaauggcucuaucccuaacgacaagcccuuucagaaugugaacagaauuacauauggcgcuuguccucgguacgucaaacacagcacgcugaagcuggccaccgggaugcgcaauguucccgagaaacagacaagaggaaucuucggcgcgaucgccggguuuauugaaaacggaugggagggcaugguggaugggugguauggauuccggcaccaaaauuccgagggcagaggccaggcugccgaccuuaagagcacccaggcugccaucgaucaaauuaacgggaaacucaaucgccugaucggaaagacaaacgaaaaauuccaucagauugagaaggaauuuucugagguggaaggccggauccaggaccuugagaaguacgucgaggauaccaaaauugaccugugguccuauaaugccgaacuccugguggcucuggagaaccagcacacgaucgaucucacagacagcgaaaugaacaagcuguucgagaaaaccaagaaacaacuuagagaaaaugcggaggauauggggaacggaugcuuuaagaucuaccauaagugugacaaugccugcauuggcucuauccgcaacgggaccuaugaucacaauguuuaccgggacgaggcucugaacaauagauuccagauuaaaggcguggaacucaaguccggauacaaagacuggauccuguggauuagcuuugccaucuccugcuuccuucugugugucgcccuccugggcuuuaucaugugggcuugccagaaggggaacauucgcuguaauaucugcauuuga

SEQ ID NO: 196352 - RNA, 1701 nt, Artificial Sequence
  derived and/or modified sequence opt5 from hemagglutinin__InfluenzaA__ALE31808
augaagaccaucauugcccugggcuacauccucugccugguguucgcucagaaaauucccgggaacgacaauagcacagccacgcuuugucugggacaccaugcggucccuaacggcaccaucguuaagacaauuaccaaugauagaaucgaggugacaaacgcuaccgaacucgugcaaaauuccucuaucggggagauuugcgacagcccgcacaaaauccuggauggagaaaacuguacacuuauugacgcccugcucggcgauccccagugcgacggguuucagaauaagaaaugggaucuguucgucgagcgguccaaggccuauucuaacuguuacccuuaugacgugcccgauuacgcuagccugcgcucccucguugccucuagcggaacccuggaauuuaauaacgaguccuucaauuggacgggcgugacccagaacggcacaagcucugcuugcaucagacgguccucuagcuccuuuuucagccgccuuaauuggcugacccaucucaacuauacauacccugcccugaaugucaccaugcccaacaacgagcaauuugacaaacuuuauauuuggggagugcaccauccugggacggauaaggaccagaucuuccuguacgcgcagucuuccggcagaauuacaguuagcaccaagcggucccagcaagccgugaucccgaauaucgggucucgcccccggauuagagauaucccuagccgcauuuccaucuacuggacaauugucaaacccggagacauccuccugaucaacagcaccggcaaucugauugcuccuagaggguauuuuaagauccggucuggaaaauccagcauuaugcgcucugacgcccccaucggcaaguguaagagcgaaugcauuaccccgaacggcuccaucccuaaugauaaacccuuccagaacgugaauagaaucacauacggggcuuguccucgguaugugaagcacucuacgcucaaacuggccaccggaaugcgcaacguccccgagaagcagacaagaggcauuuuuggggcgaucgccggauucauugaaaauggcugggaggggaugguugacggaugguacggcuuucggcaccagaacagcgagggcagagggcaagcugccgaucuuaaauccacccaggcugccaucgaccagauuaauggaaagcugaaccgccucaucggcaaaacaaaugaaaaguuccaucaaauugagaaggaguucagcgaaguggaagggcggauccaggaucuggagaaauauguggaggacaccaagaucgaucuuuggucuuacaacgccgaacugcucgucgcucuggagaaucagcacacgauugaccugacagauuccgaaaugaacaaacucuuugagaagaccaaaaagcagcugagagaaaacgcggaggacaugggaaauggcugcuucaagaucuaucauaaaugugauaacgccugcauugggagcauccgcaauggcaccuacgaccacaacguguaccgggacgaggcucuuaauaacagauuucaaauuaagggaguugaacugaaaucuggcuauaaggauuggauccucuggaucuccuucgccauuagcugcuuucugcuuuguguggcccugcucggguucaucaugugggcuugccagaaaggaaauauucgcuguaacaucugcauuuga

SEQ ID NO: 196353 - RNA, 1701 nt, Artificial Sequence; identical to SEQ ID NO: 195465
  derived and/or modified sequence opt5 from hemagglutinin__InfluenzaA__ALE31810

SEQ ID NO: 196354 - RNA, 1701 nt, Artificial Sequence; identical to SEQ ID NO: 195465
  derived and/or modified sequence opt5 from hemagglutinin__InfluenzaA__ALE31812

SEQ ID NO: 196355 - RNA, 1701 nt, Artificial Sequence
  derived and/or modified sequence opt5 from hemagglutinin__InfluenzaA__ALE31814
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugaugggaaaaacuguacacugaucgacgcccuccugggagauccccagugcgacggcuuucagaauaagaaaugggaucuguucgucgaacggucuaaggcccauagcaacuguuauccuuacgacgugcccgauuaugcuucccuccgcucucugguugccagcuccgggacccuugaguuuaauaacgaauccuucaauugggcuggagugacgcaaaacggcaccucuuccagcugcauuagaggcucuaauuccagcuuuuucucucggcugaacuggcucacacaccuuaauuccaaguacccugcccuuaacgucaccaugcccaacaaugagcaguuugacaaacuguauaucuggggagugcaucacccugggacagauaaggaccagauuuuccucuacgcgcagccgagcggccgcaucaccguuuccacgaaaagaucucaacaggccgugauucccaacaucgggagccggccucgcaucagagauauucccucccggaucagcauuuauuggacaaucgucaagccuggagacauucugcugaucaauucuaccggcaaccucaucgcuccccgcggguacuuuaaaauuagauccggaaagagcucuaucaugcggagcgacgccccgauuggcaaguguaaauccgagugcaucacaccuaauggcucuauucccaacgauaagccuuuccagaaugugaaccgcaucaccuacggggcuugucccagauaugugaaacagagcacccugaagcuggccacaggaaugcggaauguccccgaacgccaaacgagaggcaucuuuggggcgauugccggauucaucgagaacggcugggaagggaugguugacggaugguacggcuuucggcaccagaauagcgagggcagagggcaggcugccgaucugaaaagcacccaagcugccauugaccagaucaacggaaagcucaaucgccugauuggcaaaacaaacgagaaguuccaucagaucgaaaaggaguucucugaaguggaggggcggauucaggaucuugaaaaauauguggaggacaccaagaucgaucugugguccuacaaugccgagcuccuggucgcucuggaaaaccaacacacaaucgaccucaccgauagcgagaugaacaaacuguuugaaaagacgaaaaagcagcuuagagagaaugcggaagacaugggaaacggcugcuucaagauuuaucauaaaugugauaaugccugcaucgggucuauucgcaacggcacauacgaccacgacguguaucgggaugaggcucugaauaacagauuucagaucaagggaguugagcucaaauccggcuacaaggacuggauucuguggaucagcuucgccaucuccugcuuucuucuguguguggcccuccugggguucauuaugugggcuugccagaaaggaaauauccgcuguaacauuugcaucuga

SEQ ID NO: 196356 - RNA, 1701 nt, Artificial Sequence; identical to SEQ ID NO: 196355
  derived and/or modified sequence opt5 from hemagglutinin__InfluenzaA__ALE31815

SEQ ID NO: 196357 - RNA, 1701 nt, Artificial Sequence; identical to SEQ ID NO: 195465
  derived and/or modified sequence opt5 from hemagglutinin__InfluenzaA__ALE31818

SEQ ID NO: 196358 - RNA, 1701 nt, Artificial Sequence
  derived and/or modified sequence opt5 from hemagglutinin__InfluenzaA__ALE31819
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaggcucuagcuccagcuuuuucucucggcuuaauuggcugacccaucucaacuauacauacccugcccugaaugucaccaugcccaacaaggagcaguuugacaaacuuuauauuuggggagugcaccauccugggacggauaaggaccagaucuuccuguacgcgcaguccagcggccgcauuacaguuuccaccaagagaucucaacaggccgugaucccgaacaucgggagccggccccgcauuagagauaucccuucccggauuagcaucuacuggacaauugucaaacccggagacauccuccugaucaauucuaccggcaaccugauugcuccucgcggguauuuuaagaucagauccggaaaaagcucuauuaugcggagcgacgcccccaucggcaaguguaaguccgaaugcauuaccccgaauggcucuaucccuaacgauaaacccuuccagaaugugaaccgcaucacauacggggcuuguccuagauaugugaagcacagcacgcucaaacuggccaccggaaugcggaauguccccgagaagcagacacgcggcauuuuuggggcgaucgccggauucauugaaaacggcugggaggggaugguugacggaugguacggcuuuagacaccaaaauuccgagggccgggggcaggcugccgaucuuaaaagcacccaggcugccaucgaccaaauuaacggaaagcugaauagacucaucggcaaaacaaacgaaaaguuccaucagauugagaaggaguucucugaaguggaagggcgcauccaggaucuggagaaauauguggaggacaccaagaucgaucuuugguccuacaaugccgaacugcucgucgcucuggagaaccagcacacgauugaccugacagauagcgaaaugaauaaacucuuugagaagaccaaaaagcaacugcgggaaaacgcggaggacaugggaaacggcugcuucaagaucuaucauaaaugugauaaugccugcauugggucuaucagaaacggcaccuacgaccacaauguguaccgcgacgaggcucuuaacaaucgguuucagauuaagggaguugaacugaaauccggcuauaaggauuggauccucuggaucagcuucgccauuuccugcuuucugcuuuguguggcccugcucggguucaucaugugggcuugccagaaaggaaacauuagauguaauaucugcauuuga

SEQ ID NO: 196359 - RNA, 1701 nt, Artificial Sequence; identical to SEQ ID NO: 196009
  derived and/or modified sequence opt5 from hemagglutinin__InfluenzaA__ALE31820

SEQ ID NO: 196360 - RNA, 1701 nt, Artificial Sequence
  derived and/or modified sequence opt5 from hemagglutinin__InfluenzaA__ALE31821
augaagaccaucauugcccugagcuacacacucugccugguguucgcucagaaaauccccggcaacgacaauuccacggccacccuuugucuggggcaccaugcggucccuaacggaacaauuguuaagaccaucacaaaugauagaauugaggugaccaacgcuacagaacucgugcaaaauucuagcaucggcgagaucugcgacuccccgcaccagauucuggauggggaaaacuguacccuuaucgacgcccugcucggagauccccagugcgacggcuuucagaauaaaaagugggaucuguucgucgagcggucuaaagcccauagcaacuguuauccuuacgacgugcccgauuaugcuucccugcgcucucucguugccagcuccgggacgcuggaauuuaauaacgagagcuucaauuggaccggagugacacaaaacggcaccucuuccgcuugcauuagacggagcagcuccagcuuuuucucucgccuuaauuggcugacacaccucaacuacaccuauccugcccugaaugucacgaugcccaacaacgagcaguuugacaaacuuuacaucuggggcgugcaucacccugggacagauaaggaccagauuuuccuguaugcgcaguccagcggaagaaucaccguuuccacaaagcggucucaacaggccgugauuccgaauaucggcagccgccccagaauccgggauauuccuucccgcaucagcauuuacuggaccaucgucaagcccggggacauucuccugaucaacucuaccggaaaucugaucgcuccuagaggcuacuuuaaaauucgguccgggaagucuucuaucaugcgcagcgacgcccccauuggaaaauguaaguccgaaugcaucacaccgaacggcucuauuccuaaugauaagcccuuccagaacgugaauagaaucacguauggcgcuuguccucgguacgugaaacacagcacccucaagcuggccacagggaugcgcaacguccccgagaaacagaccagaggaaucuuuggcgcgauugccggguucaucgaaaauggaugggagggcaugguugacgggugguauggauuucggcaucaaaacuccgagggcagaggccaggcugccgaucuuaagagcacacaggcugccauugaccaaaucaaugggaaacugaaccgccucauuggaaagaccaaugaaaaauuccaccagaucgagaaggaguucucugaaguggaaggccggauucaggaucuggagaaguacguggaggacacgaaaaucgaucuuugguccuauaacgccgaacugcucgucgcucuggagaaucagcauacaaucgaccugaccgauagcgaaaugaacaagcucuuugagaaaaccaagaaacaacugagagaaaacgcggaggacauggggaauggaugcuucaagauuuaccacaagugugauaacgccugcaucggcucuauucgcaaugggacauaugaccacaacguguaccgggacgaggcucuuaauaacagauuucagaucaaaggcguugaacugaaguccggauacaaagauuggauucucuggaucagcuucgccaucuccugcuuucugcuuuguguggcccugcucggcuucauuaugugggcuugccagaaggggaauauccgcuguaacauuugcaucuga

SEQ ID NO: 196361 - RNA, 1701 nt, Artificial Sequence; identical to SEQ ID NO: 196101
  derived and/or modified sequence opt5 from hemagglutinin__InfluenzaA__ALE31822

SEQ ID NO: 196362 - RNA, 1701 nt, Artificial Sequence; identical to SEQ ID NO: 196009
  derived and/or modified sequence opt5 from hemagglutinin__InfluenzaA__ALE31823

SEQ ID NO: 196363 - RNA, 1701 nt, Artificial Sequence; identical to SEQ ID NO: 195465
  derived and/or modified sequence opt5 from hemagglutinin__InfluenzaA__ALE31824

SEQ ID NO: 196364 - RNA, 1701 nt, Artificial Sequence
  derived and/or modified sequence opt5 from hemagglutinin__InfluenzaA__ALE31825
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauagauacccugcccugaaugucacaaugcccaacaacgagcaguuugacaaacuuuauauuuggggcgugcaccauccugggaccgauaaggaccagaucuuccuguacgcgcaguccagcggacggauuacgguuuccacaaagcgcucucaacaggccgugaucccgaauaucggcagcagaccccggauucgcgauaucccuuccagaauuagcaucuacuggaccauugucaagcccggggacauccuccugaucaacucuacaggaaaucugauugcuccucggggcuauuuuaaaauccgcuccgggaagucuucuauuaugagaagcgacgcccccaucggaaaauguaaguccgaaugcauuaccccgaacggcucuaucccuaaugauaagcccuuccagaacgugaaucggaucaccuacggcgcuuguccucgcuaugugaaacacagcacacucaagcuggccacggggaugagaaacguccccgagaaacagacccggggaauuuuuggcgcgaucgccggguucauugaaaauggaugggagggcaugguugacgggugguacggauuuagacaccaaaacuccgagggccgcggccaggcugccgaucuuaagagcacacaggcugccaucgaccaaauuaaugggaaacugaaccggcucaucggaaagaccaaugaaaaauuccaucagauugagaaggaguucucugaaguggaaggcagaauccaggaucuggagaaguauguggaggacacaaaaaucgaucuuugguccuacaacgccgaacugcucgucgcucuggagaaucagcacaccauugaccugacggauagcgaaaugaacaagcucuuugagaaaacaaagaaacaacugcgcgaaaacgcggaggacauggggaauggaugcuucaagaucuaucauaagugugauaacgccugcauuggcucuauccggaaugggaccuacgaccacaacguguacagagacgaggcucuuaauaaccgcuuucagauuaaaggcguugaacugaaguccggauauaaagauuggauccucuggaucagcuucgccauuuccugcuuucugcuuuguguggcccugcucggcuucaucaugugggcuugccagaaggggaauauucgguguaacaucugcauuuga

SEQ ID NO: 196365 - RNA, 1701 nt, Artificial Sequence; identical to SEQ ID NO: 195465
  derived and/or modified sequence opt5 from hemagglutinin__InfluenzaA__ALE31826

SEQ ID NO: 196366 - RNA, 1701 nt, Artificial Sequence; identical to SEQ ID NO: 195465
  derived and/or modified sequence opt5 from hemagglutinin__InfluenzaA__ALE31827

SEQ ID NO: 196367 - RNA, 1701 nt, Artificial Sequence; identical to SEQ ID NO: 195465
  derived and/or modified sequence opt5 from hemagglutinin__InfluenzaA__ALE31828

SEQ ID NO: 196368 - RNA, 1701 nt, Artificial Sequence; identical to SEQ ID NO: 196022
  derived and/or modified sequence opt5 from hemagglutinin__InfluenzaA__ALE31829

SEQ ID NO: 196369 - RNA, 1701 nt, Artificial Sequence
  derived and/or modified sequence opt5 from hemagglutinin__InfluenzaA__ALE31830
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgcccccaucggaaaauguaaguccgaaugcauuaccccgaacggcucuaucccuaaugauaagcccuuccagaacgugaauagaaucacauacggcgcuuguccucgguaugugaaacacagcacgcucaagcuggccaccgggaugcgcaacguccccgagaaacagacaagaggaauuuuuggcgcgaucgccggguucauugaaaauggaugggagggcaugguugacgggugguacggauuucggcaccaaaacuccgagggcagaggccaggcugccgaucuuaagagcacccaggcugccaucgaccaaauuaaugggaaacugaaccgccucaucggaaagacaaaugaaaaauuccaucagauugagaaggaguucucugaaguggaaggccggauccaggaucuggagaaguauguggaggacaccaaaaucgaucuuugguccuacaacgccgaacugcucgucgcucuggagaaucagcacacgauugacaucacagauagcgaaaugaacaagcuguuugagaaaaccaagaaacaacucagagaaaacgcggaggacauggggaauggaugcuucaagauuuaucauaagugugauaacgccugcaucggcucuauucgcaaugggaccuacgaccacaacguguaccgggacgaggcucugaauaacagauuucagaucaaaggcguugaacuuaaguccggauauaaagauuggauccuguggauuagcuucgccaucuccugcuuucuccuguguguggcccuucugggcuucauuaugugggcuugccagaaggggaauauccgcuguaacauuugcaucuga

SEQ ID NO: 196370 - RNA, 1701 nt, Artificial Sequence
  derived and/or modified sequence opt5 from hemagglutinin__InfluenzaA__ALE31832
augaagaacaucauugcccugagcuacauccucugccugguguucgcucagaaaauucccggcaaugacaacuccaccgccacacuuugucuggggcaccaugcggucccuaauggaacgaucguuaagaccauuacaaacgauagaaucgaggugaccaaugcuacagaacucgugcaaaacucuagcaucggcgagauuugcgacuccccgcaccagauccuggauggggaaaauuguacccuuauugacgcccugcucggagauccccagugcgacggcuuucagaacaaaaagugggaucuguucgucgagcggucuaaagccuauagcaauuguuacccuuaugacgugcccgauuacgcuucccugcgcucucucguugccagcuccgggacacuggaauuuaacaaugagagcuucaacuggaccggagugacgcaaaauggcaccucuuccgcuugcaucagacggagcaacucuuccuuuuucagccgccuuaauuggcugacacaucucaacuauaccuacccugcccugaacgucacaaugcccaauaacgagcaguuugacaaacuuuauauuuggggcgugcaccauccugggaccgauaaggaccagaucuuccuguacgcgcagucuuccggaagaauuacgguuagcacaaagcggucccaacaggccgugaucccgaauaucggcucucgcccccggauuagagauaucccuagccgcauuuccaucuacuggaccauugucaagcccggggacauccuccugaucaacagcacaggaaaucugauugcuccuagaggcuauuuuaaaauccggucugggaaguccagcauuaugcgcucugacgcccccaucggaaaauguaagagcgaaugcauuaccccgaacggcuccaucccuaaugauaagcccuuccagaacgugaauagaaucaccuacggcgcuuguccucgguaugugaaacacucuacacucaagcuggccacggggaugcgcaacguccccgagaaacagaccagaggaauuuuuggcgcgaucgccggguucauugaaaauggaugggagggcaugguugacgggugguacggauuucggcaccaaaacagcgagggcagaggccaggcugccgaucuuaaguccacacaggcugccaucgaccaaauuaaugggaaacugaaccgccucaucggaaagaccaaugaaaaauuccaucagauugagaaggaguucagcgaaguggaaggccggauccaggaucuggagaaguauguggaggacacaaaaaucgaucuuuggucuuacaacgccgaacugcucgucgcucuggagaaccagcacaccauugaccugacggauuccgaaaugaauaagcucuuugagaaaacaaagaaacaacugagagaaaacgcggaggacauggggaauggaugcuucaagaucuaucauaagugugauaacgccugcauuggcagcauccgcaaugggaccuacgaccacaacguguaccgggacgaggcucuuaauaacagauuucagauuaaaggcguugaacugaagucuggauauaaagauuggauccucuggaucuccuucgccauuagcugcuuucugcuuuguguggcccugcucggcuucaucaugugggcuugccagaaggggaauauucgcuguaacaucugcauuuga

SEQ ID NO: 196371 - RNA, 1701 nt, Artificial Sequence
  derived and/or modified sequence opt5 from hemagglutinin__InfluenzaA__ALE31833
augaagaccaucauugcccugagcuacauccucugccugguguccgcucagaaaauucccggcaacgacaauucuacagccacgcuuugucuggggcaccaugcggucccuaacggaaccaucguuaagacaauuaccaaugauagaaucgaggugacaaacgcuaccgaacucgugcaaaauagcuccaucggcgagauuugcaacucuccgcaccagauccuggacggggaaaauuguacacuuauugaugcccugcucggagacccccagugcgauggcuuccagaacaaaaagugggaccuguuugucgagcggagcaaagccuauuccaauuguuacccuuaugaugugcccgacuacgcuucucugcgcagccucguugccuccagcgggacccuggaguucaacaaugaaucuuuuaacuggacgggagugacccaaaauggcacauccagcgcuugcaucagacggucuuccagcucuuucuuuucccgccuuaacuggcugacccaucucaauuauacauacccugcccugaacgucaccaugcccaacaaugagcaguucgauaagcuguauauuuggggcgugcaccauccugggacggacaaggaucagaucuuucuguacgcgcagagcuccggaagaauuacaguuucuaccaaacggagccaacaggccgugaucccgaacaucggcucccgcccccggauuagagacaucccuagccgcauuucuaucuacuggacaauugucaagcccggggauauccuccugaucaauuccaccggaaaccugauugcuccuagaggcuauuucaaaauccggagcgggaagucuagcauuaugcgcuccgacgcccccaucggaaaauguaagucugaaugcauuaccccgaauggcagcaucccuaacgacaagcccuuucagaaugugaacagaaucacauacggcgcuuguccucgguaugugaaacacuccacgcucaagcuggccaccgggaugcgcaauguccccgagaaacagacaagaggaauuuucggcgcgaucgccggguuuauugaaaacggaugggagggcaugguugaugggugguacggauuccggcaccaaaauagcgagggcagaggccaggcugccgaccuuaagucuacccaggcugccaucgaucaaauuaacgggaaacugaaucgccucaucggaaagacaaacgaaaaauuucaucagauugagaaggaguucuccgaaguggaaggccggauccaggaccuggagaaguauguggaggauaccaaaaucgaccuuuggagcuacaaugccgaacugcucgucgcucuggagaaccagcacacgauugaucugacagacucugaaaugaacaaacucuucgagaagaccaagaaacaacugagagaaaaugcggaggauauggggaacggaugcuuuaagaucuaucauaagugugacaaugccugcauuggcuccauccgcaacgggaccuacgaucacaauguguaccgggacgaggcucuuaacaauagauuccagauuaaaggcguugaacuuaagagcggauauaaagacuggauccucuggaucuccuuugccauuucuugcuuccugcuuuguguggcccugcucggcuuuaucaugugggcuugccagaaggggaacauucgcuguaauaucugcauuuga

SEQ ID NO: 196372 - RNA, 1701 nt, Artificial Sequence
  derived and/or modified sequence opt5 from hemagglutinin__InfluenzaA__ALE31834
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagcccauagcaacuguuauccuuacgacgugcccgauuaugcuucccuccgcucucugguugccagcuccgggacccuugaauuuaauaacgagagcuucaauugggcuggagugacgcaaaacggcaccucuuccagcugcauuagaggcucuaauuccagcuuuuucucucggcugaacuggcucacacaccuuaauuccaaguacccugcccugaacgucaccaugcccaacaaugagcaguuugacaagcuguauaucuggggagugcaucacccugggacagauaaagaccagauuuuccucuacgcgcagagcuccggccgcaucaccguuucuacgaagagaagccaacaggccgugauuccgaacaucgggucccggccccgcaucagagauauuccuagccggaucucuauuuauuggacaaucgucaaacccggagacauucugcugaucaauuccaccggcaaccucaucgcuccucgcggguacuuuaagauuagaagcggaaaaucuagcaucaugcgguccgacgcccccauuggcaaguguaagucugaaugcaucacaccgaauggcagcauuccuaacgauaaacccuuccagaaugugaaccgcaucaccuacggggcuuguccuagauaugugaagcaguccacccugaaacuugccacaggaaugcggaauguccccgagaagcaaacgcgcggcaucuuuggggcgauugccggauucaucgaaaacggcugggaggggaugguugacggaugguacggcuuuagacaccagaauagcgagggccgggggcaggcugccgaucugaaaucuacccaagcugccauugaccagaucaacggaaagcucaauagacugauuggcaaaacaaacgaaaaguuccaucagaucgagaaggaguucuccgaaguggaagggcgcauucaggaucuugagaaauauguggaggacaccaagaucgaucuguggagcuacaaugccgaacuccuggucgcucuggagaaccaacacacaaucgaccucaccgauucugaaaugaacaaacuguuugagaagacgaaaaagcagcuucgggaaaaugcggaggacaugggaaacggcugcuucaagauuuaucauaaaugugauaaugccugcaucggguccauuagaaacggcacauacgaccacgacguguaucgcgaugaggcucugaauaaccgguuucagaucaagggaguugaacucaaaagcggcuacaaggacuggauucuguggaucuccuucgccaucucuugcuuucuucuguguguggcccuccugggguucauuaugugggcuugccagaaaggaaauaucagauguaacauuugcaucuga

SEQ ID NO: 196373 - RNA, 1701 nt, Artificial Sequence; identical to SEQ ID NO: 196123
  derived and/or modified sequence opt5 from hemagglutinin__InfluenzaA__ALE31835

SEQ ID NO: 196374 - RNA, 1701 nt, Artificial Sequence; identical to SEQ ID NO: 195465
  derived and/or modified sequence opt5 from hemagglutinin__InfluenzaA__ALE31836

SEQ ID NO: 196375 - RNA, 1701 nt, Artificial Sequence
  derived and/or modified sequence opt5 from hemagglutinin__InfluenzaA__ALE31837
augaagaccaucauugcccugagcuacauccucugccugguguaugcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuccagaauaaaaagugggaucuguuugucgagcggucuaaagccuacagcaacuguuauccuuacgacgugcccgauuaugcuucccugcgcucucucguugccagcuccgggacccuggaauuuaauaacgagagcuucaauuggacgggagugacccaaaacggcacaucuuccgcuugcaucagacggagcagcuccagcuucuuuucucgccuuaauuggcugacccaucucaacuacacauauccugcccugaaugucaccaugcccaacaacgagcaguucgacaaacuuuacauuuggggcgugcaccauccugggacggauaaggaccagaucuuucuguacgcgcaguccagcggaagaauuacaguuuccaccaagcggucucaacaggccgugaucccgaauaucggcagccgcccccggauuagagauaucccuucccgcauuagcaucuauuggacaauugucaagcccggggacauccuccugaucaacucuaccggaaaucugauugcuccuagaggcuacuucaaaauccgguccgggaagucuucuauuaugcgcagcgacgcccccaucggaaaauguaaguccgaaugcauuaccccgaacggcucuaucccuaaugauaagcccuuucagaacgugaauagaaucacauauggcgcuuguccucgguacgugaaacacagcacgcucaagcuggccaccgggaugcgcaacguccccgagaaacagacaagaggaauuuucggcgcgaucgccggguuuauugaaaauggaugggagggcaugguugacgggugguauggauuccggcaccaaaacuccgagggcagaggccaggcugccgaucuuaagagcacccaggcugccaucgaccaaauuaaugggaaacugaaccgccucaucggaaagacaaaugaaaaauuucaucagauugagaaggaguucucugaaguggaaggccggauccaggaucuggagaaguacguggaggacaccaaaaucgaucuuugguccuauaacgccgaacugcucgucgcucuggagaaucagcacacgauugaccugacagauagcgaaaugaacaaacucuucgagaagaccaagaaacaacugagagaaaacgcggaggacauggggaauggaugcuuuaagaucuaccauaagugugauaacgccugcauuggcucuauccgcaaugggaccuacgaccacaacguguaucgggacgaggcucuuaauaacagauuccagauuaaaggcguugaacugaaguccggauacaaagauuggauccucuggaucagcuuugccauuuccugcuuccugcuuuguguggcccugcucggcuuuaucaugugggcuugccagaaggggaauauucgcuguaacaucugcauuuga

SEQ ID NO: 196376 - RNA, 1701 nt, Artificial Sequence; identical to SEQ ID NO: 195465
  derived and/or modified sequence opt5 from hemagglutinin__InfluenzaA__ALE31838

SEQ ID NO: 196377 - RNA, 1701 nt, Artificial Sequence; identical to SEQ ID NO: 195465
  derived and/or modified sequence opt5 from hemagglutinin__InfluenzaA__ALE31839

SEQ ID NO: 196378 - RNA, 1701 nt, Artificial Sequence
  derived and/or modified sequence opt5 from hemagglutinin__InfluenzaA__ALE31840
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaagcuguauauuuggggcgugcaccauccugggacggauaaggaccagaucuuccuguacgcgcaguccagcggaagaauuacaguuuccaccaaacggucucaacaggccgugaucccgaauaucggcagccgccuccggauuagagauauccccucccgcauuagcaucuacuggacaauugucaagccuggggacauccugcugaucaacucuaccggaaaucucauugcucccagaggcuauuuuaaaauccgguccgggaagucuucuauuaugcgcagcgacgccccuaucggaaaauguaaguccgaaugcauuacccccaacggcucuaucccgaaugauaagccuuuccagaacgugaauagaaucacauacggcgcuuguccccgguaugugaaacacagcacgcugaaacuugccaccgggaugcgcaacgucccugagaagcagacaagaggaauuuuuggcgcgaucgccggguucauugaaaauggaugggagggcaugguugacgggugguacggauuucggcaccaaaacuccgagggcagaggccaggcugccgaucuuaagagcacccaggcugccaucgaccaaauuaaugggaaacucaaccgccugaucggaaagacaaaugaaaaauuccaucagauugagaaggaguucucugaaguggaaggccggauccaggaucuugagaaguauguggaggacaccaaaaucgaucugugguccuacaacgccgaacuccuggucgcucuggagaaucagcacacgauugaccucacagauagcgaaaugaacaagcuguuugagaaaaccaagaaacaacuuagagaaaacgcggaggacauggggaauggaugcuucaagaucuaucauaagugugauaacgccugcauuggcucuauccgcaaugggaccuacgaccacaacguguaccgggacgaggcucugaauaacagauuucagauuaaaggcguugaacucaaguccggauauaaagauuggauccuguggaucagcuucgccauuuccugcuuucuucuguguguggcccuccugggcuucaucaugugggcuugccagaaggggaauauucgcuguaacaucugcauuuga

SEQ ID NO: 196379 - RNA, 1701 nt, Artificial Sequence; identical to SEQ ID NO: 195465
  derived and/or modified sequence opt5 from hemagglutinin__InfluenzaA__ALE31842

SEQ ID NO: 196380 - RNA, 1701 nt, Artificial Sequence
  derived and/or modified sequence opt5 from hemagglutinin__InfluenzaA__ALE31843
augcagaccaucauugcccugagcuacauccucugccugguguucgcucaaaagauucccggcaacgacaauuccacagccacgcuuugucuggggcaccaugcggucccuaacggaaccaucguuaaaacaauuaccaaugauagaaucgaggugacaaacgcuaccgaacucgugcagaauagcagcaucggcgagauuugcgacuccccgcaccagauccuggauggggaaaacuguacacuuauugacgcccugcucggagauccccagugcgacggcuuucaaaauaagaaaugggaucuguucgucgagcggucuaaggccuauagcaacuguuacccuuaugacgugcccgauuacgcuucccugcgcucucucguugccagcuccgggacccuggaauuuaauaacgagagcuucaauuggacgggagugacccagaacggcacaucuuccgcuugcaucagaaaaucuucuuccagcuuuuucucucggcuuaauuggcugacccaucucaacuauacauacccugcccugaaugucaccaugcccaacaacgagcaguuugacaagcuguauauuuggggcgugcaccauccugggacggauaaggaccagaucuuccuguacgcgcaauccagcggacgcauuacaguuuccaccaaaagaucucagcaggccgugaucccgaauaucggcagccggccccgcauuagagauaucccuucccggauuagcaucuacuggacaauugucaagcccggggacauccuccugaucaacucuaccggaaaucugauugcuccucgcggcuauuuuaaaauccucuccggaaagagcucuauuaugagaagcgacgcccccaucgggaaauguaaguccgaaugcauuaccccgaacggcucuaucccuaaugauaagcccuuccagaacgugaaucggaucacauacggcgcuuguccucgcuaugugaaacacagcacgcugaaacuugccaccgggaugagaaacguccccgagaagcaaacacggggaauuuuuggcgcgaucgccggguucauugaaaauggaugggagggcaugguugacgggugguacggauuucgccaccagaacuccgagggcagaggccaggcugccgaucuuaagagcacccaagcugccaucgaccagauuaaugggaaacucaaccggcugaucggaaagacaaaugaaaaauuccaucagauugagaaggaguucucugaaguggaaggcagaauccaggaucuugagaaguauguggaggacaccaaaaucgaucugugguccuacaacgccgaacuccuggucgcucuggagaaucaacacacgauugaccucacagauagcgaaaugaacaagcuguuugagaaaaccaagaaacagcuucgcgaaaacgcggaggacauggggaauggaugcuucaagaucuaucauaagugugauaacgccugcauuggcucuauccggaaugggaccuacgaccacaacguguacagagacgaggcucugaauaaccgcuuucagauuaaaggcguugaacucaaguccggauauaaagauuggauccuguggaucagcuucgccauuuccugcuuucuucuguguguggcccuccugggcuucaucaugugggcuugccagaaggggaauauucgguguaacaucugcauuuga

SEQ ID NO: 196381 - RNA, 1701 nt, Artificial Sequence; identical to SEQ ID NO: 196022
  derived and/or modified sequence opt5 from hemagglutinin__InfluenzaA__ALE31844

SEQ ID NO: 196382 - RNA, 1701 nt, Artificial Sequence; identical to SEQ ID NO: 195998
  derived and/or modified sequence opt5 from hemagglutinin__InfluenzaA__ALE31846

SEQ ID NO: 196383 - RNA, 1701 nt, Artificial Sequence; identical to SEQ ID NO: 195465
  derived and/or modified sequence opt5 from hemagglutinin__InfluenzaA__ALE31847

SEQ ID NO: 196384 - RNA, 1701 nt, Artificial Sequence; identical to SEQ ID NO: 195465
  derived and/or modified sequence opt5 from hemagglutinin__InfluenzaA__ALE31848

SEQ ID NO: 196385 - RNA, 1701 nt, Artificial Sequence
  derived and/or modified sequence opt5 from hemagglutinin__InfluenzaA__ALE31850
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccagcugcauuagaggcucuaauuccagcuuuuucucucggcugaacuggcucacacaucugaauagcaaguauccugcccuuaacgucaccaugcccaacaaugagcaguuugacaagcuguacaucuggggagugcaccauccugggacagauaaagaccagauuuuccucuaugcgcagccgagcggccgcaucaccguuuccacgaagagaucucaacaggccgugauucccaacaucgggagccggccucgcaucagagauauucccucccggaucagcauuuacuggacaaucgucaaaccuggagacauucugcugaucaauucuaccggcaaccucaucgcuccccgcggguacuuuaagauuagauccggaaaaagcucuaucaugcggagcgacgccccgauuggcaaguguaaguccgaaugcaucacaccuaauggcucuauucccaacgauaaaccuuuccagaaugugaaccgcgugaccuauggggcuugucccagauacgucaagcagagcacccugaaacuugccacaggaaugcggaauguucccgagcgccaaacgagaggcaucuuuggggcgaucgccggauucauugaaaacggcugggaggggaugguggacggaugguauggcuuucggcaccaaaauuccgagggcagagggcaggcugccgaucugaaguccacccaggcugccaucgaccagauuaacggaaaacucaaucgccugaucggcaagacaaacgaaaaauuccaccagauugagaaggaguucucugaaguggaagggcggauccaggaucuugagaaguacgucgaggacaccaaaauugaucugugguccuauaaugccgaacuccugguggcucuggagaaccaacauacaaucgaccucaccgauagcgaaaugaacaagcuguuugagaaaacgaagaaacagcuuagagaaaaugcggaggacaugggaaacggcugcuucaagaucuaccacaagugugauaaugccugcauugggucuauccgcaacggcacauaugaccaugacguuuaccgggaugaggcucugaauaacagauuucagauuaaaggaguggaacucaaguccggcuacaaagacuggauccuguggauuagcuucgccaucuccugcuuucuucugugugucgcccuccugggguucaucaugugggcuugccagaagggaaauauucgcuguaacaucugcauuuga

SEQ ID NO: 196386 - RNA, 1701 nt, Artificial Sequence
  derived and/or modified sequence opt5 from hemagglutinin__InfluenzaA__ALE31851
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaaagucuagcuccagcuuuuucucucggcuuaauuggcugacccaucucaacuauacauacccugcccugaaugucaccaugcccaacaacgagcaguuugacaaacuuuauauuuggggcgugcaccauccugggacggauaaagaccagaucuuccuguacgcgcgcuccagcggaagaauuacaguuuccaccaagcggucucagcaagccgugaucccgaauaucggcagccgcccccggauuagagauaucccuucccgcauuagcaucuacuggacaauugucaaacccggggacauccuccugaucaacucuauuggaaaucugaucgcuccuagaggcuauuuuaagauucgguccgggaaaagcucuaucaugcgcagcgacgcccccauuggaaaguguaaguccgaaugcaucaccccgaacggcucuaucccuaaugauaaacccuuccagaacgugaauagaauuaccuacggcgcuuguccucgguaugugaagcacagcacacucaaacuggccacggggaugcgcaacguccccgagaagcagaccagaggaaucuuuggcgcgauugccggguucaucgaaaauggaugggagggcaugguugacgggugguacggauuucggcaccagaacuccgagggcagaggccaagcugccgaucuuaaaagcacacaggcugccauugaccagaucaaugggaagcugaaccgccucauuggaaaaaccaaugaaaaguuccaucaaaucgagaaggaguucucugaaguggaaggccggauccaggaucuggagaaauauguggaggacacaaagauugaucuuugguccuacaacgccgaacugcucgucgcucuggagaaucagcacaccaucgaccugacggauagcgaaaugaacaaacucuuugagaagacaaagaagcagcugagagaaaacgcggaggacauggggaauggaugcuucaagauuuaucauaaaugugauaacgccugcaucggcucuauucgcaaugggaccuacgaccacaacguguaccgggacgaggcucuuaauaacagauuucaaaucaagggcguugaacugaaauccggauauaaggauuggauccucuggauuagcuucgccaucuccugcuuucugcuuuguguggcccugcucggcuucauuaugugggcuugccagaaagggaauauccgcuguaacauuugcaucuga

SEQ ID NO: 196387 - RNA, 1701 nt, Artificial Sequence; identical to SEQ ID NO: 196009
  derived and/or modified sequence opt5 from hemagglutinin__InfluenzaA__ALE31852

SEQ ID NO: 196388 - RNA, 1701 nt, Artificial Sequence
  derived and/or modified sequence opt5 from hemagglutinin__InfluenzaA__ALE31853
augaagaccaucauugcccugagcuacauccucugccugguguucacacagaaaauucccggcaacgacaauuccacggcuacccuuugucuggggcaccaugccgucccuaacggaacaaucguuaagaccauuacaaaugauagaaucgaggugaccaacgcgacagaacucgugcaaaauucuagcaucggcgagauuugcgacuccccgcaccagauccuggauggggaaaacuguacccuuauugacgcucugcucggagauccccagugcgacggcuuucagaauaaaaagugggaucuguucgucgagcggucuaaagccuauagcaacuguuacccuuaugacgugcccgauuacgccucccugcgcucucucguugcuagcuccgggacgcuggaauuuaauaacgagagcuucaauuggaccggagugacacaaaacggcaccucuuccgccugcaucagacggagcagcuccagcuuuuucucucgccuuaauuggcugacacaucucaacuauaccuacccugcucugaaugucacgaugcccaacaacgagcaguuugacaaacuuuauauuuggggcgugcaccauccugggacagauaaggaccagaucuuccuguacgcccaguccagcggaagaauuaccguuuccacaaagcggucucaacaggcggugaucccgaauaucggcagccgcccccggauuagagauaucccuucccgcauuagcaucuacuggaccauugucaagcccggggacauccuccugaucaacucuaccggaaaucugauugccccuagaggcuauuuuaaaauccgguccgggaagucuucuauuaugcgcagcgacgcucccaucggaaaauguaaguccgaaugcauuacaccgaacggcucuaucccuaaugauaagcccuuccagaacgugaauagaaucacguacggcgccuguccucgguaugugaaacacagcacccucaagcuggcuacagggaugcgcaacguccccgagaaacagaccagaggaauuuuuggcgccaucgcgggguucauugaaaauggaugggagggcaugguugacgggugguacggauuucggcaccaaaacuccgagggcagaggccaggccgcugaucuuaagagcacacaggccgcuaucgaccaaauuaaugggaaacugaaccgccucaucggaaagaccaaugaaaaauuccaucagauugagaaggaguucucugaaguggaaggccggauccaggaucuggagaaguauguggaggacacgaaaaucgaucuuugguccuacaacgccgaacugcucgucgcccuggagaaucagcacacaauugaccugaccgauagcgaaaugaacaagcucuuugagaaaaccaagaaacaacugagagaaaacgcugaggacauggggaauggaugcuucaagaucuaucauaagugugauaacgcgugcauuggcucuauccgcaaugggacauacgaccacaacguguaccgggacgaggcccuuaauaacagauuucagauuaaaggcguugaacugaaguccggauauaaagauuggauccucuggaucagcuucgcuauuuccugcuuucugcuuuguguggcccugcucggcuucaucaugugggccugccagaaggggaauauucgcuguaacaucugcauuuga

SEQ ID NO: 196389 - RNA, 1701 nt, Artificial Sequence
  derived and/or modified sequence opt5 from hemagglutinin__InfluenzaA__ALE31854
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgagauccagcggacggauuacaguuuccaccaagggcucucagcaagccgugaucccgaauaucgggagccgcccccggauuagagauaucccuucccgcauuagcaucuacuggacaauugucaagcccggagacauccuccugaucaacucuaccggcaaucugauugcuccuagaggguauuuuaaaauccgguccggaaagagcucuauuaugcgcagcgacgcccccaucggcagauguaaauccgaaugcauuaccccgaacggcucuaucccuaaugauaagcccuuccagaacgugaaucggaucacauacggggcuuguccucgcuaugugaagcacagcacgcucaaacuggccaccggaaugagaaacguccccgagaagcagacacggggcauuuuuggggcgaucgccggauucauugaaaauggcugggaggggaugguugacggaugguacggcuuuagacaccagaacuccgagggccgcgggcaagcugccgaucuuaaaagcacccaggcugccaucgaccagauuaauggaaagcugaaccggcucaucggcaaaacaaaugaaaaguuccaucaaauugagaaagaguucucugaaguggaagggagaauccaggaucuggagaaguauguggaggacaccaagaucgaucuuugguccuacaacgccgaacugcucgucgcucuggagaaucagcacacgauugaccugacagauagcgaaaugaacaaacucuuugagaagaccaaaaagcagcugcgcgaaaacgcggaggacaugggaaauggcugcuucaaaaucuaucauaagugugauaacgccugcauugggucuauccggaauggcaccuacgaccacaacguguacagagacgaggcucuuaauaaccgcuuucaaauuaagggaguugaacugaaauccggcuauaaggauuggauccucuggaucagcuucgccauuuccugcuuucugcuuuguguggcccugcucggguucaucaugugggcuugccagaaaggaaauauucgguguaacaucugcauuuga

SEQ ID NO: 196390 - RNA, 1701 nt, Artificial Sequence; identical to SEQ ID NO: 196151
  derived and/or modified sequence opt5 from hemagglutinin__InfluenzaA__ALE31855

SEQ ID NO: 196391 - RNA, 1701 nt, Artificial Sequence; identical to SEQ ID NO: 195465
  derived and/or modified sequence opt5 from hemagglutinin__InfluenzaA__ALE31856

SEQ ID NO: 196392 - RNA, 1701 nt, Artificial Sequence; identical to SEQ ID NO: 195465
  derived and/or modified sequence opt5 from hemagglutinin__InfluenzaA__ALE31857

SEQ ID NO: 196393 - RNA, 1701 nt, Artificial Sequence
  derived and/or modified sequence opt5 from hemagglutinin__InfluenzaA__ALE31858
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaaguauacauacccugcccugaacgucaccaugcccaauaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaacaucggcagccgcccccggauuagagauaucccuucccgcauuagcaucuacuggacaauugucaaacccggggacauccuccugaucaauucuaccggaaaccugauugcuccuagaggcuauuuuaagauccgguccgggaaaagcucuauuaugcgcagcgacgcccccaucggaaaguguaaguccgaaugcauuaccccgaauggcucuaucccuaacgauaaacccuuccagaaugugaacagaaucacauacggcgcuuguccucgguaugugaagcacagcacgcucaaacuggccaccgggaugcgcaauguccccgagaagcagacaagaggaauuuuuggcgcgaucgccggguucauugaaaacggaugggagggcaugguugacgggugguacggauuucggcaccaaaauuccgagggcagaggccaggcugccgaucuuaaaagcacccaggcugccaucgaccaaauuaacgggaagcugaaucgccucaucggaaaaacaaacgaaaaguuccaucagauugagaaggaguucucugaaguggaaggccggauccaggaucuggagaaauauguggaggacaccaagaucgaucuuugguccuacaaugccgaacugcucgucgcucuggagaaccagcacacgauugaccugacagauagcgaaaugaauaaacucuuugagaagaccaaaaagcaacugagagaaaacgcggaggacauggggaacggaugcuucaagaucuaucauaaaugugauaaugccugcauuggcucuauccgcaacgggaccuacgaccacaauguguaccgggacgaggcucuuaacaauagauuucagauuaagggcguugaacugaaauccggauauaaggauuggauccucuggaucagcuucgccauuuccugcuuucugcuuuguguggcccugcucggcuucaucaugugggcuugccagaaagggaacauucgcuguaauaucugcauuuga

SEQ ID NO: 196394 - RNA, 1701 nt, Artificial Sequence
  derived and/or modified sequence opt5 from hemagglutinin__InfluenzaA__ALE31859
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaccagacggagcagcuccagcuuuuucucucgccuuaauuggcugacacaucucaacuauaccuacccugcccugaaugucacgaugcccaacaacgagcaguuugacaaacuuuauaucuggggcgugcaccauccugggacagauaaggaccagauuuuccuguacgcgcaguccagcggaagaaucaccguuuccacaaagcggucucaacaggccgugauuccgaauaucggcagccgccccagaauccgggauauuccuucccgcaucagcauuuacuggaccaucgucaagcccggggacaugcuccugauuaacucuaccggaaaucugaucgcuccuagaggcuauuuuaaaauccgguccgggaagucuucuauuaugcgcagcgacgcccccaucggaaaauguaaguccgaaugcauuacaccgaacggcucuaucccuaaugauaagcccuuccagaacgugaauagaauuacguacggcgcuuguccucgguaugugaaacacagcacccucaagcuggccacagggaugcgcaacguccccgagaaacagaccagaggaaucuuuggcgcgaucgccggguucauugaaaauggaugggagggcaugguugacgggugguacggauuucggcaccaaaacuccgagggcagaggccaggcugccgaucuuaagagcacacaggcugccaucgaccaaauuaaugggaaacugaaccgccucaucggaaagaccaaugaaaaauuccaucagauugagaaggaguucucugaaguggaaggccggauccaggaucuggagaaguauguggaggacacgaaaauugaucuuugguccuacaacgccgaacugcucgucgcucuggagaaucagcacacaaucgaccugaccgauagcgaaaugaacaagcucuuugagaaaaccaagaaacaacugagagaaaacgcggaggacauggggaauggaugcuucaagaucuaucauaagugugauaacgccugcauuggcucuauccgcaaugggacauacgaccacaacguguaccgggacgaggcucuuaauaacagauuucagauuaaaggcguugaacugaaguccggauauaaagauuggauccucuggauuagcuucgccaucuccugcuuucugcuuuguguggcccugcucggcuucaucaugugggcuugccagaaggggaauauucgcuguaacaucugcauuuga

SEQ ID NO: 196395 - RNA, 1701 nt, Artificial Sequence
  derived and/or modified sequence opt5 from hemagglutinin__InfluenzaA__ALE31860
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcaaaauuugcgacuccccgcaccagauccuggauggggagaacuguacacuuauugacgcccugcucggagauccccagugcgacggcuuucagaauaagaaaugggaucuguucgucgaacggucuaaggccuauagcaacuguuacccuuaugacgugcccgauuacgcuucccugcgcucucucguugccagcuccgggacccuggaguuuaauaacgaaucuuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaaacccggggacauccuccugaucaacucuaccggaaaucugauugcuccuagaggcuauuuuaagauccgguccggggagagcucuauuaugcgcagcgacgcccccaucggaaaauguaaguccgaaugcauuaccccgaacggcucuaucccuaaugauaagcccuuccagaacgugaauagaaucacauacggcgcuuguccucgguaugugaaacacagcacgcucaagcuggccaccgggaugcgcaacguccccgagaaacagacaagaggaauuuuuggcgcgaucgccggguucauugaaaauggaugggagggcaugguugacgggugguacggauuucggcaccaaaacuccgagggcagaggccaggcugccgaucuuaagagcacccaggcugccaucgaccaaauuaaugggaaacugaaccgccucaucggaaagacaaaugaaaaauuccaucagauugagaaggaguucucugaaguggaaggccggauccaggaucuggagaaguauguggaggacaccaaaaucgaucuuugguccuacaacgccgaacugcucgucgcucuggagaaucagcacacgauugaccugacagauagcgaaaugaacaagcucuuugagaaaaccaagaaacaacugagagaaaacgcggaggacauggggaauggaugcuucaagaucuaucauaagugugauaacgccugcauuggcucuauccgcaaugggaccuacgaccacaacguguaccgggacgaggcucuuaauaacagauuucagauuaaaggcguugaacugaaguccggauauaaagauuggauccucuggaucagcuucgccauuuccugcuuucugcuuuguguggcccugcucggcuucaucaugugggcuugccagaaggggaauauucgcuguaacaucugcauuuga

SEQ ID NO: 196396 - RNA, 1701 nt, Artificial Sequence; identical to SEQ ID NO: 195465
  derived and/or modified sequence opt5 from hemagglutinin__InfluenzaA__ALE31861

SEQ ID NO: 196397 - RNA, 1701 nt, Artificial Sequence
  derived and/or modified sequence opt5 from hemagglutinin__InfluenzaA__ALE31862
augaagaugaucauugcccugagcuacauccucugccugguguucgcucagaaaauucccggcaacgacaauuccaccgccacacuuugucuggggcaccaugcggucccuaacggaacgaucguuaagaccauuacaaaugauagaaucgaggugaccaacgcuacagaacucgugcaaaauucuagcaucggcgagauuugcgacuccccgcaccagauccuggauggggaaaacuguacccuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacacuggaauuuaauaacgagagcuucaauuggaccggagugacgcaaaacggcaccucuuccgcuugcaucagaaagucuagcuccagcuuuuucucucggcuuaauuggcugacacaucucaacuauaccuacccugcccugaaugucacaaugcccaacaacgagcaguuugacaaacuuuauauuuggggcgugcaccauccugggaccgauaaagaccagaucuuccuguacgcgcgcuccagcggaagaauuacgguuuccacaaagcggucucagcaagccgugaucccgaauaucggcagccgcccccggauuagagauaucccuucccgcauuagcaucuacuggaccauugucaaacccggggacauccuccugaucaacucuacaggaaaucugauugcuccuagaggcuauuuuaagauccgguccgggaaaagcucuauuaugcgcagcgacgcccccaucggaaaguguaaguccgaaugcauuaccccgaacggcucuaucccuaaugauaaacccuuccagaacgugaauagaaucaccuacggcgcuuguccucgguaugugaagcacagcacacucaaacuggccacggggaugcgcaacguccccgagaagcagaccagaggaauuuuuggcgcgaucgccggguucauugaaaauggaugggagggcaugguugacgggugguacggauuucggcaccagaacuccgagggcagaggccaagcugccgaucuuaaaagcacacaggcugccaucgaccagauuaaugggaagcugaaccgccucaucggaaaaaccaaugaaaaguuccaucaaauugagaaggaguucucugaaguggaaggccggauccaggaucuggagaaauauguggaggacacaaagaucgaucuuugguccuacaacgccgaauuucuggucgcucucgagaaucagcacaccauugaccugacggauagcgaaaugaacaaacuguucgagaagacaaagaagcagcucagagaaaacgcggaggacauggggaauggaugcuuuaagaucuaucauaaaugugauaacgccugcauuggcucuauccgcaaugggaccuacgaccacaacguguaccgggacgaggcucugaauaacagauuccaaauuaagggcguugaacuuaaauccggauauaaggauuggauccuguggaucagcuuugccauuuccugcuuccuccuguguguggcccuucugggcuuuaucaugugggcuugccagaaagggaauauucgcuguaacaucugcauuuga

SEQ ID NO: 196398 - RNA, 1701 nt, Artificial Sequence; identical to SEQ ID NO: 196123
  derived and/or modified sequence opt5 from hemagglutinin__InfluenzaA__ALE31863

SEQ ID NO: 196399 - RNA, 1701 nt, Artificial Sequence; identical to SEQ ID NO: 196123
  derived and/or modified sequence opt5 from hemagglutinin__InfluenzaA__ALE31865

SEQ ID NO: 196400 - RNA, 1701 nt, Artificial Sequence; identical to SEQ ID NO: 196123
  derived and/or modified sequence opt5 from hemagglutinin__InfluenzaA__ALE31866

SEQ ID NO: 196401 - RNA, 1701 nt, Artificial Sequence
  derived and/or modified sequence opt5 from hemagglutinin__InfluenzaA__ALE31867
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaaagucuagcuccagcuuuuucucucggcuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcgcuccagcggaagaauuacaguuuccaccaagcggucucagcaagccgugaucccgaauaucggcagccgcccccggauuagagauaucccuucccgcauuagcaucuacuggacaauugucaaacccggggacauccuccugaucaacucuaccggaaaucugauugcuccuagaggcuauuuuaagauccgguccgggaaaagcucuauuaugcgcagcgacgcccccaucggaaaguguaaguccgaaugcauuaccccgaacggcucuaucccuaaugauaaacccuuccagaacgugaauagaaucacauacggcgcuuguccucgguaugugaagcacagcacgcucaaacuggccaccgggaugcgcaacguccccgagaagcagacaagaggaauuuuuggcgcgaucgccggguucauugaaaauggaugggagggcaugguugacgggugguacggauuucggcaccagaacuccgagggcagaggccaagcugccgaucuuaaaagcacccaggcugccaucgaccagauuaaugggaagcugaaccgccucaucggaaaaacaaaugaaaaguuccaucaaauugagaaggaguucucugaaguggaaggccggauccaggaucuggagaaauauguggaggacaccaagaucgaucuuugguccuacaacgccgaacugcucgucgcucuggagaaucagcacacgauugaccugacagauagcgaaaugaacaaacucuuugagaagaccaaaaagcagcugagagaaaacgcggaggacauggggaauggaugcuucaagaucuaucauaaaugugauaacgccugcauuggcucuauccgcaaugggaccuacgaccacaacguguaccgggacgaggcucuuaauaacagauuucaaauuaagggcguugaacugaaauccggauauaaggauuggauccucuggaucagcuucgccauuuccugcuuucugcuuuguguggcccugcucggcuucaucaugugggcuugccagaaugggaacauucgcuguaauaucugcauuuga

SEQ ID NO: 196402 - RNA, 1701 nt, Artificial Sequence; identical to SEQ ID NO: 195465
  derived and/or modified sequence opt5 from hemagglutinin__InfluenzaA__ALE31868

SEQ ID NO: 196403 - RNA, 1701 nt, Artificial Sequence; identical to SEQ ID NO: 196401
  derived and/or modified sequence opt5 from hemagglutinin__InfluenzaA__ALE31869

SEQ ID NO: 196404 - RNA, 1701 nt, Artificial Sequence; identical to SEQ ID NO: 196401
  derived and/or modified sequence opt5 from hemagglutinin__InfluenzaA__ALE31870

SEQ ID NO: 196405 - RNA, 1701 nt, Artificial Sequence
  derived and/or modified sequence opt5 from hemagglutinin__InfluenzaA__ALE31871
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcaacuccccgcaccagauccuggacggggaaaauuguacacuuauugaugcccugcucggagacccccagugcgauggcuuucagaacaaaaagugggaccuguucgucgagcggucuaaagccuauagcaauuguuacccuuaugaugugcccgacuacgcuucccugcgcucucucguugccagcuccgggacccuggaauuuaacaaugagagcuucaacuggacgggagugacccaaaauggcacaucuuccgcuugcaucagaaaguccucuuccagcuuuuucucucggcuuaacuggcugacccaucucaauuauacauacccugcccugaacgucaccaugcccaacaaugagcaguuugauaaacuuuauauuuggggcgugcaccauccugggacggacaaggaucagaucuuccuguacgcgcgcuccagcggaagaauuacaguuuccaccaagcggucucagcaagccgugaucccgaacaucggcagccgcccccggauuagagacaucccuucccgcauuagcaucuacuggacaauugucaaacccggggauauccuccugaucaauucuaccggaaaccugauugcuccuagaggcuauuuuaagauccgguccgggaaaagcucuauuaugcgcagcgacgcccccaucggaaaguguaaguccgaaugcauuaccccgaauggcucuaucccuaacgacaaacccuuccagaaugugaacagaaucacauacggcgcuuguccucgguaugugaagcacagcacgcucaaacuggccaccgggaugcgcaauguccccgagaagcagacaagaggaauuuuuggcgcgaucgccggguucauugaaaacggaugggagggcaugguugaugggugguacggauuucggcaccagaauagcgagggcagaggccaagcugccgaccuuaaaagcacccaggcugccaucgaucagauuaacgggaagcugaaucgccucaucggaaaaacaaacgaaaaguuccaucaaauugagaaggaguucucugaaguggaaggccggauccaggaccuggagaaauauguggaggauaccaagaucgaccuuugguccuacaaugccgaacugcucgucgcucuggagaaccagcacacgauugaucugacagacagcgaaaugaacaaacucuuugagaagaccaaaaagcagcugagagaaaaugcggaggauauggggaacggaugcuucaagaucuaucauaaaugugacaaugccugcauuggcucuauccgcaacgggaccuacgaucacaauguguaccgggacgaggcucuuaacaauagauuucaaauuaagggcguugaacugaaauccggauauaaggacuggauccucuggaucagcuucgccauuuccugcuuucugcuuuguguggcccugcucggcuucaucaugugggcuugccagaaagggaacauucgcuguaauaucugcauuuga

SEQ ID NO: 196406 - RNA, 1701 nt, Artificial Sequence; identical to SEQ ID NO: 195451
  derived and/or modified sequence opt5 from hemagglutinin__InfluenzaA__ALE31872

SEQ ID NO: 196407 - RNA, 1701 nt, Artificial Sequence; identical to SEQ ID NO: 195465
  derived and/or modified sequence opt5 from hemagglutinin__InfluenzaA__ALE31873

SEQ ID NO: 196408 - RNA, 1701 nt, Artificial Sequence
  derived and/or modified sequence opt5 from hemagglutinin__InfluenzaA__ALE31874
augaagaccaucauugcccugagcuacauccucugccugguguucgcucagaaacuucccggcaacgacaauuccgccgcgacacugugucucgggcaccaugcugucccuaacggaacgauuguuaagaccaucacaaaugauagaauugaggugaccaacgccacagaacuggugcaaaauucuagcaucggcgagaucugcgacuccccgcaccagauucuugauggggaaaacuguacccugaucgacgcccuccugggagauccccagugcgacggcuuucagaauaaaaagugggaucuguucgucgagcggucuaaagcucauagcaacuguuauccuuacgacgugcccgauuaugccucccuccgcucucugguugcuagcuccgggacacuugaauuuaauaacgagagcuucaauugggccggagugacccaaaacggcacgucuuccagcugcauuagaggcucuaauuccagcuuuuucucucggcugaacuggcucacccaccuuaauuccaaguacccugcgcugaacgucacaaugcccaacaaugagcaguuugacaagcuguauaucuggggagugcaucacccugggaccgauaaagaccagauuuuccucuacgcccagagcuccggccgcaucacaguuucuaccaagagaagccaacaggcugugauuccgaacaucgggucccggccccgcaucagagauauuccuagccggaucucuauuuauuggacgaucgucaaacccggagacauucugcugaucaauuccacaggcaaccucaucgccccucgcggguacuuuaagauuagaagcggaaaaucuagcaucaugcgguccgacgcucccauuggcaaguguaagucugaaugcaucaccccgaauggcagcauuccuaacgauaaacccuuccagaaugugaaccgcaucacauacggggccuguccuagauaugugaagcaguccacccugaaacuugcgaccggaaugcggaauguccccgagaagcaaacacgcggcaucuuuggggccauugcuggauucaucgaaaacggcugggaggggaugguugacggaugguacggcuuuagacaccagaauagcgagggccgggggcaggccgcugaucugaaaucuacgcaagccgccauugaccagaucaacggaaagcucaauagacugauuggcaaaaccaacgaaaaguuccaucagaucgagaaggaguucuccgaaguggaagggcgcauucaggaucuugagaaauauguggaggacacaaagaucgaucuguggagcuacaaugcugaacuccuggucgcgcuggagaaccaacacaccaucgaccucacagauucugaaaugaacaaacuguuugagaagaccaaaaagcagcuucgggaaaaugccgaggacaugggaaacggcugcuucaagauuuaucauaaaugugauaaugcuugcaucggguccauuagaaacggcacguacgaccacgacguguaucgcgaugaggcccugaauaaccgguuucagaucaagggaguugaacucaaaagcggcuacaaggacuggauucuguggaucuccuucgccaucucuugcuuucuucuguguguggcucuccugggguucauuaugugggccugccagaaaggaaauaucagauguaacauuugcaucuga

SEQ ID NO: 196409 - RNA, 1701 nt, Artificial Sequence; identical to SEQ ID NO: 196408
  derived and/or modified sequence opt5 from hemagglutinin__InfluenzaA__ALE31875

SEQ ID NO: 196410 - RNA, 1701 nt, Artificial Sequence; identical to SEQ ID NO: 196408
  derived and/or modified sequence opt5 from hemagglutinin__InfluenzaA__ALE31876

SEQ ID NO: 196411 - RNA, 1701 nt, Artificial Sequence
  derived and/or modified sequence opt5 from hemagglutinin__InfluenzaA__ALE31877
augaagaccaucauugcccugagcuacauccucugccugguguucgcucagaaacuucccgagaacgacaauuccacagccacgcugugucucggccaccaugcggucccuaacgggaccauuguuaagacaaucaccucugauagaauugaagugacaaaugcuaccgagcuggugcaaaacagcuccaucggagaaaucugcgacucuccgcaccagauucuugauggcaaaaauuguacacugaucgacgcccuccugggggauccccagugcgacggauuucagaacaagaaaugggaucuguucgucgagcggagcaaggccuauuccaauuguuacccuuaugacgugcccgauuacgcuucucuccgcagccugguugccuccagcggcacccuugaauuuaacgacgagucuuucaauugggcuggggugacgcaaaacggaaccuccagcgccugcauuagaggcucuaauuccagcuuuuucucucggcugaacuggcucacacauuccaauuuuaaguauccugcgcugaacgucaccaugcccaauaacgagcaguucgauaaacuuuacaucuggggcgugcaccauccugggacagacaaggaucagauuuuucuguaugcccagagcuccggacgcaucaccguuucuacgaaaagaagccaacaggcugugauuccgaacaucggcucccggccccgcaucagaaauauuccuagccggaucucuauuuacuggacaaucgucaagcccggggacauucuccugaucaacuccaccggaaaucugaucgccccucgcggcuacuucaaaauuagaagcgggaagucuagcaucaugcgguccgacgcucccauuggaaaguguaaaucugaaugcaucacaccgaacggcagcauuccuaaugauaagcccuuucagaacgugaaucgcaucaccuauggcgccuguccuagauacgugaaacaguccacccucaagcuggcgacagggaugcggaacguccccgagaaacaaacgcgcggaaucuucggcgccauugcuggguuuaucgaaaauggaugggagggcaugaaggacgggugguauggauucagacaccagaacagcgagggccggggccaggccgcugaucuuaaaucuacccaagccgccauugaccagaucaaugggaagcugaacagacucauuggaaagacaaaugaaaaauuccaccagaucgagaaggaauuuuccgagguugaaggccgcauucaggaucuggagaaauacguggaggacaccaagaucgaucuuuggagcuauaacgcugaacugcucguggcgcuggagaaucaacauacaaucgaccugaccgauucugaaauuaacaaacucuucgagaagacgaagaaacagcugcgggaaaacgccgaggacauggggaauggaugcuuuaagaucuaccacaaaugugauaacgcuugcauuggcuccaucagaaaugggacauaugaccaugacgucuaccgcgaugaggcccuuaacaaucgguuccagauuaagggcguggaacugaaaagcggauacaaggacuggauccucuggaucuccuuugccauuucuugcuuccugcuuuguguugcucugcucggcuuuaucaugugggccugccagaaggggaacauuagauguaauaucugcauuuga

SEQ ID NO: 196412 - RNA, 1701 nt, Artificial Sequence; identical to SEQ ID NO: 195465
  derived and/or modified sequence opt5 from hemagglutinin__InfluenzaA__ALE31878

SEQ ID NO: 196413 - RNA, 1701 nt, Artificial Sequence; identical to SEQ ID NO: 195465
  derived and/or modified sequence opt5 from hemagglutinin__InfluenzaA__ALE31879

SEQ ID NO: 196414 - RNA, 1701 nt, Artificial Sequence; identical to SEQ ID NO: 195465
  derived and/or modified sequence opt5 from hemagglutinin__InfluenzaA__ALE31880

SEQ ID NO: 196415 - RNA, 1701 nt, Artificial Sequence
  derived and/or modified sequence opt5 from hemagglutinin__InfluenzaA__ALE31881
augaagaccaucauugcccugagccacauccucugccugguguucgcucagaaaauucccggcaacgacaauuccacagccacgcuuugucuggggcaucacgcggucccuaacggaaccaucguuaagacaauuaccaaugauagaaucgaggugacaaacgcuaccgaacucgugcaaaauucuagcaucggcgagauuugcgacuccccgcaucagauccuggauggggaaaacuguacacuuauugacgcccugcucggagauccccagugcgacggcuuucagaauaaaaagugggaucuguucgucgagcggucuaaagccuacagcaacuguuauccuuacgacgugcccgauuaugcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaccucaacuacacauauccugcccugaaugucaccaugcccaacaacgagcaguuugacaaacuuuacauuuggggcgugcaucacccugggacggauaaggaccagaucuuccuguaugcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugguggcuccuagaggcuacuuuaaaauucgguccgggaagucuucuaucaugcgcagcgacgcccccauuggaaaauguaaguccgaaugcaucaccccgaacggcucuauuccuaaugauaagcccuuccagaacgugaauagaaucacauauggcgcuuguccucgguacgucaaacacagcacgcucaagcuggccaccgggaugcgcaacguucccgagaaacagacaagaggaaucuuuggcgcgauugccggguucaucgaaaauggaugggagggcaugguggacgggugguauggauuucggcaucaaaacuccgagggcagaggccaggcugccgaucuuaagagcacccaggcugccauugaccaaaucaaugggaaacugaaccgccucauuggaaagacaaaugaaaaauuccaccagaucgagaaggaguucucugaaguggaaggccggauucaggaucuggagaaguacgucgaggacaccaaaaucgaucuuugguccuauaacgccgaacugcucguggcucuggagaaucagcauacgaucgaccugacagauagcgaaaugaacaagcucuuugagaaaaccaagaaacaacugagagaaaacgcggaggacauggggaauggaugcuucaagauuuaccacaagugugauaacgccugcaucggcucuauucgcaaugggaccuaugaccacaacguuuaccgggacgaggcucuuaauaacagauuucagaucaaaggcauugaacugaaguccggauacaaagauuggauccucuggaucagcuucgccauuuccugcuuucugcuuuguguggcccugcucggcuucaucaugugggcuugccagaaggggaauauucgcuguaacaucugcauuuga

SEQ ID NO: 196416 - RNA, 1701 nt, Artificial Sequence; identical to SEQ ID NO: 195465
  derived and/or modified sequence opt5 from hemagglutinin__InfluenzaA__ALE31882

SEQ ID NO: 196417 - RNA, 1701 nt, Artificial Sequence; identical to SEQ ID NO: 195465
  derived and/or modified sequence opt5 from hemagglutinin__InfluenzaA__ALE31888

SEQ ID NO: 196418 - RNA, 1701 nt, Artificial Sequence; identical to SEQ ID NO: 195465
  derived and/or modified sequence opt5 from hemagglutinin__InfluenzaA__ALE31889

SEQ ID NO: 196419 - RNA, 1701 nt, Artificial Sequence; identical to SEQ ID NO: 196123
  derived and/or modified sequence opt5 from hemagglutinin__InfluenzaA__ALE31890

SEQ ID NO: 196420 - RNA, 1701 nt, Artificial Sequence; identical to SEQ ID NO: 196123
  derived and/or modified sequence opt5 from hemagglutinin__InfluenzaA__ALE31891

SEQ ID NO: 196421 - RNA, 1701 nt, Artificial Sequence; identical to SEQ ID NO: 195465
  derived and/or modified sequence opt5 from hemagglutinin__InfluenzaA__ALE31892

SEQ ID NO: 196422 - RNA, 1701 nt, Artificial Sequence; identical to SEQ ID NO: 195465
  derived and/or modified sequence opt5 from hemagglutinin__InfluenzaA__ALE31893

SEQ ID NO: 196423 - RNA, 1701 nt, Artificial Sequence; identical to SEQ ID NO: 196071
  derived and/or modified sequence opt5 from hemagglutinin__InfluenzaA__ALE31894

SEQ ID NO: 196424 - RNA, 1701 nt, Artificial Sequence; identical to SEQ ID NO: 195451
  derived and/or modified sequence opt5 from hemagglutinin__InfluenzaA__ALE31895

SEQ ID NO: 196425 - RNA, 1701 nt, Artificial Sequence; identical to SEQ ID NO: 195465
  derived and/or modified sequence opt5 from hemagglutinin__InfluenzaA__ALE31896

SEQ ID NO: 196426 - RNA, 1701 nt, Artificial Sequence; identical to SEQ ID NO: 195465
  derived and/or modified sequence opt5 from hemagglutinin__InfluenzaA__ALE31897

SEQ ID NO: 196427 - RNA, 1701 nt, Artificial Sequence; identical to SEQ ID NO: 195465
  derived and/or modified sequence opt5 from hemagglutinin__InfluenzaA__ALE31898

SEQ ID NO: 196428 - RNA, 1701 nt, Artificial Sequence
  derived and/or modified sequence opt5 from hemagglutinin__InfluenzaA__ALE31899
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaaagucuagcuccagcuuuuucucucggcuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcgcuccagcggaagaauuacaguuuccaccaagcggucucagcaagccgugaucccgaauaucggcagccgcccccggauuagagauaucccuucccgcauuagcaucuacuggacaauugucaaacccggggacauccuccugaucaacucuaccggaaaucugauugcuccuagaggcuauuuuaagauccgguccgggaaaagcucuaugaugcgcagcgacgcccccauuggaaaguguaaguccgaaugcaucaccccgaacggcucuauuccuaaugauaaacccuuccagaacgugaauagaaucacauacggcgcuuguccucgguaugugaagcacagcacgcucaaacuggccaccgggaugcgcaacguccccgagaagcagacaagaggaaucuuuggcgcgauugccggguucaucgaaaauggaugggagggcaugguugacgggugguacggauuucggcaccagaacuccgagggcagaggccaagcugccgaucuuaaaagcacccaggcugccauugaccagaucaaugggaagcugaaccgccucauuggaaaaacaaaugaaaaguuccaucaaaucgagaaggaguucucugaaguggaaggccggauucaggaucuggagaaauauguggaggacaccaagaucgaucuuugguccuacaacgccgaacugcucgucgcucuggagaaucagcacacgaucgaccugacagauagcgaaaugaacaaacucuuugagaagaccaaaaagcagcugagagaaaacgcggaggacauggggaauggaugcuucaagauuuaucauaaaugugauaacgccugcaucggcucuauucgcaaugggaccuacgaccacaacguguaccgggacgaggcucuuaauaacagauuucaaaucaagggcguugaacugaaauccggauauaaggauuggauucucuggaucagcuucgccaucuccugcuuucugcuuuguguggcccugcucggcuucauuaugugggcuugccagaaagggaauauccgcuguaacauuugcaucuga

SEQ ID NO: 196429 - RNA, 1701 nt, Artificial Sequence; identical to SEQ ID NO: 196071
  derived and/or modified sequence opt5 from hemagglutinin__InfluenzaA__ALE31901

SEQ ID NO: 196430 - RNA, 1701 nt, Artificial Sequence
  derived and/or modified sequence opt5 from hemagglutinin__InfluenzaA__ALE31902
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgcccccaucggaaaauguaaguccgaaugcauuaccccgaacggcucuaucccuaaugauaagcccuuccagaacgugaauagaaucacauacggcgcuuguccucgguaugugaaacacagcacgcucaagcuggccaccgggaugcgcaacguccccgagaaacagacaagaggaauuuuuggcgcgaucgccggguucauugaaaauggaugggagggcaugguugacgggugguacggauuucggcaccaaaacuccgagggcagaggccaggcugccgaucuuaagagcacccaggcugccaucgaccaaauuaaugggaaacugaaccgccucaucggaaagacaaaugaaaaauuccaucagauugagaaggaguucucugaaguggaaggccggauccaggaucuggagaaguauguggaggacaccaaaaucgaucuuugguccuacaacgccgaacugcucgucgcucuggagaaucagcacacgauugaccugacagauagcgaaaugaacaagcucuuugagagaaccaaaaagcaacugcgcgaaaacgcggaggacauggggaauggaugcuucaaaaucuaucauaagugugauaacgccugcauuggcucuauccggaaugggaccuacgaccacaacguguacagagacgaggcucuuaauaaccgcuuucagauuaagggcguugaacugaaauccggauauaaggauuggauccucuggaucagcuucgccauuuccugcuuucugcuuuguguggcccugcucggcuucaucaugugggcuugccagaaagggaauauucgguguaacaucugcauuuga

SEQ ID NO: 196431 - RNA, 1701 nt, Artificial Sequence; identical to SEQ ID NO: 195465
  derived and/or modified sequence opt5 from hemagglutinin__InfluenzaA__ALE31903

SEQ ID NO: 196432 - RNA, 1701 nt, Artificial Sequence; identical to SEQ ID NO: 195465
  derived and/or modified sequence opt5 from hemagglutinin__InfluenzaA__ALE31904

SEQ ID NO: 196433 - RNA, 1701 nt, Artificial Sequence
  derived and/or modified sequence opt5 from hemagglutinin__InfluenzaA__ALE31905
augaagaccaucauugcccugggcuacauccucugccugggguucgcucagaaaauucccggaaacgacaauagcacagccacgcuuugucugggccaccaugcggugccuaacgggaccaucgucaagacaauuaccaaugauagaaucgagguuacaaacgcuaccgaacucgugcaaaauuccucuaucggagagauuugcgacagcccgcacaaaauccuggauggcgaaaacuguacacuuauugacgcccugcucggggauccccagugcgacggauuucagaauaagaaaugggaucuguucguggagcgguccaaggccuauucuaacuguuacccuuaugacguccccgauuacgcuagccugcgcucccucguggccucuagcggcacccuggaauuuaauaacgaguccuucaauuggacgggcguuacccagaacgggacaagcucugcuugcaucagacgguccucuagcuccuuuuucagccgccuuaauuggcugacccaucucaacuauacauacccugcccugaaugugaccaugcccaacaacgagcaauuugacaaacuuuauauuuggggaguccaccauccuggcacggauaaggaccagaucuuccuguacgcgcagucuuccgggagaauuacagugagcaccaagcggucccagcaagccguuaucccgaauaucggaucucgcccccggauuagagauaucccuagccgcauuuccaucuacuggacaauugugaaacccggcgacauccuccugaucaacagcaccgggaaucugauugcuccuagaggauauuuuaagauccggucuggcaaauccagcauuaugcgcucugacgcccccaucggcaaguguaagagcgaaugcauuaccccgaacggguccaucccuaaugauaaacccuuccagaacgucaauagaaucacauacggagcuuguccucgguaugugaagcacucuacgcucaaacuggccaccggcaugcgcaacgugcccgagaagcagacaagagggauuuuuggagcgaucgccggcuucauugaaaaugggugggagggaauggucgacggcugguacggcuuucggcaccagaacagcgaggggagaggacaagcugccgaucuuaaauccacccaggcugccaucgaccagauuaauggcaagcugaaccgccucaucgggaaaacaaaugaaaaguuccaucaaauugagaaggaguucagcgaaguugaaggacggauccaggaucuggagaaauauguggaggacaccaagaucgaucuuuggucuuacaacgccgaacugcucguggcucuggagaaucagcacacgauugaccugacagauuccgaaaugaacaaacucuuugagaagaccaaaaagcagcugagagaaaacgcggaggacaugggcaaugggugcuucaagaucuaucauaaaugugauaacgccugcauuggcagcauccgcaauggaaccuacgaccacaacgucuaccgggacgaggcucuuaauaacagauuucaaauuaagggcguggaacugaaaucuggguauaaggauuggauccucuggaucuccuucgccauuagcugcuuucugcuuuguguugcccugcucggauucaucaugugggcuugccagaaaggcaauauucgcuguaacaucugcauuuga

SEQ ID NO: 196434 - RNA, 1701 nt, Artificial Sequence; identical to SEQ ID NO: 195465
  derived and/or modified sequence opt5 from hemagglutinin__InfluenzaA__ALE31906

SEQ ID NO: 196435 - RNA, 1701 nt, Artificial Sequence
  derived and/or modified sequence opt5 from hemagglutinin__InfluenzaA__ALE31907
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauaaguacccugcccugaaugucacaaugcccaacaacgagcaguuugacaaacuuuauauuuggggcgugcaccauccugggaccgauaaagaccagaucuuccuguacgcgcaguccagcggaagaauuacgguuuccacaaagcggucucaacaggccgugaucccgaauaucggcagccgcccccggauuagagauaucccuucccgcauuagcaucuacuggaccauugucaaaucuggggacauccuccugaucaacuccacaggaaaucugauugcucccagaggcuauuuuaagauccggagcgggaaaucuagcauuaugcgcuccgacgccccuaucggaaaguguaagucugaaugcauuacccccaacggcagcaucccgaaugauaaaccuuuccagaacgugaauagaaucaccuacggcgcuuguccccgguaugugaagcacuccacacucaaacuggccacggggaugcgcaacgucccugagaagcagaccagaggaauuuuuggcgcgaucgccggguucauugaaaauggaugggagggcaugguugacgggugguacggauuucggcaccaaaacagcgagggcagaggccaggcugccgaucuuaaaucuacacaggcugccaucgaccaaauuaaugggaagcugaaccgccucaucggaaaaaccaaugaaaaguuccaucagauugagaaggaguucuccgaaguggaaggccggauccaggaucuggagaaauauguggaggacacaaagaucgaucuuuggagcuacaacgccgaacugcucgucgcucuggagaaucagcacaccauugaccugacggauucugaaaugaacaaacucuuugagaagacaaagaagcaacugagagaaaacgcggaggacauggggaauggaugcuucaagaucuaucauaaaugugauaacgccugcauuggcuccauccgcaaugggaccuacgaccacaacguguaccgggacgaggcucuuaauaacagauuucagauuaagggcguugaacugaaaagcggauauaaggauuggauccucuggaucuccuucgccauuucuugcuuucugcuuuguguggcccugcucggcuucaucaugugggcuugccagaaagggaauauucgcuguaacaucugcauuuga

SEQ ID NO: 196436 - RNA, 1701 nt, Artificial Sequence; identical to SEQ ID NO: 195465
  derived and/or modified sequence opt5 from hemagglutinin__InfluenzaA__ALE31908

SEQ ID NO: 196437 - RNA, 1701 nt, Artificial Sequence
  derived and/or modified sequence opt5 from hemagglutinin__InfluenzaA__ALE31909
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauacauacccugcccugaaugucaccaugcccaacaacgagcaguuugacaagcuguauauuuggggcgugcaccauccugggacggauaaggaccagaucuuccuguacgcgcaguccagcggaagaauuacaguuuccaccaaacggucucaacaggccgugaucccgaauaucggcagccgcccccggauuagagauaucccuucccgcauuagcaucuacuggacaauugucaagucuggggacauccuccugaucaacuccaccggaaaucugauugcucccagaggcuauuuuaaaauccggagcgggaagucuagcauuaugcgcuccgacgccccuaucggaaaauguaagucugaaugcauuacccccaacggcagcaucccgaaugauaagccuuuccagaacgugaauagaaucacauacggcgcuuguccccgguaugugaaacacuccacgcucaagcuggccaccgggaugcgcaacgucccugagaaacagacaagaggaauuuuuggcgcgaucgccggguucauugaaaauggaugggagggcaugguugacgggugguacggauuucggcaccaaaacagcgagggcagaggccaggcugccgaucuuaagucuacccaggcugccaucgaccaaauuaaugggaaacugaaccgccucaucggaaagacaaaugaaaaauuccaucagauugagaaggaguucuccgaaguggaaggccggauccaggaucuggagaaguauguggaggacaccaaaaucgaucuuuggagcuacaacgccgaacugcucgucgcucuggagaaucagcacacgauugaccugacagauucugaaaugaacaagcucuuugagaaaaccaagaaacaacugagagaaaacgcggaggacauggggaauggaugcuucaagaucuaucauaagugugauaacgccugcauuggcuccauccgcaaugggaccuacgaccacaacguguaccgggacgaggcucuuaauaacagauuucagauuaaaggcguugaacuuaagagcggauauaaagauuggauccucuggaucuccuucgccauuucuugcuuucugcuuuguguggcccugcucggcuucaucaugugggcuugccagaaggggaauauucgcuguaacaucugcauuuga

SEQ ID NO: 196438 - RNA, 1701 nt, Artificial Sequence; identical to SEQ ID NO: 195465
  derived and/or modified sequence opt5 from hemagglutinin__InfluenzaA__ALE31910

SEQ ID NO: 196439 - RNA, 1701 nt, Artificial Sequence; identical to SEQ ID NO: 196388
  derived and/or modified sequence opt5 from hemagglutinin__InfluenzaA__ALE31912

SEQ ID NO: 196440 - RNA, 1701 nt, Artificial Sequence
  derived and/or modified sequence opt5 from hemagglutinin__InfluenzaA__ALE31913
augaagaccaucauugcccugggcuacauccucugccugguguucgcucagaaaauucccgggaacgacaauagcacagccacgcuuugucugggacaccaugcggucccuaacggcaccaucguuaagacaauuaccaaugauagaaucgaggugacaaacgcuaccgaacucgugcaaaauuccucuaucggggagauuugcgacagcccgcacaaaauccuggauggagaaaacuguacacuuauugacgcccugcucggcgauccccagugcgacggguuucagaauaagaaaugggaucuguucgucgagcgguccaaggccuauucuaacuguuacccuuaugacgugcccgauuacgcuagccugcgcucccucguugccucuagcggaacccuggaauuuaauaacgaguccuucaauuggacgggcgugacccagaacggcacaagcucugcuugcaucagacgguccucuagcuccuuuuucagccgccuuaauuggcugacccaucucaacuauacauacccugcccugaaugucaccaugcccaacaacgagcaauuugacaaacuuuauauuuggggagugcaccauccugggacggauaaggaccagaucuuccuguacgcgcagucuuccggcagaauuacaguuagcaccaagcggucccagcaagccgugaucccgaauaucgggucucgcccccggauuagagauaucccuagccgcauuuccaucuacuggacaauugucaaacccggagacauccuccugaucaacagcaccggcaaucugauugcuccuagaggguauuuuaagauccggucuggaaaauccagcauuaugcgcucugacgcccccaucggcaaguguaagagcgaaugcauuaccccgaacggcuccaucccuaaugauaaacccuuccagaacgugaauagaaucacauacggggcuuguccucgguaugugaagcacucuacgcucaaacuggccaccggaaugcgcaacguccccgagaagcagacaagaggcauuuuuggggcgaucgccggauucauugaaaauggcugggaggggaugguugacggaugguacggcuuucggcaccagaacagcgagggcagagggcaagcugccgaucuuaaauccacccaggcugccaucgaccagauuaauggaaagcugaaccgccucaucggcaaaacaaaugaaaaguuccaucaaauugagaaggaguucagcgaaguggaagggcggauccaggaucuggagaaauauguggaggacaccaagaucgaucuuuggucuuacaacgccgaacugcucgucgcucuggagaaucagcacacgauugaccugacagauuccgaaaugaacaaacucuuugagaagaccaaaaagcagcugagagaaaacgcggaggacaugggaaauggcugcuucaagaucuaucauaaaugugauaacgccugcauugagagcauccgcaaugggaccuacgaccacaacguguaccgggacgaagcucuuaauaacagauuucaaauuaagggcguugagcugaaaucuggauauaaggauuggauccucuggaucuccuucgccauuagcugcuuucugcuuuguguggcccugcucggcuucaucaugugggcuugccagaaagggaauauucgcuguaacaucugcauuuga

SEQ ID NO: 196441 - RNA, 1701 nt, Artificial Sequence; identical to SEQ ID NO: 195465
  derived and/or modified sequence opt5 from hemagglutinin__InfluenzaA__ALE31914

SEQ ID NO: 196442 - RNA, 1701 nt, Artificial Sequence
  derived and/or modified sequence opt5 from hemagglutinin__InfluenzaA__ALE31915
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgaauacgcuucccugcgcucucucguugccagcuccgggacccuggaguuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgaacaguuugauaaacuuuauauuuggggcgugcaccauccugggacggacaaggaucagaucuuccuguacgcgcaguccagcggaagaauuacaguuuccaccaaacggucucaacaggccgugaucccgaauaucggcagccgcccccggauuagagacaucccuucccgcauuagcaucuacuggacaauugucaagcccggggauauccuccugaucaacucuaccggaaaucugauugcuccuagaggcuauuuuaaaauccgguccgggaagucuucuauuaugcgcagcgacgcccccaucggaaaauguaaguccgagugcauuaccccgaacggcucuaucccuaaugacaagcccuuccagaacgugaauagaaucacauacggcgcuuguccucgguaugugaaacacagcacgcucaagcuggccaccgggaugcgcaacguccccgaaaaacagacaagaggaauuuuuggcgcgaucgccggguucauugagaauggaugggagggcaugguugaugggugguacggauuucggcaccaaaacuccgaaggcagaggccaggcugccgaccuuaagagcacccaggcugccaucgaucaaauuaaugggaaacugaaccgccucaucggaaagacaaaugagaaauuccaucagauugaaaaggaguucucugaaguggagggccggauccaggaccuggagaaguauguggaagauaccaaaaucgaccuuugguccuacaacgccgagcugcucgucgcucuggaaaaucagcacacgauugaucugacagacagcgagaugaacaagcucuuugaaaagaccaagaaacaacugagagagaacgcggaggauauggggaauggaugcuucaagaucuaucauaagugugacaacgccugcauuggcucuauccgcaaugggaccuacgaucacaacguguaccgggacgaagcucuuaauaacagauuucagauuaaaggcguugagcugaaguccggauauaaagacuggauccucuggaucagcuucgccauuuccugcuuucugcuuuguguggcccugcucggcuucaucaugugggcuugccagaaggggaauauucgcuguaacaucugcauuuga

SEQ ID NO: 196443 - RNA, 1701 nt, Artificial Sequence; identical to SEQ ID NO: 195465
  derived and/or modified sequence opt5 from hemagglutinin__InfluenzaA__ALE31916

SEQ ID NO: 196444 - RNA, 1701 nt, Artificial Sequence; identical to SEQ ID NO: 195465
  derived and/or modified sequence opt5 from hemagglutinin__InfluenzaA__ALE31917

SEQ ID NO: 196445 - RNA, 1701 nt, Artificial Sequence; identical to SEQ ID NO: 195998
  derived and/or modified sequence opt5 from hemagglutinin__InfluenzaA__ALE31918

SEQ ID NO: 196446 - RNA, 1701 nt, Artificial Sequence; identical to SEQ ID NO: 196123
  derived and/or modified sequence opt5 from hemagglutinin__InfluenzaA__ALE31920

SEQ ID NO: 196447 - RNA, 1701 nt, Artificial Sequence; identical to SEQ ID NO: 195465
  derived and/or modified sequence opt5 from hemagglutinin__InfluenzaA__ALE31921

SEQ ID NO: 196448 - RNA, 1701 nt, Artificial Sequence; identical to SEQ ID NO: 195465
  derived and/or modified sequence opt5 from hemagglutinin__InfluenzaA__ALE31922

SEQ ID NO: 196449 - RNA, 1701 nt, Artificial Sequence; identical to SEQ ID NO: 196009
  derived and/or modified sequence opt5 from hemagglutinin__InfluenzaA__ALE31923

SEQ ID NO: 196450 - RNA, 1701 nt, Artificial Sequence; identical to SEQ ID NO: 195465
  derived and/or modified sequence opt5 from hemagglutinin__InfluenzaA__ALE31924

SEQ ID NO: 196451 - RNA, 1701 nt, Artificial Sequence; identical to SEQ ID NO: 195465
  derived and/or modified sequence opt5 from hemagglutinin__InfluenzaA__ALE31925

SEQ ID NO: 196452 - RNA, 1701 nt, Artificial Sequence
  derived and/or modified sequence opt5 from hemagglutinin__InfluenzaA__ALE31926
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagggauucaauuggacgggcgugacccaaaacggcacaagcucugcuugcaucagacgguccucuagcuccuuuuucagccgccuuaauuggcugacccaucucaacuauaaguacccugcccugaaugucacaaugcccaacaacgagcaguuugacaaacuuuauauuuggggagugcaccauccugggaccgauaaagaccagaucuuccuguacgcgcagucuuccggcagaauuacgguuagcacaaagcggucccaacaggccgugaucccgaauaucgggucucgcccccggauuagagauaucccuagccgcauuuccaucuacuggaccauugucaaacccggagacauccuccugaucaacagcacaggcaaucugauugcuccuagaggguauuuuaagauccggucuggaaaauccagcauuaugcgcucugacgcccccaucggcaaguguaagagcgaaugcauuaccccgaacggcuccaucccuaaugauaaacccuuccagaacgugaauagaaucaccuacggggcuuguccucgguaugugaagcacucuacacucaaacuggccacgggaaugcgcaacguccccgagaagcagaccagaggcauuuuuggggcgaucgccggauucauugaaaauggcugggaggggaugguugacggaugguacggcuuucggcaccaaaacagcgagggcagagggcaggcugccgaucuuaaauccacacaggcugccaucgaccaaauuaauggaaagcugaaccgccucaucggcaaaaccaaugaaaaguuccaucagauugagaaggaguucagcgaaguggaagggcggauccaggaucuggagaaauauguggaggacacaaagaucgaucuuuggucuuacaacgccgaacugcucgucgcucuggagaaucagcacaccauugaccugacggauuccgaaaugaacaaacucuuugagaagacaaagaagcaacugagagaaaacgcggaggacaugggaaauggcugcuucaagaucuaucauaaaugugauaacgccugcauugggagcauccgcaauggcaccuacgaccacaacguguaccgggacgaggcucuuaauaacagauuucagauuaagggaguugaacugaaaucuggcuauaaggauuggauccucuggaucuccuucgccauuagcugcuuucugcuuuguguggcccugcucggguucaucaugugggcuugccagaaaggaaauauucgcuguaacaucugcauuuga

SEQ ID NO: 196453 - RNA, 1701 nt, Artificial Sequence; identical to SEQ ID NO: 195465
  derived and/or modified sequence opt5 from hemagglutinin__InfluenzaA__ALE31927

SEQ ID NO: 196454 - RNA, 1701 nt, Artificial Sequence
  derived and/or modified sequence opt5 from hemagglutinin__InfluenzaA__ALE31928
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacauucuaauuuuaaguauccugcgcugaacgucaccaugcccaacaaugagcaguucgacaaacuuuacaucuggggagugcaccauccugggacagauaaggaccagauuuuucuguaugcccaguccagcggccgcaucaccguuuccacgaagagaucucaacaggcugugauuccgaacaucgggagccggccccgcaucagagauauuccuucccggaucagcauuuacuggacaaucgucaaacccggagacauucuccugaucaauucuaccggcaaccugaucgccccucgcggguacuucaagauuagauccggaaaaagcucuaucaugcggagcgacgcucccauuggcaaguguaaguccgaaugcaucacaccgaauggcucuauuccuaacgauaaacccuuucagaaugugaaccgcaucaccuauggggccuguccuagauacgugaagcagagcacccucaaacuggcgacaggaaugcggaauguccccgagaagcaaacgcgcggcaucuucggggccauugcuggauuuaucgaaaacggcugggaggggaugguugacggaugguauggcuucagacaccaaaauuccgagggccgggggcaggccgcugaucuuaaaagcacccaggccgccauugaccagaucaacggaaagcugaauagacucauuggcaaaacaaacgaaaaguuccaccagaucgagaaggaauuuucugagguggaagggcgcauucaggaucuggagaaauacguggaggacaccaagaucgaucuuugguccuauaaugcugaacugcucgucgcgcuggagaaccaacauacaaucgaccugaccgauagcgaaaugaacaaacucuucgagaagacgaaaaagcagcugcgggaaaaugccgaggacaugggaaacggcugcuuuaagauuuaccacaaaugugauaaugcuugcaucgggucuauuagaaacggcacauaugaccaugacguguaccgcgaugaggcccuuaauaaccgguuccagaucaagggaguugaacugaaauccggcuacaaggacuggauucucuggaucagcuuugccaucuccugcuuccugcuuuguguggcucugcucggguuuauuaugugggccugccagaaaggaaauaucagauguaacauuugcaucuga

SEQ ID NO: 196455 - RNA, 1701 nt, Artificial Sequence; identical to SEQ ID NO: 196101
  derived and/or modified sequence opt5 from hemagglutinin__InfluenzaA__ALE31930

SEQ ID NO: 196456 - RNA, 1701 nt, Artificial Sequence; identical to SEQ ID NO: 195465
  derived and/or modified sequence opt5 from hemagglutinin__InfluenzaA__ALE31931

SEQ ID NO: 196457 - RNA, 1701 nt, Artificial Sequence; identical to SEQ ID NO: 195465
  derived and/or modified sequence opt5 from hemagglutinin__InfluenzaA__ALE31932

SEQ ID NO: 196458 - RNA, 1701 nt, Artificial Sequence
  derived and/or modified sequence opt5 from hemagglutinin__InfluenzaA__ALE31933
augaagaccaucauugcccugagcuacauccucugccugguguaugcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuccagaauaaaaagugggaucuguuugucgagcggucuaaagccuacagcaacuguuauccuuacgacgugcccgauuaugcuucccugcgcucucucguugccagcuccgggacccuggaauuuaauaacgagagcuucaauuggacgggagugacccaaaacggcacaucuuccgcuugcaucagacggucuagcuccagcuucuuuucucgccuuaauuggcugacccaucucaaguacacauauccugcccugaacgucaccaugcccaauaacgagcaguucgacaaacuuuacauuuggggcgugcaccauccugggacggauaaggaccagaucuuucuguacgcgcaguccagcggaagaauuacaguuuccaccaagcggucucaacaggccgugaucccgaacaucggcagccgcccccggauuagagauaucccuucccgcauuagcaucuauuggacaauugucaaacccggggacauccuccugaucaauucuaccggaaaccugauugcuccuagaggcuacuucaagauccgguccgggaaaagcucuauuaugcgcagcgacgcccccaucggaaaguguaaguccgaaugcauuaccccgaauggcucuaucccuaacgauaaacccuuucagaaugugaacagaaucacauauggcgcuuguccucgguacgugaagcacagcacgcucaaacuggccaccgggaugcgcaauguccccgagaagcagacaagaggaauuuucggcgcgaucgccggguuuauugaaaacggaugggagggcaugguugacgggugguauggauuccggcaccaaaauuccgagggcagaggccaggcugccgaucuuaaaagcacccaggcugccaucgaccaaauuaacgggaagcugaaucgccucaucggaaaaacaaacgaaaaguuucaucagauugagaaggaguucucugaaguggaaggccggauccaggaucuggagaaauacguggaggacaccaagaucgaucuuugguccuauaaugccgaacugcucgucgcucuggagaaccagcacacgauugaccugacagauagcgaaaugaauaaacucuucgagaagaccaaaaagcaacugagagaaaacgcggaggacauggggaacggaugcuuuaagaucuaccauaaaugugauaaugccugcauuggcucuauccgcaacgggaccuacgaccacaauguguaucgggacgaggcucuuaacaauagauuccagauuaagggcguugaacugaaauccggauacaaggauuggauccucuggaucagcuuugccauuuccugcuuccugcuuuguguggcccugcucggcuuuaucaugugggcuugccagaaagggaacauucgcuguaauaucugcauuuga

SEQ ID NO: 196459 - RNA, 1701 nt, Artificial Sequence
  derived and/or modified sequence opt5 from hemagglutinin__InfluenzaA__ALE31934
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaaagucuagcuccagcuuuuucucucggcuuaauuggcugacccaucucaacuauacauaccaggcccugaaugucaccaugccuaacaacgagcaguuugacaaacuuuauauuuggggcgugcaccaucccgggacggauaaggaccagaucuuccuguacgcgcgcuccagcggaagaauuacaguuuccaccaagcggucucaacaggccgugaucccuaauaucggcagccgcccgcggauuagagauauccccucccgcauuagcaucuacuggacaauugucaaaccuggggacauccuccugaucaacucuaccggaaaucugauugcucccagaggcuauuuuaagauccgguccgggaaaagcucuauuaugcgcagcgacgccccuaucggaaaguguaaguccgaaugcauuacccccaacggcucuaucccgaaugauaaaccuuuccagaacgugaauagaaucacauacggcgcuuguccccgguaugugaagcacagcacgcucaaacuggccaccgggaugcgcaacauuccugagaagcagacaagaggaaucuuuggcgcgauugccggguucaucgaaaauggaugggagggcauggucgacgggugguacggauuucggcaccaaaacuccgagggcagaggccaggcugccgaucuuaaaagcacccaggcugccauugaccaaaucaaugggaagcugaaccgccucauuggaaaaacaaaugaaaaguuccaucagaucgagaaggaguucucugaaguugaaggccggauccaggaucuggagaaauauguggaggacaccaagauugaucuuugguccuacaacgccgaacugcucguggcucuggagaaucagcacacgaucgaccugacagauagcgaaaugaacaaacucuuugagaagaccaaaaagcaacugagagaaaacgcggaggacauggggaauggaugcuucaagauuuaucauaaaugugauaacgccugcaucggcucuauucgcaaugggaccuacgaccacaacgucuaccgggacgaggcucuuaauaacagauuucagaucaagggcguggaacugaaauccggauauaaggauuggauccucuggauuagcuucgccaucuccugcuuucugcuuuguguugcccugcucggcuucauuaugugggcuugccagaaagggaauauccgcuguaacauuugcaucuga

SEQ ID NO: 196460 - RNA, 1701 nt, Artificial Sequence; identical to SEQ ID NO: 195465
  derived and/or modified sequence opt5 from hemagglutinin__InfluenzaA__ALE31935

SEQ ID NO: 196461 - RNA, 1701 nt, Artificial Sequence; identical to SEQ ID NO: 196247
  derived and/or modified sequence opt5 from hemagglutinin__InfluenzaA__ALE31936

SEQ ID NO: 196462 - RNA, 1701 nt, Artificial Sequence
  derived and/or modified sequence opt5 from hemagglutinin__InfluenzaA__ALE31937
augaagaccaucauugcccugagcuacauccucugccugguguucgcucagaaacuucccgagaacgacaauuccacagccacgcugugucucggccaccaugcggucccuaacgggaccauuguuaagacaaucaccaaugauagaauugaagugacaaacgcuaccgagcuggugcaaaauucuagcaucggagaaaucugcgacuccccgcaccagauucuugauggcgagaacuguacacugaucgacgcccuccugggggauccccagugcgacggauuucagaauaaaaagugggaucuguucgucgaacggucuaaagccuauagcaacuguuacccuuaugacgugcccgauuacgcuucccuccgcucucugguugccagcuccggcacccuugaguuuaauaacgagagcuucaauugggcuggggugacgcaaaacggaaccucuuccagcugcauuagaggcucuaauuccagcuuuuucucucggcugaacuggcucacacaucuuaauuccaaguauccugcccugaacgucaccaugcccaacaaugaacaguuugacaagcuguacaucuggggcgugcaccauccugggacagauaaagaccagauuuuccucuaugcgcagccgagcggacgcaucaccguuuccacgaagagaucucaacaggccgugauucccaacaucggcagccggccucgcaucagagauauucccucccggaucagcauuuacuggacaaucgucaaaccuggggacauucugcugaucaauucuaccggaaaccucaucgcuccccgcggcuacuuuaagauuagauccgggaaaagcucuaucaugcggagcgacgccccgauuggaaaguguaaguccgagugcaucacaccuaauggcucuauucccaacgauaaaccuuuccagaaugugaaccgcaucaccuauggcgcuugucccagauacgugaagcagagcacccugaaacuugccacagggaugcggaauguccccgaacgccaaacgagaggaaucuuuggcgcgauugccggguucaucgagaacggaugggagggcaugguugacgggugguauggauuucggcaccaaaauuccgaaggcagaggccaggcugccgaucugaaaagcacccaggcugccauugaccagaucaacgggaaacucaaucgccugauuggaaagacaaacgagaaauuccaccagaucgaaaaggaguucucugaaguggagggccggauucaggaucuugagaaguacguggaagacaccaaaaucgaucugugguccuauaaugccgagcuccuggucgcucuggaaaaccaacauacaaucgaccucaccgauagcgagaugaacaagcuguuugaaaagacgaagaaacagcuuagagagaaugcggaggacauggggaacggaugcuucaagauuuaccacaagugugauaaugccugcaucggcucuauucgcaacgggacauaugaccaugacguguaccgggaugaagcucugaauaacagauuucagaucaaaggcguugagcucaaguccggauacaaagacuggauucuguggaucagcuucgccaucuccugcuuucuucuguguguggcccuccugggcuucauuaugugggcuugccagaaggggaauauccgcuguaacauuugcaucuga

SEQ ID NO: 196463 - RNA, 1701 nt, Artificial Sequence; identical to SEQ ID NO: 195465
  derived and/or modified sequence opt5 from hemagglutinin__InfluenzaA__ALE31938

SEQ ID NO: 196464 - RNA, 1701 nt, Artificial Sequence; identical to SEQ ID NO: 196071
  derived and/or modified sequence opt5 from hemagglutinin__InfluenzaA__ALE31939

SEQ ID NO: 196465 - RNA, 1701 nt, Artificial Sequence; identical to SEQ ID NO: 195465
  derived and/or modified sequence opt5 from hemagglutinin__InfluenzaA__ALE31941

SEQ ID NO: 196466 - RNA, 1701 nt, Artificial Sequence; identical to SEQ ID NO: 196022
  derived and/or modified sequence opt5 from hemagglutinin__InfluenzaA__ALE31943

SEQ ID NO: 196467 - RNA, 1701 nt, Artificial Sequence
  derived and/or modified sequence opt5 from hemagglutinin__InfluenzaA__ALE31944
augaagaccaucauugcccugagcuacauccucugccugguguucgcucagaaacuucccgagaacgacaauuccacagccacgcugugucucggccaccaugcggucccuaacgggaccauuguuaagacaaucaccucugauagaauugaagugacaaaugcuaccgagcuggugcaaaacagcuccaucggagaaaucugcgacucuccgcaccagauucuugauggcaaaaauuguacacugaucgacgcccuccugggggauccccagugcgacggauuucagaacaagaaaugggaucuguucgucgagcggagcaaggccuauuccaauuguuacccuuaugacgugcccgauuacgcuucucuccgcagccugguugccuccagcggcacccuugaauuuaacgacgagucuuucaauugggcuggggugacgcaaaacggaaccuccagcgccugcauuagaggcucuaauuccagcuuuuucucucggcugaacuggcucacacauuccaauuuuaaguauccugcgcugaacgucaccaugcccaauaacgagcaguucgauaaacuuuacaucuggggcgugcaccauccugggacagacaaggaucagauuuuucuguaugcccagagcuccggacgcaucaccguuucuacgaaaagaagccaacaggcugugauuccgaacaucggcucccggccccgcaucagagacauuccuagccggaucucuauuuacuggacaaucgucaagcccggggacauucuccugaucaauuccaccggaaaccugaucgccccucgcggcuacuucaaaauuagaagcgggaagucuagcaucaugcgguccgaugcucccauuggaaaguguaaaucugaaugcaucacaccgaauggcagcauuccuaacgacaagcccuuucagaaugugaaccgcaucaccuauggcgccuguccuagauacgugaaacaguccacccucaagcuggcgacagggaugcggaauguccccgagaaacaaacgcgcggaaucuucggcgccauugcuggguuuaucgaaaacggaugggagggcaugaaggaugggugguauggauucagacaccagaauagcgagggccggggccaggccgcugaccuuaaaucuacccaagccgccauugaucagaucaacgggaagcugaauagacucauuggaaagacaaacgaaaaauuccaccagaucgagaaggaauuuuccgagguugaaggccgcauucaggaccuggagaaauacguggaggauaccaagaucgaccuuuggagcuauaaugcugaacugcucguggcgcuggagaaccaacauacaaucgaucugaccgacucugaaaugaauaaacucuucgagaagacgaagaaacagcugcgggaaaacgccgaggauauggggaacggaugcuuuaagauuuaccacaaaugugacaaugcuugcaucggcuccauuagaaacgggacauaugaccaugaugucuaccgcgacgaggcccuuaauaaccgguuccagaucaagggcguggaacugaaaagcggauacaaggauuggauucucuggaucuccuuugccaucucuugcuuccugcuuuguguugcucugcucggcuuuauuaugugggccugccagaaggggaauaucagauguaacauuugcaucuga

SEQ ID NO: 196468 - RNA, 1701 nt, Artificial Sequence
  derived and/or modified sequence opt5 from hemagglutinin__InfluenzaA__ALE31945
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagggcucucaacaggccgugaucccgaaugucgggagccggccccgcaucagagauauuccuucccggaucagcauuuacuggacaaucgugaagcccggagacauucuccugaucaacucuaccggcaaucugaucgcuccucgcggguauuuuaaaauuagauccggaaagagcucuaucaugcggagcgacgcccccauuggcaaauguaaguccgaaugcaucaccccgaacggcucuauuccuaaugauaagcccuuccagaacgugaaucgcaucacauacggggcuuguccuagauaugucaaacacagcacgcucaagcuggccaccggaaugcggaacguucccgagaaacagacacgcggcaucuuuggggcgauugccggauucaucgaaaauggcugggaggggaugguggacggaugguacggcuuuagacaccaaaacuccgagggccgggggcaggcugccgaucuuaagagcacccaggcugccauugaccaaaucaauggaaaacugaacagacucauuggcaagacaaaugaaaaauuccaucagaucgagaaggaguucucugaaguggaagggcgcauucaggauaucgagaaguaugucgaggacaccaaaaucgaucugugguccuacaacgccgaacuucugguggcucucgagaaucagcacacgauugaccugacagauagcgaaaugaacaagcuguuugagaaaaccaagaaacaacuccgggaaaacgcggaggacaugggaaauggcugcuucaagaucuaucauaagugugauaacgccugcauugggucuaucagaaauggcaccuacgaccacaacguuuaccgcgacgaggcucugaauaaccgguuucagauuaaaggaguggaacuuaaguccggcuauaaagauuggauccuguggaucagcuucgccauuuccugcuuucuccugugugucgcccuucugggguucaucaugugggcuugccagaagggaaauauuagauguaacaucugcauuuga

SEQ ID NO: 196469 - RNA, 1701 nt, Artificial Sequence; identical to SEQ ID NO: 196123
  derived and/or modified sequence opt5 from hemagglutinin__InfluenzaA__ALE31946

SEQ ID NO: 196470 - RNA, 1701 nt, Artificial Sequence; identical to SEQ ID NO: 196123
  derived and/or modified sequence opt5 from hemagglutinin__InfluenzaA__ALE31947

SEQ ID NO: 196471 - RNA, 1701 nt, Artificial Sequence
  derived and/or modified sequence opt5 from hemagglutinin__InfluenzaA__ALE31948
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaaagucuagcuccagcuuuuucucucggcuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcgcuccagcggaagaauuacaguuuccaccaagcggucucagcaagccgugaucccgaauaucggcagccgcccccggauuagagauaucccuucccgcauuagcaucuacuggacaauugucaaacccggggacauccuccugaucaacucuaccggaaaucugauugcuccuagaggcuauuuuaagauccgguccgggaaaagcucuauuaugcgcagcgacgcccccaucggaaaguguaaguccgaaugcauuaccccgaacggcucuaucccuaaugauaaacccuuccagaacgugaauagaaucacauacggcgcuuguccucgguaugugaagcacagcacgcucaaacuggccaccgggaugcgcaacguccccgagaagcagacaagaggaauuuuuggcgcgaucgccggguucauugaaaauggaugggagggcaugguugacgggugguacggauuucggcaccagaacuccgagggcagaggccaagcugccgaucuuaaaagcacccaggcugccaucgaccagauuaaugggaagcugaaccgccucgugggaaaaacaaaugaaaaguuccaucaaaucgagaaggaguucucugaaguggaaggccggauucaggaucuggagaaauaugucgaggacaccaagaucgaucuuugguccuacaacgccgaauuucugguggcucucgagaaucagcacacgaucgaccugacagauagcgaaaugaacaaacuguucgagaagaccaaaaagcagcucagagaaaacgcggaggacauggggaauggaugcuuuaagauuuaucauaaaugugauaacgccugcaucggcucuauucgcaaugggaccuacgaccacaacguuuaccgggacgaggcucugaauaacagauuccaaaucaagggcguggaacuuaaauccggauauaaggauuggauucuguggaucagcuuugccaucuccugcuuccuccugugugucgcccuucugggcuuuauuaugugggcuugccagaaagggaauauccgcuguaacauuugcaucuga

SEQ ID NO: 196472 - RNA, 1701 nt, Artificial Sequence; identical to SEQ ID NO: 196123
  derived and/or modified sequence opt5 from hemagglutinin__InfluenzaA__ALE31949

SEQ ID NO: 196473 - RNA, 1701 nt, Artificial Sequence; identical to SEQ ID NO: 195465
  derived and/or modified sequence opt5 from hemagglutinin__InfluenzaA__ALE31950

SEQ ID NO: 196474 - RNA, 1701 nt, Artificial Sequence; identical to SEQ ID NO: 196009
  derived and/or modified sequence opt5 from hemagglutinin__InfluenzaA__ALE31951

SEQ ID NO: 196475 - RNA, 1701 nt, Artificial Sequence; identical to SEQ ID NO: 195465
  derived and/or modified sequence opt5 from hemagglutinin__InfluenzaA__ALE31952

SEQ ID NO: 196476 - RNA, 1701 nt, Artificial Sequence
  derived and/or modified sequence opt5 from hemagglutinin__InfluenzaA__ALE31953
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaaagucuagcuccagcuuuuucucucggcuuaauuggcugacccaucucaacuauacauacccugcccugaaugucaccaugcccaacaacgagcaguuugacaaacuuuauauuuggggcgugcaccauccugggacggauaaggaccagaucuuccuguuugcgcgcuccagcggaagaauuacaguuuccaccaagcggucucagcaagccgugaucccgaauaucggcagccgcccccggauuagagauaucccuucccgcauuagcaucuacuggacaauugucaaacccggggacauccuccugaucaacucuaccggaaaucugauugcuccuagaggcuacuucaagauccgguccgggaaaagcucuauuaugcgcagcgacgcccccaucggaaaguguaaguccgaaugcauuaccccgaacggcucuaucccuaaugauaaacccuuucagaacgugaauagaaucacauauggcgcuuguccucgguacgugaagcacagcacgcucaaacuggccaccgggaugcgcaacguccccgagaagcagacaagaggaauuuucggcgcgaucgccggguuuauugaaaauggaugggagggcaugguugacgggugguauggauuccggcaccagaacuccgagggcagaggccaagcugccgaucuuaaaagcacccaggcugccaucgaccagauuaaugggaagcugaaccgccucaucggaaaaacaaaugaaaaguuccaucaaauugagaaggaauuuucugagguggaaggccggauccaggaucuggagaaauacguggaggacaccaagaucgaucuuugguccuauaacgccgaacugcucgucgcucuggagaaucagcacacgauugaccugacagauagcgaaaugaacaaacucuucgagaagaccaaaaagcagcugagagaaaacgcggaggacauggggaauggaugcuuuaagaucuaccauaaaugugauaacgccugcauuggcucuauccgcaaugggaccuaugaccacaacguguaccgggacgaggcucuuaauaacagauuccaaauuaagggcguugaacugaaauccggauacaaggauuggauccucuggaucagcuuugccauuuccugcuuccugcuuuguguggcccugcucggcuuuaucaugugggcuugccagaaagggaauauucgcuguaacaucugcauuuga

SEQ ID NO: 196477 - RNA, 1701 nt, Artificial Sequence
  derived and/or modified sequence opt5 from hemagglutinin__InfluenzaA__ALE31954
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugaugggaaaaacuguacacugaucgacgcccuccugggagauccccagugcgacggcuuucagaauaagcggugggaucuguucgucgaacgcucuaaagccuauagcaacuguuacccuuaugacgugcccgauuacgcuucccucagaucucugguugccagcuccgggacccuugaguuuaaugacgaauccuucaacugggcuggagugacgcaaaauggcaccucuuccgccugcauucggggcagcaacucuuccuuuuucagccgccugaauuggcucacacauucuaacuuuaaguauccugcgcugaaugucaccaugcccaacaacgagcaguucgauaaacuuuacaucuggggagugcaccauccugggacagacaaagaucagauuuuucuguaugcccacuccagcggcagaaucaccguuuccacgaagcggucucagcaagcugugauuccgaaugucgggagccgccccagaauccggaacaucccuucccgcauuagcaucuacuggacaauugugaaacccggagacauccuccugauuaauucuaccggcaaccugaucgccccuagaggguacuucaagauccaguccggaaaaagcucuauuaugcggagcgacgcucccaucggcaaguguaaguccgagugcauuacaccgaauggcucuaucccuaacgauaaacccuuucagaaugugaaccgcauuaccuauggggccuguccuagauacgucaagcagagcacccucaaacuggcgacaggaaugcggaauguucccgaaaagcaaacgcgcggcaucuucggggccaucgcuggauuuauugagaacggcugggaagggaugaaagacggaugguauggcuucagacaccagaauagcgagggccgggggcaggccgcugaucuuaagagcacccaagccgccaucgaccagauuaacggaaaacugaauagacucgugggcaagacaaacgagaaguuccaucagaucgaaaaagaguuuucugaaguggaggggcgcauucaggaucuggaaaaguacgucgaggacaccaaaaucgaucuuugguccuauaaugcugagcugcucguggcgcuggaaaaccaacacacaauugaccugaccgauagcgagaugaacaaacucuucgaaaagacgaagaagcagcugcgggagaaugccgaagacaugggaaacggcugcuuuaagaucuaccauaagugugauaaugcuugcaucgggucuauuagaaacggcacauaugaccacuacguuuaccgcgacgaggcccuuaauaaccgguuccagaucaaaggaguggagcugaaguccggcuauaaagauuggauucucuggaucagcuuugccauuuccugcuuccugcuuugugucgcucugcucggguuuaucaugugggccugccagaagggaaauaucagauguaacauuugcaucuga

SEQ ID NO: 196478 - RNA, 1701 nt, Artificial Sequence; identical to SEQ ID NO: 195465
  derived and/or modified sequence opt5 from hemagglutinin__InfluenzaA__ALE31955

SEQ ID NO: 196479 - RNA, 1701 nt, Artificial Sequence
  derived and/or modified sequence opt5 from hemagglutinin__InfluenzaA__ALE31956
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcaacuccccgcaccagauccuggacggggaaaauuguacacuuauugaugcccugcucggagacccccagugcgauggcuuucagaacaaaaagugggaccuguucgucgagcggucuaaagccuauagcaauuguuacccuuaugaugugcccgacuacgcuucccugcgcucucucguugccagcuccgggacccuggaauuuaacaaugagagcuucaacuggacgggagugacccaaaauggcacaucuuccgcuugcaucagacggagcagcuccagcuuuuucucucgccuuaacuggcugacccaucucaauuauacauacccugcccugaacgucaccaugcccaacaaugagcaguuugauaaacuuuauauuuggggcgugcaccauccugggacggacaaggaucagaucuuccuguacgcgcaguccagcggaagaauuacaguuuccaccaagcggucucaacaggccgugaucccgaacaucggcagccgcccccggauuagagacaucccuucccgcauuagcaucuacuggacaauugucaagcccggggauauccuccugaucaauucuaccggaaaccugauugcuccuagaggcuauuuuaaaauccgguccgggaagucuucuauuaugcgcagcgacgcccccaucggaaaauguaaguccgaaugcauuaccccgaauggcucuaucccuaacgacaagcccuuccagaaugugaacagaaucacauacggcgcuuguccucgguaugugaaacacagcacgcucaagcuggccaccgggaugcgcaauguccccgagaaacagacaagaggaauuuuuggcgcgaucgccggguucauugaaaacggaugggagggcaugguugaugggugguacggauuucggcaccaaaauuccgagggcagaggccaggcugccgaccuuaagagcacccaggcugccaucgaucaaauuaacgggaaacugaaucgccucaucggaaagacaaacgaaaaauuccaucagauugagaaggaguucucugaaguggaaggccggauccaggaccuggagaaguauguggaggauaccaaaaucgaccuuugguccuacaaugccgaacugcucgucgcucuggagaaccagcacacgauugaucugacagacagcgaaaugaacaagcucuuugagaaaaccaagaaacaacugagagaaaaugcggaggauauggggaacggaugcuucaagaucuaucauaagugugacaaugccugcauuggcucuauccgcaacgggaccuacgaucacaauguguaccgggacgaggcucuuaacaauagauuucagauuaaaggcguugaacugaaguccggauauaaagacuggauccucuggaucagcuucgccauuuccugcuuucugcuuuguguggcccugcucggcuucaucaugugggcuugccagaaggggaacauucgcuguaauaucugcauuuga

SEQ ID NO: 196480 - RNA, 1701 nt, Artificial Sequence; identical to SEQ ID NO: 196071
  derived and/or modified sequence opt5 from hemagglutinin__InfluenzaA__ALE31957

SEQ ID NO: 196481 - RNA, 1701 nt, Artificial Sequence
  derived and/or modified sequence opt5 from hemagglutinin__InfluenzaA__ALE31958
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagcaagccccgcauuagagauaucccuucccggauuagcaucuacuggacaauugucaaacccggggacauccuccugaucaacucuaccggaaaucugauugcuccucgcggcuauuuuaagaucagauccgggaaaagcucuauuaugcggagcgacgcccccaucggaaaguguaaguccgaaugcauuaccccgaacggcucuaucccuaaugauaaacccuuccagaacgugaaucgcaucacauacggcgcuuguccuagauaugugaagcacagcacgcucaaacuggccaccgggaugcggaacguccccgagaagcagacacgcggaauuuuuggcgcgaucgccggguucauugaaaauggaugggagggcaugguugacgggugguacggauuuagacaccaaaacuccgagggccggggccaggcugccgaucuuaaaagcacccaggcugccaucgaccaaauuaaugggaagcugaacagacucaucggaaaaacaaaugaaaaguuccaucagauugagaaggaguucucugaaguggaaggccgcauccaggaucuggagaaauauguggaggacaccaagaucgaucuuugguccuacaacgccgaacugcucgucgcucuggagaaucagcacacgauugaccugacagauagcgaaaugaacaaacucuuugagaagaccaaaaagcaacugcgggaaaacgcggaggacauggggaauggaugcuucaagaucuaucauaaaugugauaacgccugcauuggcucuaucagaaaugggaccuacgaccacaacguguaccgcgacgaggcucuuaauaaccgguuucagauuaagggcguugaacugaaauccggauauaaggauuggauccucuggaucagcuucgccauuuccugcuuucugcuuuguguggcccugcucggcuucaucaugugggcuugccagaaagggaauauuagauguaacaucugcauuuga

SEQ ID NO: 196482 - RNA, 1701 nt, Artificial Sequence
  derived and/or modified sequence opt5 from hemagglutinin__InfluenzaA__ALE31959
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaaagucuagcuccagcuuuuucucucggcuuaauuggcugacccaucucaacuaugccuacccugcgcugaaugucacaaugcccaacaacgagcaguuugacaaacuuuauauuuggggcgugcaccauccugggaccgauaaagaccagaucuuccuguacgcccgcuccagcggaagaauuacgguuuccacaaagcggucucagcaagcugugaucccgaauaucggcagccgcccccggauuagagauaucccuucccgcauuagcaucuacuggaccauugucaaacccggggacauccuccugaucaacucuacaggaaaucugauugccccuagaggcuauuuuaagauccgguccgggaaaagcucuauuaugcgcagcgacgcucccaucggaaaguguaaguccgaaugcauuaccccgaacggcucuaucccuaaugauaaacccuuccagaacgugaauagaaucaccuacggcgccuguccucgguaugugaagcacagcacacucaaacuggcgacggggaugcgcaacguccccgagaagcagaccagaggaauuuuuggcgccaucgcuggguucauugaaaauggaugggagggcaugguugacgggugguacggauuucggcaccagaacuccgagggcagaggccaagccgcugaucuuaaaagcacacaggccgccaucgaccagauuaaugggaagcugaaccgccucaucggaaaaaccaaugaaaaguuccaucaaauugagaaggaguucucugaaguggaaggccggauccaggaucuggagaaauauguggaggacacaaagaucgaucuuugguccuacaacgcugaacugcucgucgcgcuggagaaucagcacaccauugaccugacggauagcgaaaugaacaaacucuuugagaagacaaagaagcagcugagagaaaacgccgaggacauggggaauggaugcuucaagaucuaucauaaaugugauaacgcuugcauuggcucuauccgcaaugggaccuacgaccacaacguguaccgggacgaggcccuuaauaacagauuucaaauuaagggcguugaacugaaauccggauauaaggauuggauccucuggaucagcuucgccauuuccugcuuucugcuuuguguggcucugcucggcuucaucaugugggccugccagaaagggaauauucgcuguaacaucugcauuuga

SEQ ID NO: 196483 - RNA, 1701 nt, Artificial Sequence; identical to SEQ ID NO: 195465
  derived and/or modified sequence opt5 from hemagglutinin__InfluenzaA__ALE31960

SEQ ID NO: 196484 - RNA, 1701 nt, Artificial Sequence; identical to SEQ ID NO: 195654
  derived and/or modified sequence opt5 from hemagglutinin__InfluenzaA__ALE31961

SEQ ID NO: 196485 - RNA, 1701 nt, Artificial Sequence
  derived and/or modified sequence opt5 from hemagglutinin__InfluenzaA__ALE31962
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcaugagcauuuacuggacaaucgucaagcccggggacauucuccugaucaacucuaccggaaaucugaucgcuccuagaggcuauuuuaaaauucgguccgggaagucuucuaucaugcgcagcgacgcccccauuggaaaauguaaguccgaaugcaucaccccgaacggcucuauuccuaaugauaagcccuuccagaacgugaauagaaucacauacggcgcuuguccucgguaugugaaacacagcacgcucaagcuggccaccgggaugcgcaacguccccgagaaacagacaagaggaaucuuuggcgcgauugccggguucaucgaaaauggaugggagggcaugguugacgggugguacggauuucggcaccaaaacuccgagggcagaggccaggcugccgaucuuaagagcacccaggcugccauugaccaaaucaaugggaaacugaaccgccucauuggaaagacaaaugaaaaauuccaucagaucgagaaggaguucucugaaguggaaggccggauucaggaucuggagaaguauguggaggacaccaaaaucgaucuuugguccuacaacgccgaacugcucgucgcucuggagaaucagcacacgaucgaccugacagauagcgaaaugaacaagcucuuugagaaaaccaagaaacaacugagagaaaacgcggaggacauggggaauggaugcuucaagauuuaucauaagugugauaacgccugcaucggcucuauucgcaaugggaccuacgaccacaacguguaccgggacgaggcucuuaauaacagauuucagaucaaaggcguugaacugaaguccggauauaaagauuggauucucuggaucagcuucgccaucuccugcuuucugcuuuguguggcccugcucggcuucauuaugugggcuugccagaaggggaauauccgcuguaacauuugcaucuga

SEQ ID NO: 196486 - RNA, 1701 nt, Artificial Sequence
  derived and/or modified sequence opt5 from hemagglutinin__InfluenzaA__ALE31963
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagacauuccuguacgcgcaguccagcggaagaaucaccguuuccacaaagcggucucaacaggccgugauuccgaauaucggcagccgccccagaauccgggauauuccuucccgcaucagcauuuacuggaccaucgucaagcccggggacauucuccugaucaacucuaccggaaaucugaucgcuccuagaggcuauuuuaaaauucgguccgggaagucuucuaucaugcgcagcgacgcccccauuggaaaauguaaguccgaaugcaucacaccgaacggcucuauuccuaaugauaagcccuuccagaacgugaauagaaucacguacggcgcuuguccucgguaugugaaacacagcacccucaagcuggccacagggaugcgcaacguccccgagaaacagaccagaggaaucuuuggcgcgauugccggguucaucgaaaauggaugggagggcaugguugacgggugguacggauuucggcaccaaaacuccgagggcagaggccaggcugccgaucuuaagagcacacaggcugccauugaccaaaucaaugggaaacugaaccgccucauuggaaagaccaaugaaaaauuccaucagaucgagaaggaguucucugaaguggaaggccggauucaggaucuggagaaguauguggaggacacgaaaaucgaucuuugguccuacaacgccgaacugcucgucgcucuggagaaucagcacacaaucgaccugaccgauagcgaaaugaacaagcucuuugagaaaaccaagaaacaacugagagaaaacgcggaggacauggggaauggaugcuucaagauuuaucauaagugugauaacgccugcaucggcucuauucgcaaugggacauacaaccacaauguguaccgggacgaggcucuuaacaauagauuucagaucaaaggcguugaacugaaguccggauauaaagacuggauucucuggaucagcuucgccaucuccugcuuucugcuuuguguggcccugcucggcuucauuaugugggcuugccagaaggggaacauccgcuguaauauuugcaucuga

SEQ ID NO: 196487 - RNA, 1701 nt, Artificial Sequence
  derived and/or modified sequence opt5 from hemagglutinin__InfluenzaA__ALE31964
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuauuacgugcccgacuaugcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuacacauauccugcccugaaugucaccaugcccaacaacgagcaguuugauaaacuuuacauuuggggcgugcaccauccugggacggacaaggaucagaucuuccuguacgcgcaguccagcggaagaauuacaguuuccaccaagcggucucaacaggccgugaucccgaauaucggcagccgcccccggauuagagacaucccuucccgcauuagcaucuauuggacaauugucaagcccggggauauccuccugaucaacucuaccggaaaucugauugcuccuagaggcuacuuuaaaauccaguccgggaagucuucuauuaugcggagcgacgcccccaucggaaaauguaaguccgaaugcauuaccccgaacggcucuaucccuaaugacaagcccuuccagaacgugaaucgcaucacauauggcgcuuguccuagauacgugaaacacagcacgcucaagcuggccaccgggaugcggaacguccccgagaaacaaacacgcggaauuuuuggcgcgaucgccggguucauugaaaauggaugggagggcaugguugaugggugguauggauuuagacaccagaacuccgagggccggggccaggcugccgaccuuaagagcacccaagcugccaucgaucagauuaaugggaaacugaacagacucaucggaaagacaaaugaaaaauuccaucagauugagaaggaguucucugaaguggaaggccgcauccaggaccuggagaaguacguggaggauaccaaaaucgaccuuugguccuauaacgccgaacugcucgucgcucuggagaaucaacacacgauugaucugacagacagcgaaaugaacaagcucuuugagaaaaccaagaaacagcugcgggaaaacgcggaggauauggggaauggaugcuucaagaucuaccauaagugugacaacgccugcauuggcucuaucagaaaugggaccuacgaucacaacguguaucgcgacgaggcucuuaauaaccgguuucagauuaaaggcguugaacugaaguccggauacaaagacuggauccucuggaucagcuucgccauuuccugcuuucugcuuuguguggcccugcucggcuucaucaugugggcuugccagaaggggaauauuagauguaacaucugcauuuga

SEQ ID NO: 196488 - RNA, 1701 nt, Artificial Sequence; identical to SEQ ID NO: 195465
  derived and/or modified sequence opt5 from hemagglutinin__InfluenzaA__ALE31965

SEQ ID NO: 196489 - RNA, 1701 nt, Artificial Sequence; identical to SEQ ID NO: 196123
  derived and/or modified sequence opt5 from hemagglutinin__InfluenzaA__ALE31966

SEQ ID NO: 196490 - RNA, 1701 nt, Artificial Sequence; identical to SEQ ID NO: 196393
  derived and/or modified sequence opt5 from hemagglutinin__InfluenzaA__ALE31967

SEQ ID NO: 196491 - RNA, 1701 nt, Artificial Sequence; identical to SEQ ID NO: 196009
  derived and/or modified sequence opt5 from hemagglutinin__InfluenzaA__ALE31968

SEQ ID NO: 196492 - RNA, 1701 nt, Artificial Sequence; identical to SEQ ID NO: 196116
  derived and/or modified sequence opt5 from hemagglutinin__InfluenzaA__ALE31969

SEQ ID NO: 196493 - RNA, 1701 nt, Artificial Sequence; identical to SEQ ID NO: 195465
  derived and/or modified sequence opt5 from hemagglutinin__InfluenzaA__ALE31970

SEQ ID NO: 196494 - RNA, 1701 nt, Artificial Sequence
  derived and/or modified sequence opt5 from hemagglutinin__InfluenzaA__ALE31971
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuaugccuacccugcgcugaaugucacaaugcccaacaacgagcaguuugacaaacuuuauauuuggggcgugcaccauccugggaccgauaaggaccagaucuuccuguacgcccaguccagcggaagaauuacgguuuccacaaagggcucucaacaggcugugaucccgaauaucgggagccggccccgcauuagagauaucccuucccggauuagcaucuacuggaccauugucaagcccggagacauccuccugaucaacucuacaggcaaucugauugccccucgcggguauuuuaaaaucagauccggaaagagcucuauuaugcggagcgacgcucccaucggcaaauguaaguccgaaugcauuaccccgaacggcucuaucccuaaugauaagcccuuccagaacgugaaucgcaucaccuacggggccuguccuagauaugugaaacacagcacacucaagcuggcgacgggaaugcggaacguccccgagaaacagacccgcggcauuuuuggggccaucgcuggauucauugaaaauggcugggaggggaugguugacggaugguacggcuuuagacaccaaaacuccgagggccgggggcaggccgcugaucuuaagagcacacaggccgccaucgaccaaauuaauggaaaacugaacagacucaucggcaagaccaaugaaaaauuccaucagauugagaaggaguucucugaaguggaagggcgcauccaggaucuggagaaguauguggaggacacaaaaaucgaucuuugguccuacaacgcugaacugcucgucgcgcuggagaaucagcacaccauugaccugacggauagcgaaaugaacaagcucuuugagaaaacaaagaaacaacugcgggaaaacgccgaggacaugggaaauggcugcuucaagaucuaucauaagugugauaacgcuugcauugggucuaucagaaauggcaccuacgaccacaacguguaccgcgacgaggcccuuaauaaccgguuucagauuaaaggaguugaacugaaguccggcuauaaagauuggauccucuggaucagcuucgccauuuccugcuuucugcuuuguguggcucugcucggguucaucaugugggccugccagaagggaaauauuagauguaacaucugcauuuga

SEQ ID NO: 196495 - RNA, 1701 nt, Artificial Sequence; identical to SEQ ID NO: 196009
  derived and/or modified sequence opt5 from hemagglutinin__InfluenzaA__ALE31972

SEQ ID NO: 196496 - RNA, 1701 nt, Artificial Sequence; identical to SEQ ID NO: 196009
  derived and/or modified sequence opt5 from hemagglutinin__InfluenzaA__ALE31973

SEQ ID NO: 196497 - RNA, 1701 nt, Artificial Sequence; identical to SEQ ID NO: 195654
  derived and/or modified sequence opt5 from hemagglutinin__InfluenzaA__ALE31974

SEQ ID NO: 196498 - RNA, 1701 nt, Artificial Sequence; identical to SEQ ID NO: 196009
  derived and/or modified sequence opt5 from hemagglutinin__InfluenzaA__ALE31975

SEQ ID NO: 196499 - RNA, 1701 nt, Artificial Sequence; identical to SEQ ID NO: 195465
  derived and/or modified sequence opt5 from hemagglutinin__InfluenzaA__ALE31976

SEQ ID NO: 196500 - RNA, 1701 nt, Artificial Sequence; identical to SEQ ID NO: 195465
  derived and/or modified sequence opt5 from hemagglutinin__InfluenzaA__ALE31977

SEQ ID NO: 196501 - RNA, 1701 nt, Artificial Sequence
  derived and/or modified sequence opt5 from hemagglutinin__InfluenzaA__ALE31978
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaaaguccucuuccagcuuuuucucucggcuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcgcuccagcggaagaauuacaguuuccaccaagcggucucagcaagccgugaucccgaauaucggcagccgcccccggauuagagauaucccuucccgcauuagcaucuacuggacaauugucaaacccggggacauccuccugauccacucuaccggaaaccugauugcuccuagaggcuauuuuaagauccgguccgggaaaagcucuauuaugcgcagcgacgcccccaucggaaaguguaaguccgaaugcauuaccccgaauggcucuaucccuaacgauaaacccuuccagaaugugaacagaaucacauacggcgcuuguccucgguaugugaagcacagcacgcucaaacuggccaccgggaugcgcaauguccccgagaagcagacaagaggaauuuuuggcgcgaucgccggguucauugaaaacggaugggagggcaugguugacgggugguacggauuucggcaucagaauagcgagggcagaggccaagcugccgaucuuaaaagcacccaggcugccaucgaccagauuaacgggaagcugaaucgccucaucggaaaaacaaacgaaaaguuccaccaaauugagaaggaguucucugaaguggaaggccggauccaggaucuggagaaauauguggaggacaccaagaucgaucuuugguccuacaaugccgaacugcucgucgcucuggagaaccagcauacgauugaccugacagauagcgaaaugaauaaacucuuugagaagaccaaaaagcagcugagagaaaacgcggaggacauggggaacggaugcuucaagaucuaucacaaaugugauaaugccugcauuggcucuauccgcaacgggaccuacgaccacaauguguaccgggacgaggcucuuaacaauagauuucaaauuaagggcguugaacugaaauccggauauaaggauuggauccucuggaucagcuucgccauuuccugcuuucugcuuuguguggcccugcucggcuucaucaugugggcuugccagaaagggaacauucgcuguaauaucugcauuuga

SEQ ID NO: 196502 - RNA, 1701 nt, Artificial Sequence; identical to SEQ ID NO: 195465
  derived and/or modified sequence opt5 from hemagglutinin__InfluenzaA__ALE31979

SEQ ID NO: 196503 - RNA, 1701 nt, Artificial Sequence
  derived and/or modified sequence opt5 from hemagglutinin__InfluenzaA__ALE31980
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgcccccaucggaaaauguaaguccgaaugcauuaccccgaacggcucuaucccuaaugauaagcccuuccagaacgugaauagaaucacauacggcgcuuguccucgguaugugaaacacagcacgcucaagcuggccaccgggaugcgcaacguccccgagaaacagacaagaggaauuuuuggcgcgaucgccggguucauugaaaauggaugggagggcaugguugacgggugguacggauuucggcaccaaaacuccgagggcagaggccaggcugccgaucuuaagagcacccaggcugccaucgaccaaauuaaugggaaacugaaccgccucaucggaaagacaaaugaaaaauuccaucagauugagaaggaguucucugaaguggaaggccggauccaggaucuggagaaguauguggaggacaccaaaaucgaucuuugguccuacaacgccgaacugcucgucgcucuggagaaucagcacacgauugaccugacagauagcgaaaugaacaagcucuuugagaaaaccaagaaacaacugagagaaaacgcggaggacauggggaauggaugcuucaagaucuaucauaagugugauaacgccugcauuggcucuauccgcaaugggaccuacgaccacaacguguaccgggacgaggcucuuaauaacagauuucagauuaaaggcguugaacugaaguccgaguauaaagauuggauccucuggaucagcuucgccauuuccugcuuucugcuuuguguggcccugcucggauucaucaugugggcuugccagaagggcaauauucgcuguaacaucugcauuuga

SEQ ID NO: 196504 - RNA, 1701 nt, Artificial Sequence; identical to SEQ ID NO: 195465
  derived and/or modified sequence opt5 from hemagglutinin__InfluenzaA__ALE31981

SEQ ID NO: 196505 - RNA, 1701 nt, Artificial Sequence; identical to SEQ ID NO: 196005
  derived and/or modified sequence opt5 from hemagglutinin__InfluenzaA__ALE31995

SEQ ID NO: 196506 - RNA, 1701 nt, Artificial Sequence
  derived and/or modified sequence opt5 from hemagglutinin__InfluenzaA__ALE31996
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgcccccaucggaaaauguaaguccgaaugcauuaccccgaacggcucuaucccuaaugauaagcccuuccagaacgugaauagagugacauacggcgcuuguccucgguaugucaaacacagcacgcucaagcuggccaccgggaugcgcaacguucccgagaaacagacaagaggaaucuuuggcgcgauugccggguucaucgaaaauggaugggagggcaugguggacgggugguacggauuucggcaccaaaacuccgagggcagaggccaggcugccgaucuuaagagcacccaggcugccauugaccaaaucaaugggaaacugaaccgccucauuggaaagacaaaugaaaaauuccaucagaucgagaaggaguucucugaaguggaaggccggauucaggaucuggagaaguaugucgaggacaccaaaaucgaucuuugguccuacaacgccgaacugcucguggcucuggagaaucagcacacgaucgaccugacagauagcgaaaugaacaagcucuuugagaaaaccaagaaacaacugagagaaaacgcggaggacauggggaauggaugcuucaagauuuaucauaagugugauaacgccugcaucggcucuauucgcaaugggaccuacgaccacaacguuuaccgggacgaggcucuuaauaacagauuucagaucaaaggcguggaacugaaguccggauauaaagauuggauucucuggaucagcuucgccaucuccugcuuucugcuuugugucgcccugcucggcuucauuaugugggcuugccagaaggggaauauccgcuguaacauuugcaucuga

SEQ ID NO: 196507 - RNA, 1701 nt, Artificial Sequence
  derived and/or modified sequence opt5 from hemagglutinin__InfluenzaA__ALE31997
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucaucgagcggucuaaagccuauagcaacuguuacccuuaugacguccccgauuacgcuucccugcgcucucucguggccagcuccgggacccuggaauuuaauaacgagagcuucaauuggacgggaguuacccaaaacggcacaucuuccgcuugcauuagacggagcagcuccagcuuuuucucucgccuuaauuggcugacccaucucaacuauacauacccugcccugaaugugaccaugcccaacaacgagcaguuugacaaacuuuauaucuggggcguccaccauccugggacggauaaggaccagauuuuccuguacgcgcaguccagcggaagaaucacaguguccaccaagcggucucaacaggccguuaucccgaauauuggcagccgccccagaauccgggauauuccuucccgcaucagcauuuacuggacaaucgugaagcccggggacauccuccugauuaacucuaccggaaaucugaucgcuccuagaggcuauuuuaaaauucgguccgggaagucuucuaucaugcgcagcgacgcccccauuggaaaauguaaguccgaaugcaucaccccgaacggcucuaucccuaaugauaagcccuuccagaacgucaauagaauuacauacggcgcuuguccucgguaugugaaacacagcacgcucaagcuggccaccgggaugcgcaacgugcccgagaaacagacaagaggaaucuuuggcgcgauugccggguucaucgaaaauggaugggagggcauggucgacgggugguacggauuucggcaccaaaacuccgagggcagaggccaggcugccgaucuuaagagcacccaggcugccauugaccaaaucaaugggaaacugaaccgccucauuggaaagacaaaugaaaaauuccaucagaucgagaaggaguucucugaaguugaaggccggauccaggaucuggagaaguauguggaggacaccaaaauugaucuuugguccuacaacgccgaacugcucguggcucuggagaaucagcacacgaucgaccugacagauagcgaaaugaacaagcucuuugagaaaaccaagaaacaacugagagaaaacgcggaggacauggggaauggaugcuucaagauuuaucauaagugugauaacgccugcaucggcucuauucgcaaugggaccuacgaccacaacgucuaccgggacgaggcucuuaauaacagauuucagaucaaaggcguggaacugaaguccggauauaaagauuggauccucuggauuagcuucgccaucuccugcuuucugcuuuguguugcccugcucggcuucauuaugugggcuugccagaaggggaauauccgcuguaacauuugcaucuga

SEQ ID NO: 196508 - RNA, 1701 nt, Artificial Sequence; identical to SEQ ID NO: 195465
  derived and/or modified sequence opt5 from hemagglutinin__InfluenzaA__ALE31998

SEQ ID NO: 196509 - RNA, 1701 nt, Artificial Sequence
  derived and/or modified sequence opt5 from hemagglutinin__InfluenzaA__ALE31999
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucuccacuauacauacccugcccugaacgucaccaugcccaauaacgagcaguuugacaaacuuuauauuuggggcgugcaucacccugggacggauaaggaccagaucuuccuguacgcgcaguccagcggaagaauuacaguuuccaccaagcggucucaacaggccgugaucccgaacaucggcagccgcccccggauuagagauaucccuucccgcauuagcaucuacuggacaauugucaagcccggggacauccuccugaucaauucuaccggaaaccugauugcuccuagaggcuauuuuaaaauccgguccgggaagucuucuauuaugcgcagcgacgcccccaucggaaaauguaaguccgaaugcauuaccccgaauggcucuaucccuaacgauaagcccuuccagaaugugaacagaaucacauacggcgcuuguccucgguaugugaaacacagcacgcucaagcuggccaccgggaugcgcaauguccccgagaaacagacaagaggaauuuuuggcgcgaucgccggguucauugaaaacggaugggagggcaugguugacgggugguacggauuucggcaucaaaauuccgagggcagaggccaggcugccgaucuuaagagcacccaggcugccaucgaccaaauuaacgggaaacugaaucgccucaucggaaagacaaacgaaaaauuccaccagauugagaaggaguucucugaaguggaaggccggauccaggaucuggagaaguauguggaggacaccaaaaucgaucuuugguccuacaaugccgaacugcucgucgcucuggagaaccagcauacgauugaccugacagauagcgaaaugaauaagcucuuugagaaaaccaagaaacaacugagagaaaacgcggaggacauggggaacggaugcuucaagaucuaucacaagugugauaaugccugcauuggcucuauccgcaacgggaccuacgaccacaauguguaccgggacgaggcucuuaacaauagauuucagauuaaaggcguugaacugaaguccggauauaaagauuggauccucuggaucagcuucgccauuuccugcuuucugcuuuguguggcccugcucggcuucaucaugugggcuugccagaaggggaacauucgcuguaauaucugcauuuga

SEQ ID NO: 196510 - RNA, 1701 nt, Artificial Sequence
  derived and/or modified sequence opt5 from hemagglutinin__InfluenzaA__ALE32000
augaagaccaucauugcccugagccacauccucugccugguguucgcucagaaacuucccgagaacgacaauuccacagccacgcugugucucggccaucacgcggucccuaacgggaccauuguuaagacaaucaccucugauagaauugaagugacaaaugcuaccgagcuggugcaaaacagcuccaucggagaaaucugcgacucuccgcaucagauucuugauggcaaaaauuguacacugaucgacgcccuccugggggauccccagugcgacggauuucagaacaagaaaugggaucuguucgucgagcggagcaaggccuacuccaauuguuauccuuacgacgugcccgauuaugcuucucuccgcagccugguugccuccagcggcacccuugaauuuaacgacgagucuuucaauugggcuggggugacgcaaaacggaaccuccagcgccugcauuagaggcucuaauuccagcuuuuucucucggcugaacuggcucacacacuccaauuuuaaguacccugcgcugaacgucaccaugcccaauaacgagcaguucgauaaacuuuauaucuggggcgugcaucacccugggacagacaaggaucagauuuuucuguacgcccagagcuccggacgcaucaccguuucuacgaaaagaagccaacaggcugugauuccgaacaucggcucccggccccgcaucagaaauauuccuagccggaucucuauuuauuggacaaucgucaagcccggggacauucuccugaucaacuccaccggaaaucugaucgccccucgcggcuacuucaaaauuagaagcgggaagucuagcaucaugcgguccgacgcucccauuggaaaguguaaaucugaaugcaucacaccgaacggcagcauuccuaaugauaagcccuuucagaacgugaaucgcaucaccuacggcgccuguccuagauaugugaaacaguccacccucaagcuggcgacagggaugcggaacguccccgagaaacaaacgcgcggaaucuucggcgccauugcuggguuuaucgaaaauggaugggagggcaugaaggacgggugguacggauucagacaccagaacagcgagggccggggccaggccgcugaucuuaaaucuacccaagccgccauugaccagaucaaugggaagcugaacagacucauuggaaagacaaaugaaaaauuccaucagaucgagaaggaauuuuccgagguugaaggccgcauucaggaucuggagaaauauguggaggacaccaagaucgaucuuuggagcuacaacgcugaacugcucguggcgcuggagaaucaacacacaaucgaccugaccgauucugaaaugaacaaacucuucgagaagacgaagaaacagcugcgggaaaacgccgaggacauggggaauggaugcuuuaagauuuaucauaaaugugauaacgcuugcaucggcuccauuagaaaugggacauacgaccacgacgucuaucgcgaugaggcccuuaacaaucgguuccagaucaagggcguggaacugaaaagcggauacaaggacuggauucucuggaucuccuuugccaucucuugcuuccugcuuuguguugcucugcucggcuuuauuaugugggccugccagaaggggaacaucagauguaauauuugcaucuga

SEQ ID NO: 196511 - RNA, 1701 nt, Artificial Sequence; identical to SEQ ID NO: 195465
  derived and/or modified sequence opt5 from hemagglutinin__InfluenzaA__ALE32001

SEQ ID NO: 196512 - RNA, 1701 nt, Artificial Sequence; identical to SEQ ID NO: 195465
  derived and/or modified sequence opt5 from hemagglutinin__InfluenzaA__ALE32002

SEQ ID NO: 196513 - RNA, 1701 nt, Artificial Sequence; identical to SEQ ID NO: 195565
  derived and/or modified sequence opt5 from hemagglutinin__InfluenzaA__ALE32003

SEQ ID NO: 196514 - RNA, 1701 nt, Artificial Sequence; identical to SEQ ID NO: 195465
  derived and/or modified sequence opt5 from hemagglutinin__InfluenzaA__ALE32004

SEQ ID NO: 196515 - RNA, 1701 nt, Artificial Sequence; identical to SEQ ID NO: 195465
  derived and/or modified sequence opt5 from hemagglutinin__InfluenzaA__ALE32005

SEQ ID NO: 196516 - RNA, 1701 nt, Artificial Sequence; identical to SEQ ID NO: 196009
  derived and/or modified sequence opt5 from hemagglutinin__InfluenzaA__ALE32006

SEQ ID NO: 196517 - RNA, 1701 nt, Artificial Sequence; identical to SEQ ID NO: 195465
  derived and/or modified sequence opt5 from hemagglutinin__InfluenzaA__ALE32007

SEQ ID NO: 196518 - RNA, 1701 nt, Artificial Sequence; identical to SEQ ID NO: 196016
  derived and/or modified sequence opt5 from hemagglutinin__InfluenzaA__ALE32008

SEQ ID NO: 196519 - RNA, 1701 nt, Artificial Sequence
  derived and/or modified sequence opt5 from hemagglutinin__InfluenzaA__ALE32009
augaagaccaucauugcccugagcuacauccucugccugguguucgcucagaaacuucccgagaacgacaauuccacagccacgcugugucucggccaccaugcggucccuaacgggaccauuguuaagacaaucaccucugauagaauugaagugacaaaugcuaccgagcuggugcaaaacagcuccaucggagaaaucugcgacucuccgcaccagauucuugauggcaaaaauuguacacugaucgacgcccuccugggggauccccagugcgacggauuucagaacaagaaaugggaucuguucgucgagcggagcaaggccuauuccaauuguuacccuuaugacgugcccgauuacgcuucucuccgcagccugguugccuccagcggcacccuugaauuuaacgacgagucuuucaauugggcuggggugacgcaaaacggaaccuccagcgccugcauuagaggcucuaauuccagcuuuuucucucggcugaacuggcucacacauuccaauuuuaaguauccugcgcugaacgucaccaugcccaauaacgagcaguucgauaaacuuuacaucuggggcgugcaccauccugggacagacaaggaucagauuuuucuguaugcccagagcuccggacgcaucaccguuucuacgaaaagaagccaacaggcugugauuccgaacaucggcucccggccccgcaucagaaauauuccuagccggaucucuauuuacuggacaaucgucaagcccggggacauucuccugaucaacuccaccggaaaucugaucgccccucgcggcuacuucaaaauuagaagcgggaagucuagcaucaugcgguccgacgcucccauuggaaaguguaaaucugaaugcaucacaccgaacggcagcauuccuaaugauaagcccuuucagaacgugaaucgcaucaccuauggcgccuguccuagauacgugaaacaguccacccucaagcuggcgacagggaugcggaacguccccgagaaacaaacgcgcggaaucuucggcgccauugcuggguuuaucgaaaauggaugggagggcaugaaggacgggugguauggauucagacaccagaacagcgagggccggggccaggccgcugaucuuaaaucuacccaagccgccauugaccagaucaaugggaagcugaacagacucauuggaaagacaaaugaaaaauuccaccagaucgagaaggaauuuuccgagguugaaggccgcauucaggaucuggagaaauacguggaggacaccaagaucgaucuuuggagcuauaacgcugaacugcucguggcgcuggagaaucaacauacaaucguccugaccgacucugaaaugaacaaacucuucgagaagacgaagaaacagcugcgggaaaacgccgaggauauggggaauggaugcuuuaagauuuaccacaaaugugacaacgcuugcaucggcuccauuagaaaugggacauaugaucaugacguguaccgcgacgaggcccuuaacaaucgguuccagaucaagggcguugaacugaaaagcggauacaaggauuggauucucuggaucuccuuugccaucucuugcuuccugcuuuguguggcucugcucggcuuuauuaugugggccugccaggaggggaacaucagauguaauauuugcaucuga

SEQ ID NO: 196520 - RNA, 1701 nt, Artificial Sequence
  derived and/or modified sequence opt5 from hemagglutinin__InfluenzaA__ALE32010
augaagaccaucauugcccugagcuacauccucugccuggcuuucgcccagaaaauucccggcaacgacaauuccacagcgacgcuuugucuggggcaccaugcugugccuaacggaaccaucgucaagacaauuaccaaugauagaaucgagguuacaaacgccaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucguggagcggucuaaggcuuauagcaacuguuacccuuaugacguccccgauuacgccucccugcgcucucucguggcuagcuccgggacccuggaauuuaauaacgagagcuucaauuggacgggaguuacccaaaacggcacaucuuccgccugcaucagacggagcagcuccagcuuuuucucucgccuuaauuggcugacccaucuccacuauacauacccugcgcugaacgugaccaugcccaauaacgagcaguuugacaaacuuuauauuuggggcguccaucacccugggacggauaaggaccagaucuuccuguacgcccaguccagcggaagaauuacaguguccaccaaacggucucaacaggcuguuaucccgaacaucggcagccgcccccggauuagagauaucccuucccgcauuagcaucuacuggacaauugugaagcccggggacauccuccugaucaauucuaccggaaaccugauugccccuagaggcuauuuuaaaauccgguccgggaagucuucuauuaugcgcagcgacgcucccaucggaaaauguaaguccgaaugcauuaccccgaauggcucuaucccuaacgauaagcccuuccagaaugucaacagaaucacauacggcgccuguccucgguaugugaaacacagcacgcucaagcuggcgaccgggaugcgcaaugugcccgagaaacagacaagaggaauuuuuggcgccaucgcuggguucauugaaaacggaugggagggcauggucgacgggugguacggauuucggcaucaaaauuccgagggcagaggccaggccgcugaucuuaagagcacccaggccgccaucgaccaaauuaacgggaaacugaaucgccucaucggaaagacaaacgaaaaauuccaccagauugagaaggaguucucugaaguugaaggccggauccaggaucuggagaaguauguggaggacaccaaaaucgaucuuugguccuacaaugcugaacugcucguggcgcuggagaaccagcauacgauugaccugacagauagcgaaaugaauaagcucuuugagaaaaccaagaaacaacugagagaaaacgccgaggacauggggaacggaugcuucaagaucuaucacaagugugauaaugcuugcauuggcucuauccgcaacgggaccuacgaccacaaugucuaccgggacgaggcccuuaacaauagauuucagauuaaaggcguggaacugaaguccggauauaaagauuggauccucuggaucagcuucgccauuuccugcuuucugcuuuguguugcucugcucggcuucaucaugugggccugccagaaggggaacauucgcuguaauaucugcauuuga

SEQ ID NO: 196521 - RNA, 1701 nt, Artificial Sequence; identical to SEQ ID NO: 196479
  derived and/or modified sequence opt5 from hemagglutinin__InfluenzaA__ALE32011

SEQ ID NO: 196522 - RNA, 1701 nt, Artificial Sequence; identical to SEQ ID NO: 196022
  derived and/or modified sequence opt5 from hemagglutinin__InfluenzaA__ALE32012

SEQ ID NO: 196523 - RNA, 1701 nt, Artificial Sequence; identical to SEQ ID NO: 195465
  derived and/or modified sequence opt5 from hemagglutinin__InfluenzaA__ALE32013

SEQ ID NO: 196524 - RNA, 1701 nt, Artificial Sequence
  derived and/or modified sequence opt5 from hemagglutinin__InfluenzaA__ALE32014
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaaagucuagcuccagcuuuuucucucggcuuaauuggcugacccagcucaacuauacauacccugcccugaaugucaccaugcccaacaacgagcaguuugacaaacuuuauauuuggggcgugcaucacccugggacggauaaggaccagaucuuccuguacgcgcaauccagcggacgcauuacaguuuccaccaagagaucucagcaggccgugaucccgaauaucggcagccggccccgcauuagagauaucccuucccggauuagcaucuacuggacaauugucaaacccggggacauccuccugaucaacucuaccggaaaucugauugcuccucgcggcuauuuuaagaucagauccgggaaaagcucuauuaugcggagcgacgcccccaucggaaaguguaaguccgaaugcauuaccccgaacggcucuaucccuaaugauaaacccuuccagaacgugaaucgcaucacauacggcgcuuguccuagauaugugaagcauagcacgcucaaacuggccaccgggaugcggaacguccccgagaagcaaacacgcggaauuuuuggcgcgaucgccggguucauugaaaauggaugggagggcaugguugacgggugguacggauuuagacaccagaacuccgagggccggggccaggcugccgaucuuaaaagcacccaagcugccaucgaccagauuaaugggaagcugaacagacucaucggaaaaacaaaugaaaaguuccaccagauugagaaggaguucucugaaguggaaggccgcauccaggaucuggagaaauauguggaggacaccaagaucgaucuuugguccuacaacgccgaacugcucgucgcucuggagaaucaacauacgauugaccugacagauagcgaaaugaacaaacucuuugagaagaccaaaaagcagcugcgggaaaacgcggaggacauggggaauggaugcuucaagaucuaucacaaaugugauaacgccugcauuggcucuaucagaaaugggaccuacgaccauaacguguaccgcgacgaggcucuuaauaaccgguuucagauuaagggcguugaacugaaauccggauauaaggauuggauccucuggaucagcuucgccauuuccugcuuucugcuuuguguggcccugcucggcuucaucaugugggcuugccagaaagggaauauuagauguaacaucugcauuuga

SEQ ID NO: 196525 - RNA, 1701 nt, Artificial Sequence; identical to SEQ ID NO: 196350
  derived and/or modified sequence opt5 from hemagglutinin__InfluenzaA__ALE32015

SEQ ID NO: 196526 - RNA, 1701 nt, Artificial Sequence; identical to SEQ ID NO: 195465
  derived and/or modified sequence opt5 from hemagglutinin__InfluenzaA__ALE32016

SEQ ID NO: 196527 - RNA, 1701 nt, Artificial Sequence; identical to SEQ ID NO: 195465
  derived and/or modified sequence opt5 from hemagglutinin__InfluenzaA__ALE32017

SEQ ID NO: 196528 - RNA, 1701 nt, Artificial Sequence; identical to SEQ ID NO: 195465
  derived and/or modified sequence opt5 from hemagglutinin__InfluenzaA__ALE32018

SEQ ID NO: 196529 - RNA, 1701 nt, Artificial Sequence; identical to SEQ ID NO: 196009
  derived and/or modified sequence opt5 from hemagglutinin__InfluenzaA__ALE32020

SEQ ID NO: 196530 - RNA, 1701 nt, Artificial Sequence; identical to SEQ ID NO: 196116
  derived and/or modified sequence opt5 from hemagglutinin__InfluenzaA__ALE32021

SEQ ID NO: 196531 - RNA, 1701 nt, Artificial Sequence; identical to SEQ ID NO: 196196
  derived and/or modified sequence opt5 from hemagglutinin__InfluenzaA__ALE32022

SEQ ID NO: 196532 - RNA, 1701 nt, Artificial Sequence; identical to SEQ ID NO: 195465
  derived and/or modified sequence opt5 from hemagglutinin__InfluenzaA__ALE32023

SEQ ID NO: 196533 - RNA, 1701 nt, Artificial Sequence
  derived and/or modified sequence opt5 from hemagglutinin__InfluenzaA__ALE32024
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugaugggaaaaacuguacacugaucgacgcccuccugggagauccccagugcgacggcuuucagaauaagcggugggaucuguucgucgaacgcucuaaagccuauagcaacuguuacccuuaugacgugcccgauuacgcuucccucagaucucugguugccagcuccgggacccuugaguuuaaugacgaauccuucaacugggcuggagugacgcaaaauggcaagucuuccgccugcauucggggcagcaacucuuccuuuuucagccgccugaauuggcucacccauucuaacuuuaaguauccugcgcugaaugucacaaugcccaacaacgagcaguucgauaaacuuuacaucuggggagugcaccauccugggaccgacaaggaucagauuuuucuguaugcccacuccagcggcagaaucacaguuuccaccaaacggucucagcaagcugugauuccgaauaucgggagccgccccagaauccggaacauuccuucccgcaucagcauuuacuggacgaucgucaagcccggagacauucuccugaucaauucuacaggcaaccugaucgccccuagaggguacuucaaaauucaguccggaaagagcucuaucaugcggagcgacgcucccauuggcaaguguaaauccgagugcaucaccccgaauggcucuauuccuaacgauaagcccuuucagaaugugaaccgcaucacauaugggaccuguccuagauacgugaaacagagcacccucaagcuggccacaggaaugcggaauguccccgaaaaacaaacgcgcggcaucuucggggcgauugccggauuuaucgagaacggcugggaagggaugaaggacggaugguauggcuucagacaccagaauagcgagggccgggggcaggcugccgaucuuaaaagcacccaagcugccauugaccagaucaacggaaagcugaauagacucauuggcaagacaaacgagaaauuccaucagaucgaaaaggaguuuucugaaguugaggggcgcauucaggaucuggaaaaauacguggaggacaccaagaucgaucuuugguccuauaaugccgagcugcucguggcucuggaaaaccaacacacaaucgaccugaccgauagcgagaugaacaaacucuucgaaaagacgaagaaacagcugcgggagaaugcggaagacaugggaaacggcugcuuuaagauuuaccauaaaugugauaaugccugcaucgggucuauuagaaacggcacauaugaccacuacgucuaccgcgacgaggcucuuaauaaccgguuccagaucaagggaguggagcugaaauccggcuauaaggauuggauucucuggaucagcuuugccaucuccugcuuccugcuuuguguugcccugcucggguuuauuaugugggcuugccagaagggaaauaucagauguaacauuugcaucuga

SEQ ID NO: 196534 - RNA, 1701 nt, Artificial Sequence
  derived and/or modified sequence opt5 from hemagglutinin__InfluenzaA__ALE32025
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaaagucuagcuccagcuuuuucucucggcuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcgcuccagcggaagaauuacaguuuccaccaagcggucucagcaagccgugaucccgaauaucggcagccgcccccggauuagagauaucccuucccgcauuagcaucuacuggacaauugucaaaucuggggacauccuccugaucaacuccaccggaaaucugauugcucccagaggcuauuuuaagauccggagcgggaaaucuagcauuaugcgcuccgacgccccuaucggaaaguguaagucugaaugcauuacccccaacggcagcaucccgaaugauaaaccuuuccagaacgugaauagaaucacauacggcgcuuguccccgguaugugaagcacuccacgcucaaacuggccaccgggaugcgcaacgucccugagaagcagacaagaggaauuuuuggcgcgaucgccggguucauugaaaauggaugggagggcaugguugacgggugguacggauuucggcaccagaacagcgagggcagaggccaagcugccgaucuuaaaucuacccaggcugccaucgaccagauuaaugggaagcugaaccgccucaucggaaaaacaaaugaaaaguuccaucaaauugagaaggaguucuccgaaguggaaggccggauccaggaucuggagaaauauguggaggacaccaagaucgaucuuuggagcuacaacgccgaacugcucgucgcucuggagaaucagcacacgauugaccugacagauucugaaauguccaaacucuuugagaagaccaaaaagcagcugagagaaaacgcggaggacauggggaacggaugcuucaagaucuaucauaaaugugauaaugccugcauuggcagcauccgcaacgggaccuacgaccacaauguguaccgggacgaggcucuuaacaauagauuucaaauuaagggcguugaacugaaauccggauauaaggauuggauccucuggaucucuuucgccauuagcugcuuucugcuuuguguggcccugcucggcuucaucaugugggcuugccagaaagggaacauucgcuguaauaucugcauuuga

SEQ ID NO: 196535 - RNA, 1701 nt, Artificial Sequence; identical to SEQ ID NO: 195465
  derived and/or modified sequence opt5 from hemagglutinin__InfluenzaA__ALE32026

SEQ ID NO: 196536 - RNA, 1701 nt, Artificial Sequence; identical to SEQ ID NO: 196009
  derived and/or modified sequence opt5 from hemagglutinin__InfluenzaA__ALE32027

SEQ ID NO: 196537 - RNA, 1701 nt, Artificial Sequence
  derived and/or modified sequence opt5 from hemagglutinin__InfluenzaA__ALE32028
augaagaccaucauugcccugagccacauccucugccugguguucgcucagaaaauucccggcaacgacaauuccacagccacgcuuugucuggggcaucacgcggucccuaacggaaccaucguuaagacaauuaccaaugauagaaucgaggugacaaacgcuaccgaacucgugcaaaauucuagcaucggcgagauuugcgacuccccgcaucagauccuggauggggaaaacuguacacuuauugacgcccugcucggagauccccagugcgacggcuuucagaauaaaaagugggaucuguucgucgagcggucuaaagccuacagcaacuguuauccuuacgacgugcccgauuaugcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaccucaacuacacauauccugcccugaaugucaccaugcccaacaacgagcaguuugacaaacuuuacauuuggggcgugcaucacccugggacggauaaggaccagaucuuccuguaugcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuacuuuaaaauccgguccgggaagucuucuauuaugcgcagcgacgcccccaucggaaaauguaaguccgaaugcauuaccccgaacggcucuaucccuaaugauaagcccuuccagaacgugaauagaaucacauauggcgcuuguccucgguacgugaaacacagcacgcucaagcuggccaccgggaugcgcaacguccccgagaaacagacaagaggaauuuuuggcgcgaucgccggguucauugaaaauggaugggagggcaugauggacgggugguauggauuucggcaucaaaacuccgagggcagaggccaggcugccgaucuuaagagcacccaggcugccaucgaccaaauuaaugggaaacugaaccgccucaucggaaagacaaaugaaaaauuccaccagauugagaaggaguucucugaaguugaaggccggauccaggaucuggagaaguacguggaggacaccaaaaucgaucuuugguccuauaacgccgaacugcucguggcucuggagaaucagcauacgauugaccugacagauagcgaaaugaacaagcucuuugagaaaaccaagaaacaacugagagaaaacgcggaggacauggggaauggaugcuucaagaucuaccacaagugugauaacgccugcauuggcucuauccgcaaugggaccuaugaccacaacgucuaccgggacgaggcucuuaauaacagauuucagauuaaaggcguggaacugaaguccggauacaaagauuggauccucuggaucagcuucgccauuuccugcuuucugcuuuguguugcccugcucggcuucaucaugugggcuugccagaaggggaauauucgcuguaacaucugcauuuga

SEQ ID NO: 196538 - RNA, 1701 nt, Artificial Sequence; identical to SEQ ID NO: 196116
  derived and/or modified sequence opt5 from hemagglutinin__InfluenzaA__ALE32029

SEQ ID NO: 196539 - RNA, 1701 nt, Artificial Sequence
  derived and/or modified sequence opt5 from hemagglutinin__InfluenzaA__ALE32030
augaagaccaucauugcccugagccacauccucugccugguguucgcucagaaaauucccggcaacgacaauuccacagccacgcuuugucuggggcaucacgcggucccuaacggaaccaucguuaagacaauuaccaaugauagaaucgaggugacaaacgcuaccgaacucgugcaaaauucuagcaucggcgagauuugcgacuccccgcaucagauccuggauggggaaaacuguacacuuauugacgcccugcucggagauccccagugcgacggcuuucagaauaaaaagugggaucuguucgucgagcggucuaaagccuacagcaacuguuauccuuacgacgugcccgauuaugcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaccucaacuacauuuauccugcccugaaugucacaaugcccaacaacgagcaguuugacaaacuuuacaucuggggcgugcaucacccugggaccgauaaggaccagauuuuccuguaugcgcaguccagcggaagaaucacgguuuccacaaagcggucucaacaggccgugaucccgaauauuggcagccgccccagaauccgggauauuccuucccgcaucagcauuuacuggaccaucgucaagcccggggacauccuccugauuaacucuacaggaaaucugaucgcuccuagaggcuacuuuaaaauucgguccgggaagucuucuaucaugcgcagcgacgcccccauuggaaaauguaaguccgaaugcaucaccccgaacggcucuaucccuaaugauaagcccuuccagaacgugaauagaauuaccuauggcgcuuguccucgguacgugaaacacagcacacucaagcuggccacggggaugcgcaacguccccgagaaacagaccagaggaaucuuuggcgcgauugccggguucaucgaaaauggaugggagggcaugauggacgggugguauggauuucggcaucaaaacuccgagggcagaggccaggcugccgaucuuaagagcacacaggcugccauugaccaaaucaaugggaaacugaaccgccucauuggaaagaccaaugaaaaauuccaccagaucgagaaggaguucucugaaguugaaggccggauccaggaucuggagaaguacguggaggacacaaaaauugaucuuugguccuauaacgccgaacugcucguggcucuggagaaucagcauaccaucgaccugacggauagcgaaaugaacaagcucuuugagaaaacaaagaaacaacugagagaaaacgcggaggacauggggaauggaugcuucaagauuuaccacaagugugauaacgccugcaucggcucuauucgcaaugggaccuaugaccacaacgucuaccgggacgaggcucuuaauaacagauuucagaucaaaggcguggaacugaaguccggauacaaagauuggauccucuggauuagcuucgccaucuccugcuuucugcuuuguguugcccugcucggcuucauuaugugggcuugccagaaggggaauauccgcuguaacauuugcaucuga

SEQ ID NO: 196540 - RNA, 1701 nt, Artificial Sequence
  derived and/or modified sequence opt5 from hemagglutinin__InfluenzaA__ALE32031
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgcccccaucggaaaauguaaguccgaaugcauuaccccgaacggcucuaucccuaaugauaagcccuuccagaacgugaauagaaucacauacggcgcuuguccucgguaugugaaacacagcacgcucaagcuggccaccgggaugcgcaacguccccgagaaacagacaagaggaauuuuuggcgcgaucgccggguucauugaaaauggaugggagggcaugauggacgggugguacggauuucggcaccaaaacuccgagggcagaggccaggcugccgaucuuaagagcacccaggcugccaucgaccaaauuaaugggaaacugaaccgccucaucggaaagacaaaugaaaaauuccaucagauugagaaggaguucucugaaguugaaggccggauccaggaucuggagaaguauguggaggacaccaaaaucgaucuuugguccuacaacgccgaacugcucguggcucuggagaaucagcacacgauugaccugacagauagcgaaaugaacaagcucuuugagaaaaccaagaaacaacugagagaaaacgcggaggacauggggaauggaugcuucaagaucuaucauaagugugauaacgccugcauuggcucuauccgcaaugggaccuacgaccacaacgucuaccgggacgaggcucuuaauaacagauuucagauuaaaggcguggaacugaaguccggauauaaagauuggauccucuggaucagcuucgccauuuccugcuuucugcuuuguguugcccugcucggcuucaucaugugggcuugccagaaggggaauauucgcuguaacaucugcauuuga

SEQ ID NO: 196541 - RNA, 1701 nt, Artificial Sequence
  derived and/or modified sequence opt5 from hemagglutinin__InfluenzaA__ALE32032
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauugccguuuccacaaagcggucucaacaggcugugaucccgaauaucggcagccgcccccggauuagagauaucccuucccgcauuagcaucuacuggaccauugucaagcccggggacauccuccugaucaacucuacaggaaaucugauugccccuagaggcuauuuuaaaauccgguccgggaagucuucuauuaugcgcagcgacgcucccaucggaaaauguaaguccgaaugcauuaccccgaacggcucuaucccuaaugauaagcccuuccagaacgugaauagaaucaccuacggcgccuguccucgguaugugaaacacagcacacucaagcuggcgacggggaugcgcaacguccccgagaaacagaccagaggaauuuuuggcgccaucgcuggguucauugaaaauggaugggagggcaugauggacgggugguacggauuucggcaccaaaacuccgagggcagaggccaggccgcugaucuuaagagcacacaggccgccaucgaccaaauuaaugggaaacugaaccgccucaucggaaagaccaaugaaaaauuccaucagauugagaaggaguucucugaaguugaaggccggauccaggaucuggagaaguauguggaggacacaaaaaucgaucuuugguccuacaacgcugaacugcucguggcgcuggagaaucagcacaccauugaccugacggauagcgaaaugaacaagcucuuugagaaaacaaagaaacaacugagagaaaacgccgaggacauggggaauggaugcuucaagaucuaucauaagugugauaacgcuugcauuggcucuauccgcaaugggaccuacgaccacaacgucuaccgggacgaggcccuuaauaacagauuucagauuaaaggcguggaacugaaguccggauauaaagauuggauccucuggaucagcuucgccauuuccugcuuucugcuuuguguugcucugcucggcuucaucaugugggccugccagaaggggaauauucgcuguaacaucugcauuuga

SEQ ID NO: 196542 - RNA, 1701 nt, Artificial Sequence; identical to SEQ ID NO: 195465
  derived and/or modified sequence opt5 from hemagglutinin__InfluenzaA__ALE32033

SEQ ID NO: 196543 - RNA, 1701 nt, Artificial Sequence
  derived and/or modified sequence opt5 from hemagglutinin__InfluenzaA__ALE32034
augaagaccaucauugcccugggcuacauccucugccugguguucgcucagaaaauucccgggaacgacaauagcacagccacgcuuugucugggacaccaugcggucccuaacggcaccaucguuaagacaauuaccaaugauagaaucgaggugacaaacgcuaccgaacucgugcaaaauuccucuaucggggagauuugcgacagcccgcacaaaauccuggauggagaaaacuguacacuuauugacgcccugcucggcgauccccagugcgacggguuucagaauaagaaaugggaucuguucgucgagcgguccaaggccuauucuaacuguuacccuuaugacgugcccgauuacgcuagccugcgcucccucguugccucuagcggaacccuggaauuuaauaacgaguccuucaauuggacgggcgugacccagaacggcacaagcucugcuugcaucagacgguccucuagcuccuuuuucagccgccuuaauuggcugacccaucucaaguauacauacccugcccugaacgucaccaugcccaauaacgagcaauuugacaaacuuuauauuuggggagugcaccauccugggacggauaaggaccagaucuuccuguacgcgcagucuuccggcagaauuacaguuagcaccaaacggucccagcaagccgugaucccgaacaucgggucucgcccccggauuagagauaucccuagccgcauuuccaucuacuggacaauugucaagcccggagacauccuccugaucaauagcaccggcaaccugauugcuccuagaggguauuuuaaaauccggucuggaaaguccagcauuaugcgcucugacgcccccaucggcaaguguaaaagcgaaugcauuaccccgaauggcuccaucccuaacgauaagcccuuccagaaugugaacagaaucacauacggggcuuguccucgguaugugaaacacucuacgcucaagcuggccaccggaaugcgcaauguccccgagaaacagacaagaggcauuuuuggggcgaucgccggauucauugaaaacggcugggaggggaugguugacggaugguacggcuuucggcaccagaauagcgagggcagagggcaagcugccgaucuuaaguccacccaggcugccaucgaccagauuaacggaaaacugaaucgccucaucggcaagacaaacgaaaaguuccaucaaauugagaaagaguucagcgaaguggaagggcggauccaggaucuggagaaguauguggaggacaccaaaaucgaucuuuggucuuacaaugccgaacugcucgucgcucuggagaaccagcacacgauugaccugacagauuccgaaaugaauaagcucuuugagaaaaccaagaagcagcugagagaaaacgcggaggacaugggaaacggcugcuucaaaaucuaucauaagugugauaaugccugcauugggagcauccgcaacggcaccuacgaccacaauguguaccgggacgaggcucuuaacaauagauuucaaauuaaaggaguugaacugaagucuggcuauaaagauuggauccucuggaucuccuucgccauuagcugcuuucugcuuuguguggcccugcucggguucaucaugugggcuugccagaagggaaacauucgcuguaauaucugcauuuga

SEQ ID NO: 196544 - RNA, 1701 nt, Artificial Sequence; identical to SEQ ID NO: 196355
  derived and/or modified sequence opt5 from hemagglutinin__InfluenzaA__ALE32035

SEQ ID NO: 196545 - RNA, 1701 nt, Artificial Sequence
  derived and/or modified sequence opt5 from hemagglutinin__InfluenzaA__ALE32036
augaagaccaucauugcccugggcuacauccucugccugguguucgcucagaaaauucccgggaacgacaauagcacagccacgcuuugucugggacaccaugcggucccuaacggcaccaucguuaagacaauuaccaaugauagaaucgaggugacaaacgcuaccgaacucgugcaaaauuccucuaucggggagauuugcgacagcccgcacaaaauccuggauggagaaaacuguacacuuauugacgcccugcucggcgauccccagugcgacggguuucagaauaagaaaugggaucuguucgucgagcgguccaaggccuauucuaacuguuacccuuaugacgugcccgauuacgcuagccugcgcucccucguugccucuagcggaacccuggaauuuaauaacgaguccuucaauuggacgggcgugacccagaacggcacaagcucugcuugcaucagacgguccucuagcuccuuuuucagccgccuuaauuggcugacccaucuccacuauacauacccugcccugaacgucaccaugcccaauaacgagcaauuugacaaacuuuauauuuggggagugcaucacccugggacggauaaggaccagaucuuccuguacgcgcagucuuccggcagaauuacaguuagcaccaagcggucccagcaagccgugaucccgaacaucgggucucgcccccggauuagagauaucccuagccgcauuuccaucuacuggacaauugucaaacccggagacauccuccugaucaauagcaccggcaaccugauugcuccuagaggguauuuuaagauccggucuggaaaauccagcauuaugcgcucugacgcccccaucggcaaguguaagagcgaaugcauuaccccgaauggcuccaucccuaacgauaaacccuuccagaaugugaacagaaucacauacggggcuuguccucgguaugugaagcacucuacgcucaaacuggccaccggaaugcgcaauguccccgagaagcagacaagaggcauuuuuggggcgaucgccggauucauugaaaacggcugggaggggaugguugacggaugguacggcuuucggcaucagaauagcgagggcagagggcaagcugccgaucuuaaauccacccaggcugccaucgaccagauuaacggaaagcugaaucgccucaucggcaaaacaaacgaaaaguuccaccaaauugagaaggaguucagcgaaguggaagggcggauccaggaucuggagaaauauguggaggacaccaagaucgaucuuuggucuuacaaugccgaacugcucgucgcucuggagaaccagcauacgauugaccugacagauuccgaaaugaauaaacucuuugagaagaccaaaaagcagcugagagaaaacgcggaggacaugggaaacggcugcuucaagaucuaucacaaaugugauaaugccugcauugggagcauccgcaacggcaccuacgaccacaauguguaccgggacgaggcucuuaacaauagauuucaaauuaagggaguugaacugaaaucuggcuauaaggauuggauccucuggaucuccuucgccauuagcugcuuucugcuuuguguggcccugcucggguucaucaugugggcuugccagaaaggaaacauucgcuguaauaucugcauuuga

SEQ ID NO: 196546 - RNA, 1701 nt, Artificial Sequence
  derived and/or modified sequence opt5 from hemagglutinin__InfluenzaA__ALE32037
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauaaguacccugcccugaaugucacaaugcccaacaacgagcaguuugacaaacuuuauauuuggggcgugcaccauccugggaccgauaaagaccagaucuuccuguacgcgcaguccagcggaagaauuacgguuuccacaaagcggucucaacaggccgugaucccgaauaucggcagccgcccccggauuagagauaucccuucccgcauuagcaucuacuggaccauugucaaacccggggacauccuccugaucaacucuacaggaaaucugauugcuccuagaggcuauuuuaagauccucuccgggaaaagcucuauuaugcggagcgacgcccccaucggaaaguguaaguccgaaugcauuaccccgaacggcucuaucccuaaugauaaacccuuccagaacgugaaucgcaucaccuacggcgcuuguccuagauaugugaagcacagcacacugaaacuugccacggggaugcggaacguccccgagaagcagacccgcggaauuuuuggcgcgaucgccggguucauugaaaauggaugggagggcaugguugacgggugguacggauuuagacaccaaaacuccgagggccggggccaggcugccgaucugaaaagcacacaggcugccaucgaccaaauuaaugggaagcucaacagacugaucggaaaaaccaaugaaaaguuccaucagauugagaaggaguucucugaaguggaaggccgcauccaggaucuugagaaauauguggaggacacaaagaucgaucugugguccuacaacgccgaacuccuggucgcucuggagaaucagcacaccauugaccucacggauagcgaaaugaacaaacuguuugagaagacaaagaagcaacuucgggaaaacgcggaggacauggggaauggaugcuucaagaucuaucauaaaugugauaacgccugcauuggcucuaucagaaaugggaccuacgaccacaacguguaccgcgacgaggcucugaauaaccgguuucagauuaagggcguugaacucaaauccggauauaaggauuggauccuguggaucagcuucgccauuuccugcuuucuucuguguguggcccuccugggcuucaucaugugggcuugccagaaagggaauauuagauguaacaucugcauuuga

SEQ ID NO: 196547 - RNA, 1701 nt, Artificial Sequence
  derived and/or modified sequence opt5 from hemagglutinin__InfluenzaA__ALE32038
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaaacggucucaacaggccgugaucccgaauaucggcagccgcccccggauuagagauaucccuucccgcauuagcaucuacuggacaauugucaagcccggggacauccuccugaucaacucuaaaggaaaucugauugcuccuagaggcuauuuuaagauccgguccgggaaaagcucuauuaugcgcagcgacgcccccaucggaaaguguaaguccgaaugcauuaccccgaacggcucuaucccuaaugauaaacccuuccagaacgugaauagaaucaccuacggcgcuuguccucgguaugugaagcacagcacacucaaacuggccacggggaugcgcaacguccccgagaagcagaccagaggaauuuuuggcgcgaucgccggguucauugaaaauggaugggagggcaugguugacgggugguacggauuucggcaccuuaacuccgagggcagaggccaagcugccgaucugaaaagcacacaggcugccaucgaccagauuaaugggaagcucaaccgccugaucggaaaaaccaaugaaaaguuccaucaaauugagaaggaguucucugaaguggaaggccggauccaggaucuugagaaauauguggaggacacaaagaucgaucugugguccuacaacgccgaacuccuggucgcucuggagaaucagcacaccauugaccucacggauagcgaaaugaacaaacuguuugagaagacaaagaagcagcuuagagaaaacgcggaggacauggggaauggaugcuucaagaucuaucauaaaugugauaacgccugcauuggcucuauccgcaaugggaccuacgaccacaacguguaccgggacgaggcucugaauaacagauuucaaauuaagggcguugaacucaaauccggauauaaggauuggauccuguggaucagcuucgccauuuccugcuuucuucuguguguggcccuccugggcuucaucaugugggcuugccagaaagggaauauucgcuguaacaucugcauuuga

SEQ ID NO: 196548 - RNA, 1701 nt, Artificial Sequence; identical to SEQ ID NO: 196123
  derived and/or modified sequence opt5 from hemagglutinin__InfluenzaA__ALE32039

SEQ ID NO: 196549 - RNA, 1701 nt, Artificial Sequence
  derived and/or modified sequence opt5 from hemagglutinin__InfluenzaA__ALE32040
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaccagcucuauuaugcgcagcgacgcccccaucggaaaguguaaauccgaaugcauuacaccgaacggcucuaucccuaaugauaagcccuuccagaacgugaauagaaucacguacggcgcuuguccucgguaugugaagcacagcacccucaaacuggccacagggaugcgcaacguccccgagaagcagaccagaggaauuuuuggcgcgaucgccggguucauugaaaauggaugggagggcaugguugacgggugguacggauuucggcaccaaaacuccgagggcagaggccaggcugccgaucuuaaaagcacacaggcugccaucgaccaaauuaaugggaagcugaaccgccucaucggaaaaaccaaugaaaaguuccaucagauugagaaagaguucucugaaguggaaggccggauccaggaucuggagaaguauguggaggacacgaagaucgaucuuugguccuacaacgccgaacugcucgucgcucuggagaaucagcacacaauugaccugaccgauagcgaaaugaacaaacucuuugagaagaccaaaaagcaacugagagaaaacgcggaggacauggggaauggaugcuucaaaaucuaucauaagugugauaacgccugcauuggcucuauccgcaaugggacauacgaccacaacguguaccgggacgaggcucuuaauaacagauuucagauuaagggcguugaacugaaauccggauauaaggauuggauccucuggaucagcuucgccauuuccugcuuucugcuuuguguggcccugcucggcuucaucaugugggcuugccagaaagggaauauucgcuguaacaucugcauuuga

SEQ ID NO: 196550 - RNA, 1701 nt, Artificial Sequence; identical to SEQ ID NO: 195465
  derived and/or modified sequence opt5 from hemagglutinin__InfluenzaA__ALE32041

SEQ ID NO: 196551 - RNA, 1701 nt, Artificial Sequence; identical to SEQ ID NO: 195465
  derived and/or modified sequence opt5 from hemagglutinin__InfluenzaA__ALE32042

SEQ ID NO: 196552 - RNA, 1701 nt, Artificial Sequence
  derived and/or modified sequence opt5 from hemagglutinin__InfluenzaA__ALE32043
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacaccucccugcgcucucucguugcuagcuccgggacgcuggaauuuaauaacgagagcuucaauuggaccggagugacacaaaacggcaccucuuccgccugcaucagacggagcagcuccagcuuuuucucucgccuuaauuggcugacacaucucaacuauaccuacccugcucugaaugucacgaugcccaacaacgagcaguuugacaaacuuuauauuuggggcgugcaccauccugggacagauaaggaccagaucuuccuguacgcccaguccagcggaagaauuaccguuuccacaaagcggucucaacaggcggugaucccgaauaucggcagccgcccccggauuagagauaucccuucccgcauuagcaucuacuggaccauugucaagcccggggacauccuccugaucaacucuaccggaaaucugauugccccuagaggcuauuuuaaaauccgguccgggaagucuucuauuaugcgcagcgacgcucccaucggaaaauguaaguccgaaugcauuacaccgaacggcucuaucccuaaugauaagcccuuccagaacgugaauagaaucacguacggcgccuguccucgguaugugaaacacagcacccucaagcuggcuacagggaugcgcaacguccccgagaaacagaccagaggaauuuuuggcgccaucgcgggguucauugaaaauggaugggagggcaugguugacgggugguacggauuucggcaccaaaacuccgagggcagaggccaggccgcugaucuuaagagcacacaggccgcuaucgaccaaauuaaugggaaacugaaccgccucaucggaaagaccaaugaaaaauuccaucagauugagaaggaguucucugaaguggaaggccggauccaggaucuggagaaguauguggaggacacgaaaaucgaucuuugguccuacaacgccgaacugcucgucgcccuggagaaucagcacacaauugaccugaccgauagcgaaaugaacaagcucuuugagaaaaccaagaaacaacugagagaaaacgcugaggacauggggaauggaugcuucaagaucuaucauaagugugauaacgcgugcauuggcucuauccgcaaugggacauacgaccacaacguguaccgggacgaggcccuuaauaacagauuucagauuaaaggcguugaacugaaguccggauauaaagauuggauccucuggaucagcuucgcuauuuccugcuuucugcuuuguguggcccugcucggcuucaucaugugggccugccagaaggggaauauucgcuguaacaucugcauuuga

SEQ ID NO: 196553 - RNA, 1701 nt, Artificial Sequence; identical to SEQ ID NO: 195465
  derived and/or modified sequence opt5 from hemagglutinin__InfluenzaA__ALE32044

SEQ ID NO: 196554 - RNA, 1701 nt, Artificial Sequence; identical to SEQ ID NO: 195465
  derived and/or modified sequence opt5 from hemagglutinin__InfluenzaA__ALE32045

SEQ ID NO: 196555 - RNA, 1701 nt, Artificial Sequence; identical to SEQ ID NO: 195465
  derived and/or modified sequence opt5 from hemagglutinin__InfluenzaA__ALE32046

SEQ ID NO: 196556 - RNA, 1701 nt, Artificial Sequence
  derived and/or modified sequence opt5 from hemagglutinin__InfluenzaA__ALE32047
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagguccuggauggggaaaacuguacacuuaucgacgcccugcucggagauccccagugcgacggcuuucagaauaaaaagugggaucuguucguggagcggucuaaagccuauagcaacuguuacccuuaugacguucccgauuacgcuucccugcgcucucucguggccagcuccgggacccuggaauuuaauaacgagagcuucaauuggacgggagucacccaaaacggcacaucuuccgcuugcauuagacggagcagcuccagcuuuuucucucgccuuaauuggcugacccaucucaacuauacauacccugcccugaaugugaccaugcccaacaacgagcaguuugacaagcuguauaucuggggcguucaccauccugggacggauaaggaccagauuuuccuguacgcgcaguccagcggaagaaucacaguguccaccaaacggucucaacaggccgucauuccgaauaucggcagccgccccagaauccgggauauuccuucccgcaucagcauuuacuggacaaucgugaagcccggggacauucuccugaucaacucuaccggaaaucugaucgcuccuagaggcuauuuuaaaauucgguccgggaagucuucuaucaugauuagcgacgcccccaucggaaaauguaaguccgaaugcauuaccccgaacggcucuaucccuagcgauaagcccuuccagaaugugaaccgcaucacauacggcgcuuguccuagauaugucaaacacuccacgcucaagcuggccaccgggaugcggaauguucccgagaaacagacacgcggaauuuuuggcgcgaucgccggguucauugaaaacggaugggagggcaugguggacgggugguacggauuuagacaccaaaauagcgagggccggggccaggcugccgaucuuaagucuacccaggcugccaucgaccaaauuaacgggaaacugaauagacucaucggaaagacaaacgaaaaauuccaucagauugagaaggaguucuccgaaguggaaggccgcauccaggaucuggagaaguaugucgaggacaccaaaaucgaucuuuggagcuacaaugccgaacugcucguggcucuggagaaccagcacacgauugaccugacagauucugaaaugaauaagcucuuugagaaaaccaagaaacaacugcgggaaaacgcggaggacauggggaacggaugcuucaagaucuaucauaagugugauaaugccugcauuggcuccaucagaaacgggaccuacgaccacaauguuuaccgcgacgaggcucuuaacaaucgguuucagauuaaaggcguggaacuuaagagcggauauaaagauuggauccucuggaucuccuucgccauuucuugcuuucugcuuugugucgcccugcucggcuucaucaugugggcuugccagaaggggaacauuagauguaauaucugcauuuga

SEQ ID NO: 196557 - RNA, 1701 nt, Artificial Sequence; identical to SEQ ID NO: 195465
  derived and/or modified sequence opt5 from hemagglutinin__InfluenzaA__ALE32048

SEQ ID NO: 196558 - RNA, 1701 nt, Artificial Sequence; identical to SEQ ID NO: 196123
  derived and/or modified sequence opt5 from hemagglutinin__InfluenzaA__ALE32049

SEQ ID NO: 196559 - RNA, 1701 nt, Artificial Sequence
  derived and/or modified sequence opt5 from hemagglutinin__InfluenzaA__ALE32050
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaagacggcacaucuuccgcuugcaucagacggagcagcuccagcuuuuucucucgccuuaacuggcugacccaucucaauuauacauacccugcccugaacgucaccaugcccaauaacgagcaguuugauaaacuuuauauuuggggcgugcaccauccugggacggacaaggaucagaucuuccuguacgcgcaguccagcggaagaauuacaguuuccaccaagcggucucaacaggccgugaucccgaacaucggcagccgcccccggauuagagacaucccuucccgcauuagcaucuacuggacaauugucaagcccggggacauccuccugaucaauucuaccggaaaccugauugcuccuagaggcuauuuuaaaauccgguccgggaagucuucuauuaugcgcagcgaugcccccaucggaaaauguaaguccgaaugcauuaccccgaauggcucuaucccuaacgacaagcccuuccagaaugugaacagaaucacauacggcgcuuguccucgguaugugaaacacagcacgcucaagcuggccaccgggaugcgcaauguccccgagaaacagacaagaggaauuuuuggcgcgaucgccggguucauugaaaacggaugggagggcaugguugaugggugguacggauuucggcaccaaaauuccgagggcagaggccaggcugccgaccuuaagagcacccaggcugccaucgaucaaauuaacgggaaacugaaucgccucaucggaaagacaaacgaaaaauuccaucagauugagaaggaguucucugaaguggaaggccggauccaggaccuggagaaguauguggaggauaccaaaaucgaccuuugguccuacaaugccgaacugcucgucgcucuggagaaccagcacacgauugaucugacagacagcgaaaugaauaagcucuuugagaaaaccaagaaacaacugagagaaaacgcggaggauauggggaacggaugcuucaagaucuaucauaagugugacaaugccugcauuggcucuauccgcaacgggaccuacgaccacaauguguaccgggaugaggcucuuaacaauagauuucagauuaaaggcguugaacugaaguccggauauaaagacuggauccucuggaucagcuucgccauuuccugcuuucugcuuuguguggcccugcucggcuucaucaugugggcuugccagaaggggaacauucgcuguaauaucugcauuuga

SEQ ID NO: 196560 - RNA, 1701 nt, Artificial Sequence
  derived and/or modified sequence opt5 from hemagglutinin__InfluenzaA__ALE32051
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgcccccaucggaaaauguaaguccgaaugcauuaccccgaacggcucuaucccuaaugauaagcccuuccagaacgugaauagagugacauacggcgcuuguccucgguaugucaaacacagcacgcucaagcuggccaccgggaugcgcaacguucccgagaaacagacaagaggaaucuuuggcgcgauugccggguucaucgaaaauggaugggagggcaugguggacgggugguacggauuucggcaccaaaacuccgagggcagaggccaggcugccgaucuuaagagcacccaggcugccauugaccaaaucaaugggaaacugaaccgccucauuggaaagacaaaugaaaaauuccaucagaucgagaaggaguucucugaaguggaaggccggauucaggaucuggagaaguaugucgaggacaccaaaaucgaucuuugguccuacaacgccgaacugcucguggcucuggagaaucagcacacgaucgaccugacagauagcgaaaugaacaagcucuuugagaaaaccaagaaacaacugagagaaaacgcggaggacauggggaauggaugcuucaagauuuaucauaagugugauaacgccugcaucggcucuauucgcaaugggaccuacgaccacaacguuuaccgggacgaggcucuuaucaauagauuucagauuaaaggcguggaacugaaguccggauauaaagauuggauccucuggaucagcuucgccauuuccugcuuucugcuuugugucgcccugcucggcuucaucaugugggcuugccagaaggggaacauucgcuguaauaucugcauuuga

SEQ ID NO: 196561 - RNA, 1701 nt, Artificial Sequence; identical to SEQ ID NO: 195465
  derived and/or modified sequence opt5 from hemagglutinin__InfluenzaA__ALE32052

SEQ ID NO: 196562 - RNA, 1701 nt, Artificial Sequence; identical to SEQ ID NO: 195465
  derived and/or modified sequence opt5 from hemagglutinin__InfluenzaA__ALE32053

SEQ ID NO: 196563 - RNA, 1701 nt, Artificial Sequence
  derived and/or modified sequence opt5 from hemagglutinin__InfluenzaA__ALE32054
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgaauccccgcaccagauccuggacggggagaacuguacacuuauugaugcccugcucggagacccccagugcgauggcuuucagaauaaaaagugggaccuguucgucgaacggucuaaagccuauagcaacuguuacccuuaugaugugcccgacuacgcuucccugcgcucucucguugccagcuccgggacccuggaguuuaauaacgagagcuucaauuggacgggagugacccaaaacggcacaucuuccgcuugcaucagacggucuagcuccagcuuuuucucucgccuuaauuggcugacccaucucaacuauacauacccugcccugaaugucaccaugcccaacaacgaacaguuugauaaacuuuauauuuggggcgugcaccauccugggacggacaaggaucagaucuuccuguacgcgcaguccagcggaagaauuacaguuuccaccaaaggcucucaacaggccgugaucccgaauaucgggagccggccccgcauuagagacaucccuucccggauuagcaucuacuggacaauugucaagcccggagauauccuccugaucaacucuaccggcaaucugauugcuccucgcggguauuuuaaaaucagauccggaaagagcucuauuaugcggagcgacgcccccaucggcaaauguaaguccgagugcauuaccccgaacggcucuaucccuaaugacaagcccuuccagaacgugaaucgcaucacauacggggcuuguccuagauaugugaaacacagcacgcucaagcuggccaccggaaugcggaacguccccgaaaaacagacacgcggcauuuuuggggcgaucgccggauucauugagaauggcugggaggggaugguugauggaugguacggcuuuagacaccaaaacuccgaaggccgggggcaggcugccgaccuuaagagcacccaggcugccaucgaucaaauuaauggaaaacugaacagacucaucggcaagacaaaugagaaauuccaucagauugaaaaggaguucucugaaguggaggggcgcauccaggaccuggagaaguauguggaagauaccaaaaucgaccuuugguccuacaacgccgagcugcucgucgcucuggaaaaucagcacacgauugaucugacagacagcgagaugaacaagcucuuugaaaagaccaagaaacaacugcgggagaacgcggaggauaugggaaauggcugcuucaagaucuaucauaagugugacaacgccugcauugggucuaucagaaauggcaccuacgaucacaacguguaccgcgacgaagcucuuaauaaccgguuucagauuaaaggaguugagcugaaguccggcuauaaagacuggauccucuggaucagcuucgccauuuccugcuuucugcuuuguguggcccugcucggguucaucaugugggcuugccagaagggaaauauuagauguaaccacugcaucuga

SEQ ID NO: 196564 - RNA, 1701 nt, Artificial Sequence
  derived and/or modified sequence opt5 from hemagglutinin__InfluenzaA__ALE32055
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauaaguacccugcccugaaugucacaaugcccaacaacgagcaguuugacaaacuuuauauuuggggcgugcaccauccugggaccgauaaagaccagaucuuccuguacgcgcaguccagcggaagaauuacgguuuccacaaagcggucucaacaggccgugaucccgaauaucggcagccgcccccggauuagagauaucccuucccgcauuagcaucuacuggaccauugucaaacccggggacauccuccugaucaacucuacaggaaaucugauugcuccuagaggcuauuuuaagauccgguccgggaaaagcucuauuaugcgcagcgacgcccccaucggaaaguguaaguccgaaugcauuaccccgaacggcucuaucccuaaugauaaacccuuccagaacgugaauagaaucaccuacggcgcuuguccucgguaugugaagcacagcacacucaaacuggccacggggaugcgcaacguccccgagaagcagaccagaggaauuuuuggcgcgaucgccggguucauugaaaauggaugggagggcaugguugacgggugguacggauuucggcaccaaaacuccgagggcagaggccaggcugccgaucuuaaaagcacacaggcugccaucgaccaaauuaaugggaagcugaaccgccucaucggaaaaaccaaugaaaaguuccaucagauugagaaggaguucucugaaguggaaggccggauccaggaucuggagaaauauguggaggacacaaagaucgaucuuugguccuacaacgccgaacugcucgucgcucuggagaaucagcacaccauugaccugacggauagcgaaaugaacaaacucuuugagaagacaaagaagcaacugagagaaaacgcggaggacauggggaauggaugcuucaagaucuaucauaaaugugauaacgccugcauuggcucuauccgcaaugggaccuacgaccacaacguguaccgggacgaggcucuuaauaacagauuucagauuaagggcguugaacugaaauccggauauaaggauuggauccucuggaucagcuucgccauuuccugcuuucugcuuuguguggcccugcucggcuucaucaugugggcuugccagaaugggaacauucgcuguaauaucugcauuuga

SEQ ID NO: 196565 - RNA, 1701 nt, Artificial Sequence; identical to SEQ ID NO: 196116
  derived and/or modified sequence opt5 from hemagglutinin__InfluenzaA__ALE32056

SEQ ID NO: 196566 - RNA, 1701 nt, Artificial Sequence
  derived and/or modified sequence opt5 from hemagglutinin__InfluenzaA__ALE32057
augaagaccaucauugcccugagcuacgugcucugccuggucuucgcucagaaaauccccggcaacgacaauuccacagccacgcuuugucuggggcaccaugcgguuccuaacggaaccauugugaagacaaucaccaaugauagaauugaggugacaaacgcuaccgaacucguccaaaauucuagcaucggcgagaucugcgacuccccgcaccagauucuggauggggaaaacuguacacuuaucgacgcccugcucggagauccccagugcgacggcuuucagaauaaaaagugggaucuguucguggagcggucuaaagccuauagcaacuguuacccuuaugacguucccgauuacgcuucccugcgcucucucguggccagcuccgggacccuggaauuuaauaacgagagcuucaauuggacgggagucacccaaaacggcacaucuuccgcuugcauuagacggagcagcuccagcuuuuucucucgccuuaauuggcugacccaucucaacuauacauacccugcccugaaugugaccaugcccaacaacgagcaguuugacaaacuuuauaucuggggcguucaccauccugggacggauaaggaccagauuuuccuguacgcgcaguccagcggaagaaucacaguguccaccaagcggucucaacaggccgucauuccgaauaucggcagccgccccagaauccgggauauuccuucccgcaucagcauuuacuggacaaucgugaagcccggggacauucuccugaucaacucuaccggaaaucugaucgcuccuagaggcuauuuuaaaauucgguccgggaagucuucuaucaugcgcagcgacgcccccauuggaaaauguaaguccgaaugcaucaccccgaacggcucuauuccuaaugauaagcccuuccagaacgugaauagaaucacauacggcgcuuguccucgguaugucaaacacagcacgcucaagcuggccaccgggaugcgcaacguucccgagaaacagacaagaggaaucuuuggcgcgauugccggguucaucgaaaauggaugggagggcaugguggacgggugguacggauuucggcaccaaaacuccgagggcagaggccaggcugccgaucuuaagagcacccaggcugccauugaccaaaucaaugggaaacugaaccgccucauuggaaagacaaaugaaaaauuccaucagaucgagaaggaguucucugaaguggaaggccggauucaggaucuggagaaguaugucgaggacaccaaaaucgaucuuugguccuacaacgccgaacugcucguggcucuggagaaucagcacacgaucgaccugacagauagcgaaaugaacaagcucuuugagaaaaccaagaaacaacugagagaaaacgcggaggacauggggaauggaugcuucaagauuuaucauaagugugauaacgccugcaucggcucuauucgcaaugggaccuacgaccacaacguuuaccgggacgaggcucuuaauaacagauuucagaucaaaggcguggaacugaaguccggauauaaagauuggauucucuggaucagcuucgccaucuccugcuuucugcuuugugucgcccugcucggcuucauuaugugggcuugccagaaggggaauauccgcuguaacauuugcaucuga

SEQ ID NO: 196567 - RNA, 1701 nt, Artificial Sequence; identical to SEQ ID NO: 195465
  derived and/or modified sequence opt5 from hemagglutinin__InfluenzaA__ALE32058

SEQ ID NO: 196568 - RNA, 1701 nt, Artificial Sequence; identical to SEQ ID NO: 195465
  derived and/or modified sequence opt5 from hemagglutinin__InfluenzaA__ALE32059

SEQ ID NO: 196569 - RNA, 1701 nt, Artificial Sequence
  derived and/or modified sequence opt5 from hemagglutinin__InfluenzaA__ALE32060
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagguuuuccuguacgcgcaguccagcggaagaaucacaguguccaccaagcggucucaacaggccgucauuccgaauaucggcagccgccccagaauccgggauauuccuucccgcaucagcauuuacuggacaaucgugaagcccggggacauucuccugauccacucuaccggaaaccugaucgcuccuagaggcuauuuuaaaauucgguccgggaagucuucuaucaugcgcagcgacgcccccauuggaaaauguaaguccgaaugcaucaccccgaauggcucuauuccuaacgauaagcccuuccagaaugugaacagaaucacauacggcgcuuguccucgguaugucaaacacagcacgcucaagcuggccaccgggaugcgcaauguucccgagaaacagacaagaggaaucuuuggcgcgauugccggguucaucgaaaacggaugggagggcaugguggacgggugguacggauuucggcaucaaaauuccgagggcagaggccaggcugccgaucuuaagagcacccaggcugccauugaccaaaucaacgggaaacugaaucgccucauuggaaagacaaacgaaaaauuccaccagaucgagaaggaguucucugaaguggaaggccggauucaggaucuggagaaguaugucgaggacaccaaaaucgaucuuugguccuacaaugccgaacugcucguggcucuggagaaccagcauacgaucgaccugacagauagcgaaaugaauaagcucuuugagaaaaccaagaaacaacugagagaaaacgcggaggacauggggaacggaugcuucaagauuuaucacaagugugauaaugccugcaucggcucuauucgcaacgggaccuacgaccacaauguuuaccgggacgaggcucuuaacaauagauuucagaucaaaggcguggaacugaaguccggauauaaagauuggauucucuggaucagcuucgccaucuccugcuuucugcuuugugucgcccugcucggcuucauuaugugggcuugccagaaggggaacauccgcuguaauauuugcaucuga

SEQ ID NO: 196570 - RNA, 1701 nt, Artificial Sequence
  derived and/or modified sequence opt5 from hemagglutinin__InfluenzaA__ALE32061
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaaguauacauacccugcccugaacgucaccaugcccaauaacgagcaguuugacaaacuuuauauuuggggcgugcaccauccugggacggauaacgaccagaucuuccuguacgcgagauccagcggacggauuacaguuuccaccaagggcucucagcaagccgugaucccgaauaucgggagccgcccccggauuagagauaucccuucccgcauuagcaucuacuggacaauugucaagcccggagacauccuccugaucaacucuaccggcaaucugauugcuccuagaggguauuuuaaaauccgguccggaaagagcucuauuaugcgcagcgacgcccccaucggcaaauguaaguccgaaugcauuaccccgaacggcucuaucccuaaugauaagcccuuccagaacgugaauagaaucacauacggggcuuguccucgguaugugaaacacagcacgcucaagcuggccaccggaaugcgcaacguccccgagaaacagacaagaggcauuuuuggggcgaucgccggauucauugaaaauggcugggaggggaugguugacggaugguacggcuuucggcaccagaacuccgagggcagagggcaagcugccgaucuuaagagcacccaggcugccaucgaccagauuaauggaaaacugaaccgccucaucggcaagacaaaugaaaaauuccaucaaauugagaaggaguucucugaaguggaagggcggauccaggaucuggagaaguauguggaggacaccaaaaucgaucuuugguccuacaacgccgaacugcucgucgcucuggagaaucagcacacgauugaccugacagauagcgaaaugaacaagcucuuugagaaaaccaagaaacagcugagagaaaacgcggaggacaugggaaauggcugcuucaagaucuaucauaagugugauaacgccugcauugggucuauccgcaauggcaccuacgaccacaacguguaccgggacgaggcucuuaauaacagauuucaaauuaaaggaguugaacugaaguccggcuauaaagauuggauccucuggaucagcuucgccauuuccugcuuucugcuuuguguggcccugcucggguucaucaugugggcuugccagaagggaaauauucgcuguaacaucugcauuuga

SEQ ID NO: 196571 - RNA, 1701 nt, Artificial Sequence
  derived and/or modified sequence opt5 from hemagglutinin__InfluenzaA__ALE32062
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucuauucuaccggaaaccugauugcuccuagaggcuacuuuaaaauccgguccgggaagucuucuauuaugcgcagcgacgcccccaucggaaaauguaaguccgaaugcauuaccccgaauggcucuaucccuaacgauaagcccuuccagaaugugaacagaaucacauauggcgcuuguccucgguacgugaaacacagcacgcucaagcuggccaccgggaugcgcaauguccccgagaaacagacaagaggaauuuuuggcgcgaucgccggguucauugaaaacggaugggagggcaugguugacgggugguauggauuucggcaccaaaauuccgagggcagaggccaggcugccgaucuuaagagcacccaggcugccaucgaccaaauuaacgggaaacugaaucgccucaucggaaagacaaacgaaaaauuccaucagauugagaaggaguucucugaaguggaaggccggauccaggaucuggagaaguacguggaggacaccaaaaucgaucuuugguccuauaaugccgaacugcucgucgcucuggagaaccagcacacgauugaccugacagauagcgaaaugaauaagcucuuugagaaaaccaagaaacaacugagagaaaacgcggaggacauggggaacggaugcuucaagaucuaccauaagugugauaaugccugcauuggcucuauccgcaacgggaccuacgaccacaauguguaucgggacgaggcucuuaacaauagauuucagauuaaaggcguugaacugaaguccggauacaaagauuggauccucuggaucagcuucgccauuuccugcuuucugcuuuguguggcccugcucggcuucaucaugugggcuugccagaaggggaacauucgcuguaauaucugcauuuga

SEQ ID NO: 196572 - RNA, 1701 nt, Artificial Sequence; identical to SEQ ID NO: 195465
  derived and/or modified sequence opt5 from hemagglutinin__InfluenzaA__ALE32063

SEQ ID NO: 196573 - RNA, 1701 nt, Artificial Sequence
  derived and/or modified sequence opt5 from hemagglutinin__InfluenzaA__ALE32064
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcucuaauuccuuuuucagccgccuuaacuggcugacccaucucaauuauacauacccugcccugaacgucaccaugcccaacaaugagcaguuugacaaacuuuauauuuggggcgugcaccauccugggacggauaaggaccagaucuuccuguacgcgcagucuuccggaagaauuacaguuagcaccaagcggucccaacaggccgugaucccgaacaucggcucucgcccccggauuagagauaucccuagccgcauuuccaucuacuggacaauugucaagcccggggacauccuccugaucaauagcaccggaaaccugauugcuccuagaggcuauuuuaaaauccggucugggaaguccagcauuaugcgcucugacgcccccaucggaaaauguaagagcgaaugcauuaccccgaauggcuccaucccuaacgauaagcccuuccagaaugugaacagaaucacauacggcgcuuguccucgguaugugaaacacucuacgcucaagcuggccaccgggaugcgcaauguccccgagaaacagacaagaggaauuuuuggcgcgaucgccggguucauugaaaacggaugggagggcaugguugacgggugguacggauuucggcaccaaaauagcgagggcagaggccaggcugccgaucuuaaguccacccaggcugccaucgaccaaauuaacgggaaacugaaucgccucaucggaaagacaaacgaaaaauuccaucagauugagaaggaguucagcgaaguggaaggccggauccaggaucuggagaaguauguggaggacaccaaaaucgaucuuuggucuuacaaugccgaacugcucgucgcucuggagaaccagcacacgauugaccugacagauuccgaaaugaacaagcucuuugagaaaaccaagaaacaacugagagaaaaugcggaggacaucgggaacggaugcuucaagauuuaucauaagugugauaaugccugcaucggcagcauucgcaacgggaccuacgaccacaauguguaccgggacgaggcucuuaacaauagauuucagaucaaaggcguugaacugaagucuggauauaaagauuggauccucuggauuuccuucgccaucagcugcuuucugcuuuguguggcccugcucggcuucauuaugugggcuugccagaaggggaacauccgcuguaauauuugcaucuga

SEQ ID NO: 196574 - RNA, 1701 nt, Artificial Sequence; identical to SEQ ID NO: 195465
  derived and/or modified sequence opt5 from hemagglutinin__InfluenzaA__ALE32065

SEQ ID NO: 196575 - RNA, 1701 nt, Artificial Sequence
  derived and/or modified sequence opt5 from hemagglutinin__InfluenzaA__ALE32066
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauacauacccugcccugaaugucuccaugcccaacaacgagcaguuugacaagcuguauauuuggggcgugcaccauccugggaccgauaaggaccagaucuuccuguacgcgcagagcuccggaagaauuacgguuucuacaaaacggagccaacaggccgugaucccgaauaucggcucccgcccccggauuagagauaucccuagccgcauuucuaucuacuggaccauugucaagcccggggacauccuccugaucaacuccacaggaaaucugauugcuccuagaggcuauuuuaaaauccggagcgggaagucuagcauuaugcgcuccgacgcccccaucggaaaauguaagucugaaugcauuaccccgaacggcagcaucccuaaugauaagcccuuccagaacgugaauagaaucaccuacggcgcuuguccucgguaugugaaacacuccacacucaagcuggccacggggaugcgcaacguccccgagaaacagaccagaggaauuuuuggcgcgaucgccggguucauugaaaauggaugggagggcaugguugacgggugguacggauuucggcaccaaaacagcgagggcagaggccaggcugccgaucuuaagucuacacaggcugccaucgaccaaauuaaugggaaacugaaccgccucaucggaaagaccaaugaaaaauuccaucagauugagaaggaguucuccgaaguggaaggccggauccaggaucuggagaaguauguggaggacacaaaaaucgaucuuuggagcuacaacgccgaacugcucgucgcucuggagaaucagcacaccauugaccugacggauucugaaaugaacaagcucuuugagaaaacaaagaaacaacugagagaaaacgcggaggacauggggaauggaugcuucaagaucuaucauaagugugauaacgccugcauuggcuccauccgcaaugggaccuacgaccacaacguguaccgggacgaggcucuuaauaacagauuucagauuaaaggcguugaacuuaagagcggauauaaagauuggauccucuggaucuccuucgccauuucuugcuuucugcuuuguguggcccugcucggcuucaucaugugggcuugccagaaggggaauauucgcuguaacaucugcauuuga

SEQ ID NO: 196576 - RNA, 1701 nt, Artificial Sequence; identical to SEQ ID NO: 196247
  derived and/or modified sequence opt5 from hemagglutinin__InfluenzaA__ALE32067

SEQ ID NO: 196577 - RNA, 1701 nt, Artificial Sequence; identical to SEQ ID NO: 195465
  derived and/or modified sequence opt5 from hemagglutinin__InfluenzaA__ALE32068

SEQ ID NO: 196578 - RNA, 1701 nt, Artificial Sequence; identical to SEQ ID NO: 195465
  derived and/or modified sequence opt5 from hemagglutinin__InfluenzaA__ALE32069

SEQ ID NO: 196579 - RNA, 1701 nt, Artificial Sequence
  derived and/or modified sequence opt5 from hemagglutinin__InfluenzaA__ALE32070
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgcccccaucggaaaauguaaguccgaaugcauuaccccgaacggcucuaucccuaaugauaagcccuuccagaacgugaauagaaucacauacggcguguguccucgguaugucaaacacagcacgcucaagcuggcuaccgggaugcgcaacguucccgagaaacagacaagaggaauuuuuggcgccaucgcgggguucauugaaaauggaugggagggcaugguggacgggugguacggauuucggcaccaaaacuccgagggcagaggccaggccgcugaucuuaagagcacccaggccgcuaucgaccaaauuaaugggaaacugaaccgccucaucggaaagacaaaugaaaaauuccaucagauugagaaggaguucucugaaguggaaggccggauccaggaucuggagaaguaugucgaggacaccaaaaucgaucuuugguccuacaacgccgaacugcucguggcccuggagaaucagcacacgauugaccugacagauagcgaaaugaacaagcucuuugagaaaaccaagaaacaacugagagaaaacgcugaggacauggggaauggaugcuucaagaucuaucauaagugugauaacgcgugcauuggcucuauccgcaaugggaccuacgaccacaacguuuaccgggacgaggcccuuaauaacagauuucagauuaaaggcguggaacugaaguccggauauaaagauuggauccucuggaucagcuucgcuauuuccugcuuucugcuuugugucgcccugcucggcuucaucaugugggccugccagaaggggaauauucgcuguaacaucugcauuuga

SEQ ID NO: 196580 - RNA, 1701 nt, Artificial Sequence; identical to SEQ ID NO: 195465
  derived and/or modified sequence opt5 from hemagglutinin__InfluenzaA__ALE32071

SEQ ID NO: 196581 - RNA, 1701 nt, Artificial Sequence; identical to SEQ ID NO: 196462
  derived and/or modified sequence opt5 from hemagglutinin__InfluenzaA__ALE32072

SEQ ID NO: 196582 - RNA, 1701 nt, Artificial Sequence
  derived and/or modified sequence opt5 from hemagglutinin__InfluenzaA__ALE32073
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaaagucuagcuccagcuuuuucucucggcuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggacgcauuacaguuuccaccaagagaucucaacaggccgugaucccgaauaucggcagccggccccgcauuagagauaucccuucccggauuagcaucuacuggacaauugucaaacccggggacauccuccugaucaacucuaccggaaaucugauugcuccucgcggcuauuuuaagauccucuccgggaaaagcucuauuaugagaagcgacgcccccaucggaaaguguaaguccgaaugcauuaccccgaacggcucuaucccuaaugauaaacccuuccagaacgugaaucggaucacauacggcgcuuguccucgcuaugugaagcacagcacgcugaaacuugccaccgggaugagaaacguccccgagaagcagacacggggaauuuuuggcgcgaucgccggguucauugaaaauggaugggagggcaugguugacgggugguacggauuucgccaccaaaacuccgagggcagaggccaggcugccgaucugaaaagcacccaggcugccaucgaccaaauuaaugggaagcucaaccggcugaucggaaaaacaaaugaaaaguuccaucagauugagaaggaguucucugaaguggaaggcagaauccaggaucuugagaaauauguggaggacaccaagaucgaucugugguccuacaacgccgaacuccuggucgcucuggagaaucagcacacgauugaccucacagauagcgaaaugaacaaacuguuugagaagaccaaaaagcaacuucgcgaaaacgcggaggacauggggaauggaugcuucaagaucuaucauaaaugugauaacgccugcauuggcucuauccggaaugggaccuacgaccacaacguguacagagacgaggcucugaauaaccgcuuucagauuaagggcguugaacucaaauccggauauaaggauuggauccuguggaucagcuucgccauuuccugcuuucuucuguguguggcccuccugggcuucaucaugugggcuugccagaaagggaauauucgguguaacaucugcauuuga

SEQ ID NO: 196583 - RNA, 1701 nt, Artificial Sequence
  derived and/or modified sequence opt5 from hemagglutinin__InfluenzaA__ALE32074
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccagcugcaucagacggucuuccagcucuuucuucucccgccuuaauuggcugacccaucucaacuauacauacccugcucugaaugucaccaugcccaacaacgagcaguuugacaaacuuuauauuuggggcgugcaccauccugggacggauaaggaccagaucuuccuguacgcccagagcuccggaagaauuacaguuucuaccaagcggagccaacaggcggugaucccgaauaucggcucccgcccccggauuagagauaucccuagccgcauuucuaucuacuggacaauugucaagcccggggacauccuccugaucaacuccaccggaaaucugauugccccuagaggcuauuuuaaaauccucagcgggaagucuagcauuaugcgguccgacgcucccaucggaaaauguaagucugaaugcauuaccccgaacggcagcaucccuaaugauaagcccuuccagaacgugaaucgcaucacauacggcgccuguccuagauaugugaaacacuccacgcugaaacuugcuaccgggaugcggaacguccccgagaagcagacacgcggaauuuuuggcgccaucgcgggguucauugaaaauggaugggagggcaugguugacgggugguacggauuuagacaccaaaacagcgagggccggggccaggccgcugaucugaagucuacccaggccgcuaucgaccaaauuaaugggaaacucaacagacugaucggaaagacaaaugaaaaauuccaucagauugagaaggaauuuuccgagguggaaggccgcauccaggaucuugagaaguauguggaggacaccaaaaucgaucuguggagcuacaacgccgaacuccuggucgcccuggagaaucagcacacgauugaccucacagauucugaaaugaacaagcuguuugagaaaaccaagaaacaacuucgggaaaacgcugaggacauggggaauggaugcuucaagaucuaucauaagugugauaacgcgugcauuggcuccaucagaaaugggaccuacgaccacaacguguaccgcgacgaggcccugaauaaccgguuucagauuaaaggcguugaacucaagagcggauauaaagauuggauccuguggaucuccuucgcuauuucuugcuuucuucuguguguggcccuccugggcuucaucaugugggccugccagaaggggaauauuagauguaacaucugcauuuga

SEQ ID NO: 196584 - RNA, 1701 nt, Artificial Sequence
  derived and/or modified sequence opt5 from hemagglutinin__InfluenzaA__ALE32075
augaagaccaucauugcccugagcuacauccucugccugguguucgcucagaaacuucccgagaacgacaauuccacagccacgcugugucucggccaccaugcggucccuaacgggaccauuguuaagacaaucaccucugauagaauugaagugacaaaugcuaccgagcuggugcaaaacagcuccaucggagaaaucugcgacucuccgcaccagauucuugauggcaaaaauuguacacugaucgacgcccuccugggggauccccagugcgacggauuucagaacaagaaaugggaucuguucgucgagcggagcaaggccuauuccaauuguuacccuuaugacgugcccgauuacgcuucucuccgcagccugguugccuccagcggcacccuugaauuuaacgacgagucuuucaauugggcuggggugacgcaaaacggaaccuccagcucuugcauuagaggcuccaauagcagcuuuuucucccggcugaacuggcucacacauagcaauuuuaaguauccugcccugaacgucaccaugcccaauaacgagcaguucgauaaacuuuacaucuggggcgugcaccauccugggacagacaaggaucagauuuuucuguaugcgcaguccucuggacgcaucaccguuagcacgaaaagaucccaacaggccgugauuccgaacaucggcagccggccccgcaucagaaauauuccuucucggaucuccauuuacuggacaaucgucaagcccggggacauucuccugaucaacagcaccggaaaucugaucgcuccucgcggcuacuucaaaauuagaucugggaagucuuccaucaugcggucugacgcccccauuggaaaguguaaaagcgaaugcaucacaccgaacggcuccauuccuaaugauaagcccuuucagaacgugaaucgcaucaccuauggcgcuuguccuagauacgugaaacagagcacccucaagcuggccacagggaugcggaacguccccgagaaacaaacgcgcggaaucuucggcgcgauugccggguuuaucgaaaauggaugggagggcaugaaggacgggugguauggauucagacaccagaacucugagggccggggccaggcugccgaucuuaaauccacccaagcugccauugaccagaucaaugggaagcugaacagacucauuggaaagacaaaugaaaaauuccaccagaucgagaaggaauuuagcgagguugaaggccgcauucaggaucuggagaaauacguggaggacaccaagaucgaucuuuggucuuauaacgccgaacugcucguggcucuggagaaucaacauacaaucgaccugaccgauuccgaaaugaacaaacucuucgagaagacgaagaaacagcugcgggaaaacgcggaggacauggggaauggaugcuuuaagauuuaccacaaaugugauaacgccugcaucggcagcauuagaaaugggacauaugaccaugacgucuaccgcgaugaggcucuuaacaaucgguuccagaucaagggcguggaacugaaauccggauacaaggacuggauucucuggaucucuuuugccaucagcugcuuccugcuuuguguugcccugcucggcuuuauuaugugggcuugccagaaggggaacaucagauguaauauuugcaucuga

SEQ ID NO: 196585 - RNA, 1701 nt, Artificial Sequence; identical to SEQ ID NO: 196022
  derived and/or modified sequence opt5 from hemagglutinin__InfluenzaA__ALE32076

SEQ ID NO: 196586 - RNA, 1701 nt, Artificial Sequence
  derived and/or modified sequence opt5 from hemagglutinin__InfluenzaA__ALE32077
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagcccauagcaacuguuauccuuacgacgugcccgauuaugcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaccucaacuacacauauccugcccugaaugucaccaugcccaacaacgagcaguuugacaaacuuuacauuuggggcgugcaucacccugggacggauaaggaccagaucuuccuguaugcgagauccagcggacggauuacaguuuccaccaagggcucucagcaagccgugaucccgaauaucgggagccgcccccggauuagagauaucccuucccgcauuagcaucuacuggacaauugucaagcccggagacauccuccugaucaacucuaccggcaaucugauugcuccuagaggguacuuuaaaauccgguccggaaagagcucuauuaugcgcagcgacgcccccaucggcaaauguaaguccgaaugcauuaccccgaacggcucuaucccuaaugauaagcccuuccagaacgugaauagaaucacauauggggcuuguccucgguacgugaaacacagcacgcucaagcuggccaccggaaugcgcaacguccccgagaaacagacaagaggcauuuuuggggcgaucgccggauucauugaaaauggcugggaggggaugguugacggaugguauggcuuucggcaucagaacuccgagggcagagggcaagcugccgaucuuaagagcacccaggcugccaucgaccagauuaauggaaaacugaaccgccucaucggcaagacaaaugaaaaauuccaccaaauugagaaggaguucucugaaguggaagggcggauccaggaucuggagaaguacguggaggacaccaaaaucgaucuuugguccuauaacgccgaacugcucgucgcucuggagaaucagcauacgauugaccugacagauagcgaaaugaacaagcucuuugagaaaaccaagaaacagcugagagaaaacgcggaggacaugggaaauggcugcuucaagaucuaccacaagugugauaacgccugcauugggucuauccgcaauggcaccuaugaccacaacguguaccgggacgaggcucuuaauaacagauuucaaauuaaaggaguugaacugaaguccggcuacaaagauuggauccucuggaucagcuucgccauuuccugcuuucugcuuuguguggcccugcucggguucaucaugugggcuugccagaagggaaauauucgcuguaacaucugcauuuga

SEQ ID NO: 196587 - RNA, 1701 nt, Artificial Sequence; identical to SEQ ID NO: 196123
  derived and/or modified sequence opt5 from hemagglutinin__InfluenzaA__ALE32078

SEQ ID NO: 196588 - RNA, 1701 nt, Artificial Sequence; identical to SEQ ID NO: 196009
  derived and/or modified sequence opt5 from hemagglutinin__InfluenzaA__ALE32079

SEQ ID NO: 196589 - RNA, 1701 nt, Artificial Sequence
  derived and/or modified sequence opt5 from hemagglutinin__InfluenzaA__ALE32080
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccagcugcaucagacggucuuccagcucuuucuucucccgccuuaauuggcugacccaucucaacuauacauacccugcucugaaugucaccaugcccaacaacgagcaguuugacaagcuguauauuuggggcgugcaccauccugggacggauaaggaccagaucuuccuguacgcccagagcuccggaagaauuacaguuucuaccaaacggagccaacaggcggugaucccgaauaucggcucccgcccccggauuagagauaucccuagccgcauuucuaucuacuggacaauugucaagcccggggacauccuccugaucaacuccaccggaaaucugauugccccuagaggcuauuuuaaaauccggagcgggaagucuagcauuaugcgcuccgacgcucccaucggaaaauguaagucugaaugcauuaccccgaacggcagcaucccuaaugauaagcccuuccagaacgugaauagaaucacauacggcgccuguccucgguaugugaaacacuccacgcucaagcuggcuaccgggaugcgcaacguccccgagaaacagacaagaggaauuuuuggcgccaucgcgggguucauugaaaauggaugggagggcaugguugacgggugguacggauuucggcaccaaaacagcgagggcagaggccaggccgcugaucuuaagucuacccaggccgcuaucgaccaaauuaaugggaaacugaaccgccucaucggaaagacaaaugaaaaauuccaucagauugagaaggaauuuuccgagguggaaggccggauccaggaucuggagaaguauguggaggacaccaaaaucgaucuuuggagcuacaacgccgaacugcucgucgcccuggagaaucagcacacgauugaccugacagauucugaaaugaacaagcucuuugagaaaaccaagaaacaacugagagaaaacgcugaggacauggggaauggaugcuucaagaucuaucauaagugugauaacgcgugcauuggcuccauccgcaaugggaccuacgaccacaacguguaccgggacgaggcccuuaauaacagauuucagauuaaaggcguugaacuuaagagcggauauaaagauuggauccucuggaucuccuucgcuauuucuugcuuucugcuuuguguggcccugcucggcuucaucaugugggccugccagaaggggaauauucgcuguaacaucugcauuuga

SEQ ID NO: 196590 - RNA, 1701 nt, Artificial Sequence; identical to SEQ ID NO: 196123
  derived and/or modified sequence opt5 from hemagglutinin__InfluenzaA__ALE32081

SEQ ID NO: 196591 - RNA, 1701 nt, Artificial Sequence; identical to SEQ ID NO: 196123
  derived and/or modified sequence opt5 from hemagglutinin__InfluenzaA__ALE32082

SEQ ID NO: 196592 - RNA, 1701 nt, Artificial Sequence
  derived and/or modified sequence opt5 from hemagglutinin__InfluenzaA__ALE32083
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauaaguacccugcccugaaugucacaaugcccaacaacgagcaguuugacaaacuuuauauuuggggcgugcaccauccugggaccgauaaggaccagaucuuccuguacgcgagauccagcggacggauuacgguuuccacaaagggcucucagcaagccgugaucccgaauaucgggagccgcccccggauuagagauaucccuucccgcauuagcaucuacuggaccauugucaaacccggagacauccuccugaucaacucuacaggcaaucugauugcuccuagaggguauuuuaagauccgguccggaaaaagcucuauuaugcgcagcgacgcccccaucggcaaguguaaguccgaaugcauuaccccgaacggcucuaucccuaaugauaaacccuuccagaacgugaauagaaucaccuacggggcuuguccucgguaugugaagcacagcacacucaaacuggccacgggaaugcgcaacguccccgagaagcagaccagaggcauuuuuggggcgaucgccggauucauugaaaauggcugggaggggaugguugacggaugguacggcuuucggcaccagaacuccgagggcagagggcaagcugccgaucuuaaaagcacacaggcugccaucgaccagauuaauggaaagcugaaccgccucaucggcaaaaccaaugaaaaguuccaucaaauugagaaggaguucucugaaguggaagggcggauccaggaucuggagaaauauguggaggacacaaagaucgaucuuugguccuacaacgccgaacugcucgucgcucuggagaaucagcacaccauugaccugacggauagcgaaaugaacaaacucuuugagagaacaaagaaacagcugcgcgaaaacgcggaggacaugggaaauggcugcuucaagaucuaucauaagugugauaacgccugcauugggucuauccggaauggcaccuacgaccacaacguguacagagacgaggcucuuaauaaccgcuuucaaauuaaaggaguugaacugaaguccggcuauaaagauuggauccucuggaucagcuucgccauuuccugcuuucugcuuuguguggcccugcucggguucaucaugugggcuugccagaagggaaauauucgguguaacaucugcauuuga

SEQ ID NO: 196593 - RNA, 1701 nt, Artificial Sequence; identical to SEQ ID NO: 196080
  derived and/or modified sequence opt5 from hemagglutinin__InfluenzaA__ALE32084

SEQ ID NO: 196594 - RNA, 1701 nt, Artificial Sequence; identical to SEQ ID NO: 196123
  derived and/or modified sequence opt5 from hemagglutinin__InfluenzaA__ALE32085

SEQ ID NO: 196595 - RNA, 1701 nt, Artificial Sequence
  derived and/or modified sequence opt5 from hemagglutinin__InfluenzaA__ALE32086
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaaagucuagcuccagcuuuuucucucggcuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcgcuccagcggaagaauuacaguuuccaccaagcggucucagcaagccgugaucccgaauaucggcagccgcccccggauuagagauaucccuucccgcauuagcaucuacuggacaauugucaaacccggggacauccuccugaucaacucuaccggaaaucugauugcuccuagaggcuauuuuaagauccgguccgggaaaagcucuauuaugcgcagcgacgcccccaucuccaaguguaagucugaaugcauuaccccgaacggaagcaucccuaaugauaaacccuuccagaacgugaauagaaucacauacggcgcuuguccucgguaugugaagcacuccacgcucaaacuggccaccggcaugcgcaacguccccgagaagcagacaagagggauuuuuggagcgaucgccggcuucauugaaaaugggugggagggaaugguugacggcugguacggguuucggcaccagaacagcgagggaagaggccaagcugccgaucuuaaaucuacccaggcugccaucgaccagauuaauggcaagcugaaccgccucaucgggaaaacaaaugaaaaguuccaucaaauugagaaggaguucuccgaaguggaaggacggauccaggaucuggagaaauauguggaggacaccaagaucgaucuuuggagcuacaacgccgaacugcucgucgcucuggagaaucagcacacgauugaccugacagauucugaaaugaacaaacucuuugagaagaccaaaaagcagcugagagaaaacgcggaggacaugggcaaugggugcuucaagaucuaucauaaaugugauaacgccugcauuggauccauccgcaauggcaccuacgaccacaacguguaccgggacgaggcucuuaauaacagauuucaaauuaaggggguugaacugaaaagcggcuauaaggauuggauccucuggaucuccuucgccauuucuugcuuucugcuuuguguggcccugcucggauucaucaugugggcuugccagaaaggcaauauucgcuguaacaucugcauuuga

SEQ ID NO: 196596 - RNA, 1701 nt, Artificial Sequence
  derived and/or modified sequence opt5 from hemagglutinin__InfluenzaA__ALE32087
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaaaguccucuuccagcuuuuucucucggcuuaauuggcugacccaucucgacuauacauacccugcccugaacgucaccaugcccaauaacgagcaguuugauaaacuuuauauuuggggcgugcaccauccugggacggacaaggaucagaucuuccuguacgcgcgcuccagcggaagaauuacaguuuccaccaagcggucucagcaagccgugaucccgaacaucggcagccgcccccggauuagagacaucccuucccgcauuagcaucuacuggacaauugucaaacccggggacauccuccugaucaauucuaccggaaaccugauugcuccuagaggcuauuuuaagauccgguccgggaaaagcucuauuaugcgcagcgaugcccccaucggaaaguguaaguccgaaugcauuaccccgaauggcucuaucccuaacgacaaacccuuccagaaugugaacagaaucacauacggcgcuuguccucgguaugugaagcacagcacgcucaaacuggccaccgggaugcgcaauguccccgagaagcagacaagaggaauuuuuggcgcgaucgccggguucauugaaaacggaugggagggcaugguugaugggugguacggauuucggcaccagaauagcgagggcagaggccaagcugccgaccuuaaaagcacccaggcugccaucgaucagauuaacgggaaucugaaccgccucaucggaaagacaaaugaaaaauuccaucaaauugagaaggaguucucugaaguggaaggccggauccaggaccuggagaaguauguggaggauaccaaaaucgaccuuugguccuacaacgccgaacugcucgucgcucuggagaaucagcacacgauugaucugacagacagcgaaaugaacaagcucuuugagaaaaccaagaaacagcugagagaaaacgcggaggauauggggaauggaugcuucaagaucuaucauaagugugacaacgccugcauuggcucuauccgcaaugggaccuacgaccacaacguguaccgggaugaggcucuuaauaacagauuucaaauuaaaggcguugaacugaaguccggauauaaagacuggauccucuggaucagcuucgccauuuccugcuuucugcuuuguguggcccugcucggcuucaucaugugggcuugccagaaggggaauauucgcuguaacaucugcauuuga

SEQ ID NO: 196597 - RNA, 1701 nt, Artificial Sequence
  derived and/or modified sequence opt5 from hemagglutinin__InfluenzaA__ALE32088
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaaagucuagcuccagcuuuuucucucggcuuaauuggcugacccaucucaacuauacauacccugcccugaaugucaccaugcccaacaacgagcaguuugacaaacuuuauauuuggggcgugcugcacccugggacggauaaggaccagaucuuccucuacgcgcgcuccagcggaagaauuacaguuuccaccaagcggucucagcaagccgugaucccgaauaucggcagccgcccccggauuagagauaucccuucccgcauuagcaucuacuggacaauugucaaacccggggacauccugcugaucaacucuaccggaaaucucauugcuccuagaggcuauuuuaagauccgguccgggaaaagcucuauuaugcgcagcgacgcccccaucggaaaguguaaguccgaaugcauuaccccgaacggcucuaucccuaaugauaaacccuuccagaacgugaauagaaucacauacggcgcuuguccucgguaugugaagcauagcacgcugaaacuugccaccgggaugcgcaacguccccgagaagcagacaagaggaauuuuuggcgcgaucgccggguucauugaaaauggaugggagggcaugguugacgggugguacggauuucggcaccagaacuccgagggcagaggccaagcugccgaucugaaaagcacccaggcugccaucgaccagauuaaugggaagcucaaccgccugaucggaaaaacaaaugaaaaguuccaccaaauugagaaggaguucucugaaguggaaggccggauccaggaucuugagaaauauguggaggacaccaagaucgaucugugguccuacaacgccgaacuccuggucgcucuggagaaucagcauacgguggaccucacagauagcgaaaugaacaaacuguuugagaagaccaaaaagcagcuuagagaaaacgcggaggacauggggaauggaugcuucaagauuuaucacaaaugugauaacgccugcaucggcucuauucgcaaugggaccuacgaccauaacguuuaccgggacgaggcucugaauaacagauuucaaaucaagggcguggaacucaaauccggauauaaggauuggauucuguggaucagcuucgccaucuccugcuuucuucugugugucgcccuccugggcuucauuaugugggcuugccagaaagggaauauccgcuguaacauuugcaucuga

SEQ ID NO: 196598 - RNA, 1701 nt, Artificial Sequence; identical to SEQ ID NO: 195465
  derived and/or modified sequence opt5 from hemagglutinin__InfluenzaA__ALE32089

SEQ ID NO: 196599 - RNA, 1701 nt, Artificial Sequence; identical to SEQ ID NO: 195465
  derived and/or modified sequence opt5 from hemagglutinin__InfluenzaA__ALE32090

SEQ ID NO: 196600 - RNA, 1701 nt, Artificial Sequence; identical to SEQ ID NO: 195465
  derived and/or modified sequence opt5 from hemagglutinin__InfluenzaA__ALE32091

SEQ ID NO: 196601 - RNA, 1701 nt, Artificial Sequence
  derived and/or modified sequence opt5 from hemagglutinin__InfluenzaA__ALE32092
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgcccccaucggaaaauguagauccgaaugcauuaccccgaacggcucuaucccuaaugauaagcccuuccagaacgugaaucggaucacauacggcgcuuguccucgcuaugugaagcacagcacgcucaaacuggccaccgggaugagaaacguccccgagaagcagacacggggaauuuuuggcgcgaucgccggguucauugaaaauggaugggagggcaugguugacgggugguacggauuuagacaccaaaacuccgagggccgcggccaggcugccgaucuuaaaagcacccaggcugccaucgaccaaauuaaugggaagcugaaccggcucaucggaaaaacaaaugaaaaguuccaucagauugagaaagaguucucugaaguggaaggcagaauccaggaucuggagaaguauguggaggacaccaagaucgaucuuugguccuacaacgccgaacugcucgucgcucuggagaaucagcacacgauugaccugacagauagcgaaaugaacaaacucuuugagaagaccaaaaagcaacugcgcgaaaacgcggaggacauggggaauggaugcuucaaaaucuaucauaagugugauaacgccugcauuggcucuauccggaaugggaccuacgagcacaacguguacagagacgaagcucuuaauaaccgcuuucagauuaagggcguugagcugaaauccggauauaaggacuggauccucuggaucagcuucgccauuuccugcuuucugcuuuguguggcccugcucggcuucaucaugugggcuugccagaaagggaauauucgguguaacaucugcauuuga

SEQ ID NO: 196602 - RNA, 1701 nt, Artificial Sequence; identical to SEQ ID NO: 196071
  derived and/or modified sequence opt5 from hemagglutinin__InfluenzaA__ALE32093

SEQ ID NO: 196603 - RNA, 1701 nt, Artificial Sequence
  derived and/or modified sequence opt5 from hemagglutinin__InfluenzaA__ALE32094
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaccucuaccggaaaccugauugcuccuagaggcuauuuuaaaauccgguccgggaagucuucuauuaugcgcagcgacgcccccaucggaaaauguaaguccgaaugcauuacaccgaauggcucuaucccuaacgauaagcccuuccagaaugugaacagaaucacguacggcgcuuguccucgguaugugaaacacagcacccucaagcuggccacagggaugcgcaauguccccgagaaacagaccagaggaauuuuuggcgcgaucgccggguucauugaaaacggaugggagggcaugguugacgggugguacggauuucggcaccaaaauuccgagggcagaggccaggcugccgaucuuaagagcacacaggcugccaucgaccaaauuaacgggaaacugaaucgccucaucggaaagaccaacgaaaaauuccaucagauugagaaggaguucucugaaguggaaggccggauccaggaucuggagaaguauguggaggacacgaaaaucgaucuuugguccuacaaugccgaacugcucgucgcucuggagaaccagcacacaauugaccugaccgauagcgaaaugaauaagcucuuugagaaaaccaagaaacaacugagagaaaacgcggaggacauggggaacggaugcuucaagaucuaucauaagugugauaaugccugcauuggcucuauccgcaacgggacauacgaccacaauguguaccgggacgaggcucuuaacaauagauuucagauuaaaggcguugaacugaaguccggauauaaagauuggauccucuggaucagcuucgccauuuccugcuuucugcuuuguguggcccugcucggcuucaucaugugggcuugccagaaggggaacauucgcuguaauaucugcauuuga

SEQ ID NO: 196604 - RNA, 1701 nt, Artificial Sequence; identical to SEQ ID NO: 195465
  derived and/or modified sequence opt5 from hemagglutinin__InfluenzaA__ALE32095

SEQ ID NO: 196605 - RNA, 1701 nt, Artificial Sequence
  derived and/or modified sequence opt5 from hemagglutinin__InfluenzaA__ALE32096
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucuccuauacauacccugcccugaacgucaccaugcccaauaacgagcaguuugacaagcuguauauuuggggcgugcaccauccugggacggauaaggaccagaucuuccuguacgcgcagagcuccggaagaauuacaguuucuaccaaacggagccaacaggccgugaucccgaacaucggcucccgcccccggauuagagauaucccuagccgcauuucuaucuacuggacaauugucaagcccggggacauccuccugaucaauuccaccggaaaccugauugcuccuagaggcuauuuuaaaauccggagcgggaagucuagcauuaugcgcuccgacgcccccaucggaaaauguaagucugaaugcauuaccccgaauggcagcaucccuaacgauaagcccuuccagaaugugaacagaaucacauacggcgcuuguccucgguaugugaaacacuccacgcucaagcuggccaccgggaugcgcaauguccccgagaaacagacaagaggaauuuuuggcgcgaucgccggguucauugaaaacggaugggagggcaugguugacgggugguacggauuucggcaccaaaauagcgagggcagaggccaggcugccgaucuuaagucuacccaggcugccaucgaccaaauuaacgggaaacugaaucgccucaucggaaagacaaacgaaaaauuccaucagauugagaaggaguucuccgaaguggaaggccggauccaggaucuggagaaguauguggaggacaccaaaaucgaucuuuggagcuacaaugccgaacugcucgucgcucuggagaaccagcacacgauugaccugacagauucugaaaugaauaagcucuuugagaaaaccaagaaacaacugagagaaaacgcggaggacauggggaacggaugcuucaagaucuaucauaagugugauaaugccugcauuggcuccauccgcaacgggaccuacgaccacaauguguaccgggacgaggcucuuaacaauagauuucagauuaaaggcguugaacuuaagagcggauauaaagauuggauccucuggaucuccuucgccauuucuugcuuucugcuuuguguggcccugcucggcuucaucaugugggcuugccagaaggggaacauucgcuguaauaucugcauuuga

SEQ ID NO: 196606 - RNA, 1701 nt, Artificial Sequence; identical to SEQ ID NO: 195465
  derived and/or modified sequence opt5 from hemagglutinin__InfluenzaA__ALE32097

SEQ ID NO: 196607 - RNA, 1701 nt, Artificial Sequence; identical to SEQ ID NO: 196071
  derived and/or modified sequence opt5 from hemagglutinin__InfluenzaA__ALE32099

SEQ ID NO: 196608 - RNA, 1701 nt, Artificial Sequence
  derived and/or modified sequence opt5 from hemagglutinin__InfluenzaA__ALE32100
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaaacggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgcccccaucggaaaauguaaguccgaaugcauuaccccgaacggcucuaucccuaaugauaagcccuuccagaacgugaauagaaucacauacggcgcuuguccucgguaugugaaacacagcacgcucaagcuggccaccgggaugcgcaacguccccgagaaacagacaagaggaauuuuuggcgcgaucgccggguucauugaaaauggaugggagggcaugguugacgggugguacggauuucggcaccaaaacuccgagggcagaggccaggcugccgaucuuaagagcacccaggcugccaucgaccaaauuaaugggaaacugaaccgccucaucggaaagacaaaugaaaaauuccaucagauugagaaggaguucucugaaguggaaggccggauccaggaucuggagaaguauguggaggacaccaaaaucgaucuuugguccuacaacgccgaccugcucgucgcucuggaaaaucagcacacgauugaucugacagacagcgagaugaacaagcucuuugaaaagaccaagaaacaacugagagagaacgcggaagauauggggaauggaugcuucaagaucuaucauaagugugacaacgccugcauuggcucuauccgcaaugggaccuacgaccacaacguguaccgggaugaggcucuuaauaacagauuucagauuaaaggcguugagcugaaguccggauauaaagacuggauccucuggaucagcuucgccauuuccugcuuucugcuuuguguggcccugcucggcuucaucaugugggcuugccagaaggggaauauucgcuguaacaucugcauuuga

SEQ ID NO: 196609 - RNA, 1701 nt, Artificial Sequence
  derived and/or modified sequence opt5 from hemagglutinin__InfluenzaA__ALE32101
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagccaauguuacccuuaugacgugcccgauuacgcuucccugcgcucucucguugccagcuccgggacccuggaauuuaacaaugagagcuucaacuggacgggagugacccagaauggcacaucuuccgcuugcaucagaaagagcucuggcuccuuuuucagccggcuuaacuggcugacccaucucaaguauacauacccugcccugaaugucaccaugcccaacaaugagcaguuugacaaacuuuauauuuggggagugcaccauccugggacggauaaggaccagaucuuccuguacgcgagaucuuccggcagaauuacaguuagcaccaaacggucccaacaggccgugaucccgaacaucgggucucgcccccgcauucgggauaucccuagccgcauuuccaucuacuggacaauugucaagcccggagacauccuccugaucaacagcaccggcaaucugauugcuccuagaggguauuuuaaaauccggucuggaaaguccagcauuaugcgcucugacgcccccaucggcaaguguaaaagcgaaugcauuaccccgaacggcuccaucccuaaugauaagcccuuccagaacgugaauagaaucacauacggggcuuguccucgguaugugaaacacucuacgcucaagcuggccaccggaaugcgcaacguccccgagaaacagacaagaggcauuuuuggggcgaucgccggauucauugaaaauggcugggaggggaugguugacggaugguacggcuuucggcaccaaaacagcgagggcagagggcaggcugccgaucuuaaguccacccaggcugccaucgaccaaauuaauggaaaacugaaccgccucaucggcaagacaaaugaaaaguuccaucagauugagaaagaguucagcgaaguggaagggcggauccaggaucuggagaaguauguggaggacaccaaaaucgaucuuuggucuuacaacgccgaacugcucgucgcucuggagaaucagcacacgauugaccugacagauuccgaaaugaacaagcucuuugagaaaaccaagaagcaacugagagaaaaugcggaggacaugggaaacggcugcuucaaaaucuaucauaagugugauaacgccugcauugggagcauccgcaauggcaccuacgaccacaacguguaccgggacgaggcucuuaauaacagauuucagauuaaaggaguugaacugaagucuggcuauaaagauuggauccucuggaucuccuucgccauuagcugcuuucugcuuuguguggcccugcucggguucaucaugugggcuugccagaagggaaauauucgcuguaacaucugcauuuga

SEQ ID NO: 196610 - RNA, 1701 nt, Artificial Sequence
  derived and/or modified sequence opt5 from hemagglutinin__InfluenzaA__ALE32102
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaaagagcagcuccagcuuuuucucucggcuuaauuggcugacccaucucaaguauacauacccugcccugaacgucaccaugcccaauaacgagcaguuugacaaacuuuauauuuggggcgugcaccauccugggacggauaaggaccagaucuuccuguacgcgcgcuccagcggaagaauuacaguuuccaccaaacggucucagcaagccgugaucccgaacaucggcagccgcccccggauuagagauaucccuucccgcauuagcaucuacuggacaauugucaagcccggggacauccuccugaucaauucuaccggaaaccugauugcuccuagaggcuauuuuaaaauccgguccgggaagucuucuauuaugcgcagcgacgcccccaucggaaaguguaaauccgaaugcauuaccccgaauggcucuaucccuaacgauaagcccuuccagaaugugaacagaaucacauacggcgcuuguccucgguaugugaaacacagcacgcucaagcuggccaccgggaugcgcaauguccccgagaaacagacaagaggaauuuuuggcgcgaucgccggguucauugaaaacggaugggagggcaugguugacgggugguacggauuucggcaccagaauagcgagggcagaggccaagcugccgaucuuaagagcacccaggcugccaucgaccagauuaacgggaaacugaaucgccucaucggaaagacaaacgaaaaguuccaucaaauugagaaagaguucucugaaguggaaggccggauccaggaucuggagaaguauguggaggacaccaaaaucgaucuuugguccuacaaugccgaacugcucgucgcucuggagaaccagcacacgauugaccugacagauagcgaaaugaauaagcucuuugagaaaaccaagaagcagcugagagaaaacgcggaggacauggggaacggaugcuucaaaaucuaucauaagugugauaaugccugcauuggcucuauccgcaacgggaccuacgaccacaauguguaccgggacgaggcucuuuccaacagauuucaaauuaaaggcguugaacugaaguccggauauaaagauuggauccucuggaucuccuucgccauuucuugcuuucugcuuuguguggcccugcucggcuucaucaugugggcuugccagaaggggaauauucgcuguaacaucugcauuuga

SEQ ID NO: 196611 - RNA, 1701 nt, Artificial Sequence; identical to SEQ ID NO: 196178
  derived and/or modified sequence opt5 from hemagglutinin__InfluenzaA__ALE32103

SEQ ID NO: 196612 - RNA, 1701 nt, Artificial Sequence
  derived and/or modified sequence opt5 from hemagglutinin__InfluenzaA__ALE32104
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugaucaaaucgaggugacaaacgcuaccgaacucgugcagaauagcagcaucggcgagauuugcgacuccccgcaccagauccuggauggggaaaacuguacacuuauugacgcccugcucggagauccccagugcgacggcuuucaaaauaaaaagugggaucuguucgucgagagaucuaaagccuauagcaacuguuacccuuaugacgugcccgauuacgcuucccugcggucucucguugccagcuccgggacccuggaauuuaauaacgagagcuucaauuggacgggagugacccagaacggcacaucuuccgcuugcauccgcagaucuucuuccagcuuuuucucucggcuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaauccagcggacgcauuacaguuuccaccaagagaucucagcaggccgugaucccgaauaucggcagccggccccgcauuagagauaucccuucccggauuagcaucuacuggacaauugucaagcccggggacauccuccugaucaacucuaccggaaaucugauugcuccucgcggcuauuuuaaaaucagauccggaaagagcucuauuaugcggagcgacgcccccaucgggaaauguaaguccgaaugcauuaccccgaacggcucuaucccuaaugauaagcccuuccagaacgugaaucgcaucacauacggcgcuuguccuagauaugugaaacacagcacgcucaagcuggccaccgggaugcggaacguccccgagaaacaaacacgcggaauuuuuggcgcgaucgccggguucauugaaaauggaugggagggcaugguugacgggugguacggauuuagacaccagaacuccgagggccggggccaggcugccgaucuuaagagcacccaagcugccaucgaccagauuaaugggaaacugaacagacucaucggaaagacaaaugaaaaauuccaucagauugagaaggaguucucugaaguggaaggccgcauccaggaucuggagaaguauguggaggacaccaaaaucgaucuuugguccuacaacgccgaacugcucgucgcucuggagaaucaacacacgauugaccugacagauagcgaaaugaacaagcucuuugagaaaaccaagaaacagcugcgggaaaacgcggaggacauggggaauggaugcuucaagaucuaucauaagugugauaacgccugcauuggcucuaucagaaaugggaccuacgaccacaacguguaccgcgacgaggcucuuaauaaccgguuucagauuaaaggcguugaacugaaguccggauauaaagauuggauccucuggaucagcuucgccauuuccugcuuucugcuuuguguggcccugcucggcuucaucaugugggcuugccagaaggggaauauuagauguaacaucugcauuuga

SEQ ID NO: 196613 - RNA, 1701 nt, Artificial Sequence; identical to SEQ ID NO: 196123
  derived and/or modified sequence opt5 from hemagglutinin__InfluenzaA__ALE32105

SEQ ID NO: 196614 - RNA, 1701 nt, Artificial Sequence; identical to SEQ ID NO: 196123
  derived and/or modified sequence opt5 from hemagglutinin__InfluenzaA__ALE32106

SEQ ID NO: 196615 - RNA, 1701 nt, Artificial Sequence; identical to SEQ ID NO: 196178
  derived and/or modified sequence opt5 from hemagglutinin__InfluenzaA__ALE32107

SEQ ID NO: 196616 - RNA, 1701 nt, Artificial Sequence; identical to SEQ ID NO: 196408
  derived and/or modified sequence opt5 from hemagglutinin__InfluenzaA__ALE32108

SEQ ID NO: 196617 - RNA, 1701 nt, Artificial Sequence; identical to SEQ ID NO: 196022
  derived and/or modified sequence opt5 from hemagglutinin__InfluenzaA__ALE32109

SEQ ID NO: 196618 - RNA, 1701 nt, Artificial Sequence; identical to SEQ ID NO: 196009
  derived and/or modified sequence opt5 from hemagglutinin__InfluenzaA__ALE32110

SEQ ID NO: 196619 - RNA, 1701 nt, Artificial Sequence; identical to SEQ ID NO: 195465
  derived and/or modified sequence opt5 from hemagglutinin__InfluenzaA__ALE32111

SEQ ID NO: 196620 - RNA, 1701 nt, Artificial Sequence
  derived and/or modified sequence opt5 from hemagglutinin__InfluenzaA__ALE32112
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuaugccuacccugcgcugaaugucacaaugcccaacaacgagcaguuugacaaacuuuauauuuggggcgugcaccauccugggaccgauaaggaccagaucuuccuguacgcccaguccagcggaagaauuacgguuuccacaaagcggucucaacaggcugugaucccgaauaucggcagccgcccccggauuagagauaucccuucccgcauuagcaucuacuggaccauugucaagcccggggacauccuccugaucaacucuacaggaaaucugauugccccuagaggcuauuuuaaaauccgguccgggaagucuucuauuaugcgcagcgacgcucccaucggaaaauguaaguccgaaugcauuaccccgaacggcucuaucccuaaugauaagcccuuccagaacgugaauagaaucaccuacggcgccuguccucgguaugugaaacacagcacacucaagcuggcgacggggaugcgcaacguccccgagaaacagaccagaggaauuuuuggcgccaucgcuggguucauugaaaauggaugggagggcaugguugacgggugguacggauuucggcaccaaaacuccgagggcagaggccaggccgcugaucuuaagagcacacaggccgccaucgaccaaauuaaugggaaacugaaccgccucaucggaaagaccaaugaaaaauuccaucagauugagaaggaguucucugaaguggaaggccggauccaggaucuggagaaguauguggaggacacaaaaaucgaucuuugguccuacaacgcugaacugcucgucgcgcuggagaaucagcacaccauugaccugacggauagcgaaaugaacaagcucuuugagaaaacaaagaaacaacugagagaaaacgccgaggacauggggaauggaugcuucaagaucuaucauaagugugauaacgcuugcauuggcucuauccgcaaugggaccuacgaccacaacguguaccgggacgaggcccuuaauaacagauuucagauuaaaggcguugaacugaaguccggauauaaagauuggauccucuggaucagcuucgccauuuccugcuuucugcuuuguguggcucugcucggcuucaucaugugggccugccagaaggggaauauucgcuguaacaucugcauuuga

SEQ ID NO: 196621 - RNA, 1701 nt, Artificial Sequence
  derived and/or modified sequence opt5 from hemagglutinin__InfluenzaA__ALE32113
augaagaccaucauugcccugagcuacauccucugccugguguucgcucagaaaauucccggcaacgacaauuccacagccacgcuuugucuggggcaccaugcggucccuaacggaaccguugugaagacaaucaccaaugauagaauugaggugacaaacgcuaccgaacucguccaaaauucuagcaucggcgagaucugcgacuccccgcaccagauucuggauggggaaaacuguacacuuaucgacgcccugcucggagauccccagugcgacggcuuucagaauaaaaagugggaucuguucguggagcggucuaaagccuauagcaacuguuacccuuaugacguucccgauuacgcuucccugcgcucucucguggccagcuccgggacccuggaauuuaauaacgagagcuucaauuggacgggagucacccaaaacggcacaucuuccgcuugcauuagaggcucuagcuccagcuuuuucucucggcuuaauuggcugacccaucucaacuauacauacccugcccugaaugugaccaugcccaacaacgagcaguuugacaaacuuuauaucuggggaguucaccauccugggacggauaaggaccagauuuuccuguacgcgcaguccagcggccgcaucacaguguccaccaagagaucucaacaggccgucauuccgaauaucgggagccggccccgcaucagagauauuccuucccggaucagcauuuacuggacaaucgugaagcccggagacauucuccugaucaacucuaccggcaaucugaucgcuccucgcggguauuuuaaaaugagauccggaaagagcucuauuaugcggagcgacgcccccaucggcaaauguaaguccgaaugcauuaccccgaacggcucuaucccuaaugauaagcccuuccagaacgugaaucgcauuacauacggggcuuguccuagauaugucaaacacagcacgcucaagcuggccaccggaaugcggaacguucccgagaaacagacacgcggcaucuuuggggcgaucgccggauucauugaaaauggcugggaggggaugguggacggaugguacggcuuuagacaccaaaacuccgagggccgggggcaggcugccgaucuuaagagcacccaggcugccaucgaccaaauuaauggaaaacugaacagacucaucggcaagacaaaugaaaaauuccaucagauugagaaggaguucucugaaguggaagggcgcauccaggaucuggagaaguaugucgaggacaccaaaauugaucuuugguccuacaacgccgaacugcucguggcucuggagaaucagcacacgaucgaccugacagauagcgaaaugaacaagcucuuugagaaaaccaagaaacaacugcgggaaaacgcggaggacaugggaaauggcugcuucaagaucuaucauaagugugauaacgccugcauugggucuaucagaaauggcaccuacgaccacaacguuuaccgcgacgaggcucuuaauaaccgguuucagauuaaaggaguggaacugaaguccggcuauaaagauuggauccucuggauuagcuucgccaucuccugcuuucugcuuugugucgcccugcucggguucaucaugugggcuugccagaagggaaauauuagauguaacaucugcauuuga

SEQ ID NO: 196622 - RNA, 1701 nt, Artificial Sequence; identical to SEQ ID NO: 196009
  derived and/or modified sequence opt5 from hemagglutinin__InfluenzaA__ALE32114

SEQ ID NO: 196623 - RNA, 1701 nt, Artificial Sequence; identical to SEQ ID NO: 196009
  derived and/or modified sequence opt5 from hemagglutinin__InfluenzaA__ALE32115

SEQ ID NO: 196624 - RNA, 1701 nt, Artificial Sequence
  derived and/or modified sequence opt5 from hemagglutinin__InfluenzaA__ALE32116
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgcccccaucggaaaauguaaguccgaaugcauuaccccgaacggcucuaucccuaaugauaagcccuuccagaacgugaauagaaucacauacggcgcuuguccucgguaugugaaacacagcacgcucaagcuggccaccgggaugcgcaacguccccgagaaacagacaagaggaauuuuuggcgcgaucgccggguucauugaaaauggaugggagggcaugguugacgggugguacggauuucggcaccaaaacuccgagggcagaggccaggcugccgaucuuaagagcacccaggcugccaucgaccaaauuaaugggaaacugaaccgccucaucggaaagacaaaugaaaaauuccaucagauugagaaggaguucucugaaguggaaggccggauccaggaucuggagaaguauguggaggacaccaaaaucgaucuuugguccuacaacgccgaacugcucgucgcucuggagaaucagcacacgauugaccugacagauagcgaaaugaacaagcucuuugagaaaaccaagaaacaacugagagaaaacgcggaggacauggggaauggaugcuucaagaucuaucauaagugugauaacgccugcauuggcucuauccgcaaugggaccuacgaccacaacguguaccgggacgaggcucuuaauaacagauuucagauuaaaggcguugaacugaaguccggauauaaagauuggauccucuggaucagcuucgccauuuccugcuuucugcuuuguguggcccugcucggcuucaucaugugggcuugccagaaggggaauguccgcuguaacauuugcaucuga

SEQ ID NO: 196625 - RNA, 1701 nt, Artificial Sequence
  derived and/or modified sequence opt5 from hemagglutinin__InfluenzaA__ALE32117
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgcccccaucggaaaauguaaguccgaaugcauuaccccgaacggcucuaucccuaaugauaagcccuuccagaacgugaauagaaucacauacggcgcuuguccucgguaugugaaacacagcacgcucaagcuggccaccgggaugcgcaacguccccgagaaacagacaagaggaauuuuuggcgcgaucgccggguucauugaaaauggaugggagggcaugguugacgggugguacggauuucggcaccaaaacuccgagggcagaggccaggcugccgauuucaagagcacccaggcugccaucgaccaaauuaaugggaaacuuaaccgccugaucggaaagacaaaugaaaaauuccaucagauugagaaggaauuuucugagguggaaggccggauccaggaucucgagaaguauguggaggacaccaaaaucgaucugugguccuacaacgccgaacuucuggucgcucucgagaaucagcacacgauugaccugacagauagcgaaaugaacaagcuguucgagaaaaccaagaaacaacucagagaaaacgcggaggacauggggaauggaugcuuuaagaucuaucauaagugugauaacgccugcauuggcucuauccgcaaugggaccuacgaccacaacguguaccgggacgaggcucugaauaacagauuccagauuaaaggcguugaacuuaaguccgaguauaaagauuggauccuguggaucagcuuugccauuuccugcuuccuccuguguguggcccuucugggauuuaucaugugggcuugccagaagggcaauauucgcuguaacaucugcauuuga

SEQ ID NO: 196626 - RNA, 1701 nt, Artificial Sequence; identical to SEQ ID NO: 196071
  derived and/or modified sequence opt5 from hemagglutinin__InfluenzaA__ALE32118

SEQ ID NO: 196627 - RNA, 1701 nt, Artificial Sequence; identical to SEQ ID NO: 185693
  derived and/or modified sequence opt5 from hemagglutinin__InfluenzaA__ALM06086

SEQ ID NO: 196628 - RNA, 1701 nt, Artificial Sequence; identical to SEQ ID NO: 193064
  derived and/or modified sequence opt5 from hemagglutinin__InfluenzaA__ALM06087

SEQ ID NO: 196629 - RNA, 1701 nt, Artificial Sequence
  derived and/or modified sequence opt5 from hemagglutinin__InfluenzaA__ALM06088
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgggcaagagggaagaaugaacuacuauuggacgcugguugaacccggcgacaaaauuacauucgaggccaccgggaaccugguggugccucgguacgcguuuacaauggaacgcaaugccggaagcggcaucauuaucucugauacccccguccaugacugcaacaccacaugucagacgccugagggcgcuaucaauaccucccuccccuuccagaacauucacccgaucacaauugggaagugcccuaaauauguuaagagcaccaagcugagacuugccacaggacugcggaaugugcccucuauccagagccgcggccucuuuggggcuauugccggauucaucgaaggcggguggaccggaaugguggauggcugguacggcuaucaucaccaaaacgagcagggguccggauacgccgcugaccugaaaucuacgcagaaugcgaucgacaagauuacaaacaaagucaauagcgugaucgagaagaugaacacccaguuuaccgccguuggcaaagaguucaaucaccuugagaagagaauugaaaaccugaauaagaaaguggaugacggguuccucgauaucuggacauacaacgcugagcugcugguccuccuggaaaaugagcggacccuugacuaucaugauuccaacgugaagaaccuguacgagaaaguccgcaaucaacucaagaacaaugccaaagaaauuggaaacggcuguuuugaguucuaucacaagugcgacaauacauguauggaaagcgugaagaacgggacguacgauuauccuaaauacucugaggaagccaagcugaauagagagaaaaucgacggcguuaaacuugaguccacccggaucuaucagauucuggcuaucuacagcacaguggccucuucccucguccuggugguuagccugggagcgauuuccuuuuggaugugcucuaacggcagccuccagugccgcaucuguauuuga

SEQ ID NO: 196630 - RNA, 1701 nt, Artificial Sequence; identical to SEQ ID NO: 193064
  derived and/or modified sequence opt5 from hemagglutinin__InfluenzaA__ALM06089

SEQ ID NO: 196631 - RNA, 1701 nt, Artificial Sequence
  derived and/or modified sequence opt5 from hemagglutinin__InfluenzaA__ALN39661
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgcccccaucggaaaauguaaguccgaaugcauuaccccgaacggcucuaucccuaaugauaagcccuuccagaacgugaauagaaucacauacggcgcuuguccucgguaugugaaacacagcacgcucaagcuggccaccgggaugcgcaacguccccgagaaacagacaagaggaauuuuuggcgcgaucgccggguucauugaaaauggaugggagggcaugguugacgggugguacggauuucggcaccaaaacuccgagggcagaggccaggcugccgaucuuaagagcacccaggcugccaucgaccaaauuaaugggaaacugaaccgccucaucggaaagacaaaugaaaaauuccaucagauugagaaggaguucucugaaguggaaggccggauccaggaucuggagaaguauguggaggacaccaaaaucgaucuuugguccuacaacgccgaacugcucgucgcucuggagaaucagcacacgauugaccugacagauagcgaaaugaacaagcucuuugagaaaaccaagaaacaacugagagaaaacgcggaggacauggggaauggaugcuucaagaucuaucauaagugugauaacgccugcauuggcucuauccgcaaugggaccuacgaccacaacguguaccgggacgaggcucuuaauaacagauuucagauuaaaggcguugaacugaaguccggauauaaagauuggauccucuggaucagcuucgccauuuccugcuuucugcuuuguaucgcccugcucggcuucauuaugugggcuugccagaaggggaauauccgcuguaacauuugcaucuga

SEQ ID NO: 196632 - RNA, 1701 nt, Artificial Sequence; identical to SEQ ID NO: 195998
  derived and/or modified sequence opt5 from hemagglutinin__InfluenzaA__ALN39662

SEQ ID NO: 196633 - RNA, 1701 nt, Artificial Sequence; identical to SEQ ID NO: 195465
  derived and/or modified sequence opt5 from hemagglutinin__InfluenzaA__ALN39663

SEQ ID NO: 196634 - RNA, 1701 nt, Artificial Sequence
  derived and/or modified sequence opt5 from hemagglutinin__InfluenzaA__ALN39664
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccagcugcauuagaggcucuaauuccagcuuuuucucucggcugaacuggcucacacaucugaauagcaaguauccugcccuuaacgucaccaugcccaacaaugagcaguuugacaagcuguacaucuggggagugcaccauccugggacagauaaagaccagauuuuccucuaugcgcagccgagcggccgcguuaccguguccacgaagagaucucaacaggccgucauccccaacauugggagccggccucgcaucagagauauccccucccggauuagcaucuacuggacaauugugaaaccuggagacauccugcugauuaauucuaccggcaaccucaucgcuccccgcggguacuuuaagaucagauccggaaaaagcucuauuaugcggagcgacgccccgaucggcaaguguaaguccgaaugcauuacaccuaauggcucuauccccaacgauaaaccuuuccagaaugugaaccgcauuaccuauggggcuugucccagauacgucaagcagagcacccugaaacuugccacaggaaugcggaauguucccgagcgccaaacgagaggcaucuuuggggcgaucgccggauucauugaaaacggcugggaggggaugguggacggaugguauggcuuucggcaccaaaauuccgagggcagagggcaggcugccgaucugaaguccacccaggcugccaucgaccagauuaacggaaaacucaaucgccugaucggcaagacaaacgaaaaauuccaccagauugagaaggaguucucugaaguggaagggcggauccaggaucuugagaaguacgucgaggacaccaaaauugaucugugguccuauaaugccgaacuccugguggcucuggagaaccaacauacaaucgaccucaccgauagcgaaaugaacaagcuguuugagaaaacgaagaaacagcuuagagaaaaugcggaggacaugggaaacggcugcuucaagaucuaccacaagugugauaaugccugcauugggucuauccgcaacggcacauaugaccaugacguuuaccgggaugaggcucugaauaacagauuucagauuaaaggaguggaacucaaguccggcuacaaagacuggauccuguggauuagcuucgccaucuccugcuuucuucugugugucgcccuccugggguucaucaugugggcuugccagaagggaaauauucgcuguaacaucugcauuuga

SEQ ID NO: 196635 - RNA, 1701 nt, Artificial Sequence; identical to SEQ ID NO: 195465
  derived and/or modified sequence opt5 from hemagglutinin__InfluenzaA__ALN39665

SEQ ID NO: 196636 - RNA, 1701 nt, Artificial Sequence; identical to SEQ ID NO: 196071
  derived and/or modified sequence opt5 from hemagglutinin__InfluenzaA__ALN39666

SEQ ID NO: 196637 - RNA, 1701 nt, Artificial Sequence
  derived and/or modified sequence opt5 from hemagglutinin__InfluenzaA__ALN39667
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcaacuccccgcaccagauucuugacggggaaaauuguacacugaucgaugcccuccugggagacccccagugcgauggcuuucagaacaaaaagugggaccuguucgucgagcggucuaaagccuauagcaauuguuacccuuaugaugugcccgacuacgcuucccuccgcucucugguugccagcuccgggacccuugaauuuaacaaugagagcuucaacugggcuggagugacgcaaaauggcaccucuuccgccugcauuagaggcagcaacucuuccuuuuucagccggcugaauuggcucacacauucuaacuuuaaguauccugcgcugaacgucaccaugcccaauaacgagcaguucgauaaacuuuacaucuggggagugcaccauccugggacagacaaggaucagauuuuucuguaugcccaguccagcggccgcaucaccguuuccacgaagagaucucaacaggcugugacaccgaauauugggagccggccccgcaucagaaacaucccuucccggauuagcaucuacuggaccauugucaaacccggagacauccuccugauuaauucuacaggcaaccugaucgccccucgcggguacuucaagaucagauccggaaaaagcucuauuaugcggagcgaugcucccaucggcaaguguaaguccgaaugcauuaccccgaauggcucuaucccuaacgacaaacccuuucagaaugugaaccgcauuaccuauggggccuguccuagauacgugaagcagagcacacucaaacuggcgacgggaaugcggaauguccccgagaagcaaacccgcggcaucuucggggccaucgcuggauuuauugaaaacggcugggaggggaugaaagacggaugguauggcuucagacaccaaaauuccgagggccgggggcaggccgcugaucuuaagagcacacaggccgccaucgaccagauuaacggaaaacugaauagacucaucggcaagaccaacgaaaaguuccaccagauugagaaagaauuuucugagguugaagggcgcauccaggaucuggagaaguacguggaggacacaaaaauugaucuuugguccuauaacgcugaacugcucguggcgcuggagaaucaacauaccaucgaccugacggauagcgaaaugaacaaacucuucgagaagacaaagaagcagcugcgggaaaaugccgaggacaugggaaacggcugcuuuaaaaucuaccacaagugugauaaugcuugcauugggucuaucagaaacggcaccuaugaccaugaugucuaccgcaaugaggcccuuaacaaucgguuccagauuaaaggaguggaacugaaguccggcuacaaagacuggauccucuggauuagcuuugccaucuccugcuuccugcuuuguguugcucugcucggguuuaucaugugggccugccagaagggaaacauuagauguaauaucugcauuuga

SEQ ID NO: 196638 - RNA, 1701 nt, Artificial Sequence; identical to SEQ ID NO: 196540
  derived and/or modified sequence opt5 from hemagglutinin__InfluenzaA__ALN39668

SEQ ID NO: 196639 - RNA, 1701 nt, Artificial Sequence
  derived and/or modified sequence opt5 from hemagglutinin__InfluenzaA__ALN39669
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcagcucuccggaagaauuacaguuagcaccaagcggucccaacaggccgugaucccgaauaucggcucucgcccccggauuagagauaucccuagccgcauuuccaucuacuggacaauugucaagcccggggacauccugcugaucaacagcaccggaaaucucauugcuccuagaggcuauuuuaaaauccggucugggaaguccagcauuaugcgcucugacgcccccaucggaaaauguaagagcgaaugcauuaccccgaacggcuccaucccuaaugauaagcccuuccagaacgugaauagaaucacauacggcgcuuguccucgguaugugaaacacucuacgcugaaacuugccaccgggaugcgcaacguccccgagaagcagacaagaggaauuuuuggcgcgaucgccggguucauugaaaauggaugggagggcaugguugacgggugguacggauuucggcaccaaaacagcgagggcagaggccaggcugccgaucugaaguccacccaggcugccaucgaccaaauuaaugggaaacucaaccgccugaucggaaagacaaaugaaaaauuccaucagauugagaaggaguucagcgaaguggaaggccggauccaggaucuugagaaguauguggaggacaccaaaaucgaucuguggucuuacaacgccgaacuccuggucgcucuggagaaucagcacacgauugaccucacagauuccgaaaugaacaagcuguuugagaaaaccaagaaacaacuuagagaaaacgcggaggacauggggaauggaugcuucaagaucuaucauaagugugauaacgccugcauuggcagcauccgcaaugggaccuacgaccacaacguguaccgggacgaggcucugaauaacagauuucagauuaaaggcguugaacucaagucuggauauaaagauuggauccuguggaucuccuucgccauuagcugcuuucuucuguguguggcccuccugggcuucaucaugugggcuugccagaaggggaauauucgcuguaacaucugcauuuga

SEQ ID NO: 196640 - RNA, 1701 nt, Artificial Sequence; identical to SEQ ID NO: 195465
  derived and/or modified sequence opt5 from hemagglutinin__InfluenzaA__ALN39670

SEQ ID NO: 196641 - RNA, 1701 nt, Artificial Sequence
  derived and/or modified sequence opt5 from hemagglutinin__InfluenzaA__ALN39671
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgcccccaucggaaaauguaaguccgaaugcauuaccccgaacggcucuaucccuaaugauaagcccuuccagaacgugaauagaaucacauacggcgcuuguccucgguaugugaaacacagcacgcucaagcuggccaccgggaugcgcaacguccccgagaaacagacaagaggaauuuuuggcgcgaucgccggguucauugaaaauggaugggagggcaugguugacgggugguacggauuucggcaccaaaacuccgagggcagaggccaggcugccgaucuuaagagcacccaggcugccaucgaccaaauuaaugggaaacugaaccgccucaucggaaagacaaaugaaaaauuccaucagauugagaaggaguucucugaaguggaaggccggauccaggaucuggagaaguauguggaggacaccaaaaucgaucuuugguccuacaacgccgaacugcucgucgcucuggagaaucagcacacgauugaccugacagauagcgaaaugaacaagcucuuugagaaaaccagaaagcaacugcgcgaaaacgcggaggacauggggaauggaugcuucaaaaucuaucauaagugugauaacgccugcauuggcucuauccggaaugggaccuacgaccacaacguguacagagacgaggcucuuaauaaccgcuuucagauuaagggcguugaacugaaauccggauauaaggauuggauccucuggaucagcuucgccauuuccugcuuucugcuuuguguggcccugcucggcuucaucaugugggcuugccagaaagggaauauucgguguaacaucugcauuuga

SEQ ID NO: 196642 - RNA, 1701 nt, Artificial Sequence; identical to SEQ ID NO: 195465
  derived and/or modified sequence opt5 from hemagglutinin__InfluenzaA__ALN39672

SEQ ID NO: 196643 - RNA, 1701 nt, Artificial Sequence
  derived and/or modified sequence opt5 from hemagglutinin__InfluenzaA__ALN39673
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccggauaucggcagccgcccccggauuagagacaucccuucccgcauuagcaucuacuggacaauugucaagcccggggacauccuccugaucaauucuaccggaaaccugauugcuccuagaggcuauuuuaaaauccgguccgggaagucuucuauuaugcgcagcgaugcccccaucggaaaauguaaguccgaaugcauuaccccgaauggcucuaucccuaacgacaagcccuuccagaaugugaacagaaucacauacggcgcuuguccucgguaugugaaacacagcacgcucaagcuggccaccgggaugcgcaauguccccgagaaacagacaagaggaauuuuuggcgcgaucgccggguucauugaaaacggaugggagggcaugguugaugggugguacggauuucggcaccaaaauuccgagggcagaggccaggcugccgaccuuaagagcacccaggcugccaucgaucaaauuaacgggaaacugaaucgccucaucggaaagacaaacgaaaaauuccaucagauugagaaggaguucucugaaguggaaggccggauccaggaccuggagaaguauguggaggauaccaaaaucgaccuuugguccuacaaugccgaacugcucgucgcucuggagaaccagcacacgauugaucugacagacagcgaaaugaauaagcucuuugagaaaaccaagaaacaacugagagaaaacgcggaggauauggggaacggaugcuucaagaucuaucauaagugugacaaugccugcauuggcucuauccgcaacgggaccuacgaccacaauguguaccgggaugaggcucuuaacaauagauuucagauuaaaggcguugaacugaaguccggauauaaagacuggauccucuggaucagcuucgccauuuccugcuuucugcuuuguguggcccugcucggcuucaucaugugggcuugccagaaggggaacauucgcuguaauaucugcauuuga

SEQ ID NO: 196644 - RNA, 1701 nt, Artificial Sequence; identical to SEQ ID NO: 196005
  derived and/or modified sequence opt5 from hemagglutinin__InfluenzaA__ALN39674

SEQ ID NO: 196645 - RNA, 1701 nt, Artificial Sequence; identical to SEQ ID NO: 195465
  derived and/or modified sequence opt5 from hemagglutinin__InfluenzaA__ALN39675

SEQ ID NO: 196646 - RNA, 1701 nt, Artificial Sequence
  derived and/or modified sequence opt5 from hemagglutinin__InfluenzaA__ALN39676
augaagaccaucauugcccugagcugcauccucugucugguguucgcucagaaacuucccggcaacgacaauuccacagccacgcugugccucgggcaccaugcggucccuaacggaaccauuguuaagacaaucaccaaugauagaauugaggugacaaacgcuaccgaacuggugcaaaauucuagcaucggcgagaucugugacuccccgcaccagauucuugauggggaaaacugcacacugaucgacgcccuccugggagauccccagugugacggcuuucagaauaaaaagugggaucuguucgucgagcggucuaaagccuacagcaacugcuauccuuacgacgugcccgauuaugcuucccuccgcucucugguugccagcuccgggacccuugaauuuaauaacgagaauuucaacugggcuggagugacgcaaaauggcaccucuagcuccuguauuagaggcagcaacucuuccuuuuucagccggcugaauuggcucacacaucugaacucuaaguacccugcccuuaacgucaccaugcccaauaacgagcaguuugacaagcuguauaucuggggagugcaccauccugggacagauaaagaccagauuuuccucuacgcgcaguccagcggccgcaucaccguuuccacgaagagaucucaacaggccgugauuccgaauaucgggagccggccccgcaucagagauauuccuucccggaucagcauuuauuggacaaucgucaaacccggagacauucugcugaucaacucuaccggcaaucucaucgcuccucgcggguacuuuagaauuagauccggaaagagcucuaucaugcgcagcgacgcccccauuggcaaaugcaaguccgaauguaucacaccgaacggcucuauuccuaaugauaagcccuuccagaacgugaauagaaucaccuacggggcuugcccucgguaugugaaacagaacacccugaaacuugccacaggaaugcgcaauguccccgagagacaaacgcggggcaucuuuggggcgauugccggauucaucgaaaacggcugggaggggaugguugacggaugguacggcuuuagacaccagaauagcgagggccgcgggcaggcugccgaucugaaguccacccaaagcgcuauugaccagaucaacggaaagcucaaucggcugauuggcaaaacaaacgaaaaguuccaccagaucgagaaagaguucucugaaguggaagggcggauucaggaucuugagaaguauguggaggacaccaagaucgaucugugguccuacaacgccgaacuccuggucgcccuggagaaucaacauacaaucgaccucaccgauagcgaaaugaacaaacuguuugagaagacgaaaaagcagcuucgcgaaaaugcugaggacaugggaaacggcuguuucaaaauuuaucacaagugcgauaaugcgugcaucgggucuauucggaacggcacauacgaccaugacguguauagagaugaggcccugaauaaccgcuuucagaucaagggaguugaacucaaauccggcuacaaggacuggauucuguggaucagcuucgcuaucuccuguuuucuucugugcguggcccuccugggguucauuaugugggccugucagaaaggaaauauccggugcaacauuuguaucuga

SEQ ID NO: 196647 - RNA, 1701 nt, Artificial Sequence
  derived and/or modified sequence opt5 from hemagglutinin__InfluenzaA__ALN39677
augaagaccaucauugcccugggcuacauccucugccugguguucgcucagaaaauucccgggaacgacaauagcacagccacgcuuugucugggacaccaugcggucccuaacggcaccaucguuaagacaauuaccaaugauagaaucgaggugacaaacgcuaccgaacucgugcaaaauuccucuaucggggagauuugcgacagcccgcacaaaauccuggauggagaaaacuguacacuuauugacgcccugcucggcgauccccagugcgacggguuucagaauaagaaaugggaucuguucgucgagcgguccaaggccuauucuaacuguuacccuuaugacgugcccgauuacgcuagccugcgcucccucguugccucuagcggaacccuggaauuuaauaacgaguccuucaauuggacgggcgugacccagaacggcacaagcucugcuugcaucagacgguccucuagcuccuuuuucagccgccuuaauuggcugacccaucucaacuaugccuacccugcgcugaaugucacaaugcccaacaacgagcaauuugacaaacuuuauauuuggggagugcaccauccugggaccgauaaagaccagaucuuccuguacgcccagucuuccggcagaauuacgguuagcacaaagcggucccagcaagcugugaucccgaauaucgggucucgcccccggauuagagauaucccuagccgcauuuccaucuacuggaccauugucaaacccggagacauccuccugaucaacagcacaggcaaucugauugccccuagaggguauuuuaagauccggucuggaaaauccagcauuaugcgcucugacgcucccaucggcaaguguaagagcgaaugcauuaccccgaacggcuccaucccuaaugauaaacccuuccagaacgugaauagaaucaccuacggggccuguccucgguaugugaagcacucuacacucaaacuggcgacgggaaugcgcaacguccccgagaagcagaccagaggcauuuuuggggccaucgcuggauucauugaaaauggcugggaggggaugguugacggaugguacggcuuucggcaccagaacagcgagggcagagggcaagccgcugaucuuaaauccacacaggccgccaucgaccagauuaauggaaagcugaaccgccucaucggcaaaaccaaugaaaaguuccaucaaauugagaaggaguucagcgaaguggaagggcggauccaggaucuggagaaauauguggaggacacaaagaucgaucuuuggucuuacaacgcugaacugcucgucgcgcuggagaaucagcacaccauugaccugacggauuccgaaaugaacaaacucuuugagaagacaaagaagcagcugagagaaaacgccgaggacaugggaaauggcugcuucaagaucuaucauaaaugugauaacgcuugcauugggagcauccgcaauggcaccuacgaccacaacguguaccgggacgaggcccuuaauaacagauuucaaauuaagggaguugaacugaaaucuggcuauaaggauuggauccucuggaucuccuucgccauuagcugcuuucugcuuuguguggcucugcucggguucaucaugugggccugccagaaaggaaauauucgcuguaacaucugcauuuga

SEQ ID NO: 196648 - RNA, 1701 nt, Artificial Sequence; identical to SEQ ID NO: 196352
  derived and/or modified sequence opt5 from hemagglutinin__InfluenzaA__ALN39678

SEQ ID NO: 196649 - RNA, 1701 nt, Artificial Sequence
  derived and/or modified sequence opt5 from hemagglutinin__InfluenzaA__ALN39679
augaagaccaucauugcccugggcuacauccucugccugguguucgcucagaaaauucccgggaacgacaauagcacagccacgcuuugucugggacaccaugcggucccuaacggcaccguugugaagacaaucaccaaugauagaauugaggugacaaacgcuaccgaacucguccaaaauuccucuaucggggagaucugcgacagcccgcacaaaauucuggauggagaaaacuguacacuuaucgacgcccugcucggcgauccccagugcgacggguuucagaauaagaaaugggaucuguucguggagcgguccaaggccuauucuaacuguuacccuuaugacguucccgauuacgcuagccugcgcucccucguggccucuagcggaacccuggaauuuaauaacgaguccuucaauuggacgggcgucacccagaacggcacaagcucugcuugcauuagacgguccucuagcuccuuuuucagccgccuuaauuggcugacccaucucaacuauacauacccugcccugaaugugaccaugcccaacaacgagcaauuugacaaacuuuauaucuggggaguucaccauccugggacggauaaggaccagauuuuccuguacgcgcagucuuccggcagaaucacagugagcaccaagcggucccagcaagccgucauuccgaauaucgggucucgccccagaauccgggauauuccuagccgcaucuccauuuacuggacaaucgugaaacccggagacauucuccugaucaacagcaccggcaaucugaucgcuccuagaggguauuuuaagauucggucuggaaaauccagcaucaugcgcucugacgcccccauuggcaaguguaagagcgaaugcaucaccccgaacggcuccauuccuaaugauaaacccuuccagaacgugaauagaaucacauacggggcuuguccucgguaugucaagcacucuacgcucaaacuggccaccggaaugcgcaacguucccgagaagcagacaagaggcaucuuuggggcgauugccggauucaucgaaaauggcugggaggggaugguggacggaugguacggcuuucggcaccagaacagcgagggcagagggcaagcugccgaucuuaaauccacccaggcugccauugaccagaucaauggaaagcugaaccgccucauuggcaaaacaaaugaaaaguuccaucaaaucgagaaggaguucagcgaaguggaagggcggauucaggaucuggagaaauaugucgaggacaccaagaucgaucuuuggucuuacaacgccgaacugcucguggcucuggagaaucagcacacgaucgaccugacagauuccgaaaugaacaaacucuuugagaagaccaaaaagcagcugagagaaaacgcggaggacaugggaaauggcugcuucaagauuuaucauaaaugugauaacgccugcaucgggagcauucgcaauggcaccuacgaccacaacguuuaccgggacgaggcucuuaauaacagauuucaaaucaagggaguggaacugaaaucuggcuauaaggauuggauucucuggaucuccuucgccaucagcugcuuucugcuuugugucgcccugcucggguucauuaugugggcuugccagaaaggaaauauccgcuguaacauuugcaucuga

SEQ ID NO: 196650 - RNA, 1701 nt, Artificial Sequence; identical to SEQ ID NO: 196352
  derived and/or modified sequence opt5 from hemagglutinin__InfluenzaA__ALN39680

SEQ ID NO: 196651 - RNA, 1701 nt, Artificial Sequence; identical to SEQ ID NO: 196352
  derived and/or modified sequence opt5 from hemagglutinin__InfluenzaA__ALN39681

SEQ ID NO: 196652 - RNA, 1701 nt, Artificial Sequence; identical to SEQ ID NO: 196352
  derived and/or modified sequence opt5 from hemagglutinin__InfluenzaA__ALN39682

SEQ ID NO: 196653 - RNA, 1701 nt, Artificial Sequence; identical to SEQ ID NO: 196352
  derived and/or modified sequence opt5 from hemagglutinin__InfluenzaA__ALN39683

SEQ ID NO: 196654 - RNA, 1701 nt, Artificial Sequence; identical to SEQ ID NO: 196352
  derived and/or modified sequence opt5 from hemagglutinin__InfluenzaA__ALN39684

SEQ ID NO: 196655 - RNA, 1701 nt, Artificial Sequence; identical to SEQ ID NO: 196352
  derived and/or modified sequence opt5 from hemagglutinin__InfluenzaA__ALN39685

SEQ ID NO: 196656 - RNA, 1701 nt, Artificial Sequence
  derived and/or modified sequence opt5 from hemagglutinin__InfluenzaA__ALN39686
augaagaccaucauugcccugggcuacauccucugccuggcuuucgcccagaaaauucccgggaacgacaauagcacagcgacgcuuugucugggacaccaugcugugccuaacggcaccaucgucaagacaauuaccaaugauagaaucgagguuacaaacgccaccgaacucgugcaaaauuccucuaucggggagauuugcgacagcccgcacaaaauccuggauggagaaaacuguacacuuauugacgcccugcucggcgauccccagugcgacggguuucagaauaagaaaugggaucuguucguggagcgguccaaggcuuauucuaacuguuacccuuaugacguccccgauuacaccagccugcgcucccucguggccucuagcggaacgcuggaauuuaauaacgaguccuucaauuggaccggcguuacacagaacggcaccagcucugcuugcaucagacgguccucuagcuccuuuuucagccgccuuaauuggcugacacaucucaacuauaccuacccugcccugaaugugacgaugcccaacaacgagcaauuugacaaacuuuauauuuggggaguccaccauccugggacagauaaggaccagaucuuccuguacgcgcagucuuccggcagaauuaccgugagcacaaagcggucccagcaagccguuaucccgaauaucgggucucgcccccggauuagagauaucccuagccgcauuuccaucuacuggaccauugugaaacccggagacauccuccugaucaacagcaccggcaaucugauugcuccuagaggguauuuuaagauccggucuggaaaauccagcauuaugcgcucugacgcccccaucggcaaguguaagagcgaaugcauuacaccgaacggcuccaucccuaaugauaaacccuuccagaacgucaauagaaucacguacggggcuuguccucgguaugugaagcacucuacccucaaacuggccacaggaaugcgcaacgugcccgagaagcagaccagaggcauuuuuggggcgaucgccggauucauugaaaauggcugggaggggauggucgacggaugguacggcuuucggcaccagaacagcgagggcagagggcaagcugccgaucuuaaauccacacaggcugccaucgaccagauuaauggaaagcugaaccgccucaucggcaaaaccaaugaaaaguuccaucaaauugagaaggaguucagcgaaguugaagggcggauccaggaucuggagaaauauguggaggacacgaagaucgaucuuuggucuuacaacgccgaacugcucguggcucuggagaaucagcacacaauugaccugaccgauuccgaaaugaacaaacucuuugagaagaccaaaaagcagcugagagaaaacgcggaggacaugggaaauggcugcuucaagaucuaucauaaaugugauaacgccugcauugggagcauccgcaauggcacauacgaccacaacgucuaccgggacgaggcucuuaauaacagauuucaaauuaagggaguggaacugaaaucuggcuauaaggauuggauccucuggaucuccuucgccauuagcugcuuucugcuuuguguugcccugcucggguucaucaugugggcuugccagaaaggaaauauucgcuguaacaucugcauuuga

SEQ ID NO: 196657 - RNA, 1701 nt, Artificial Sequence; identical to SEQ ID NO: 196352
  derived and/or modified sequence opt5 from hemagglutinin__InfluenzaA__ALN39687

SEQ ID NO: 196658 - RNA, 1701 nt, Artificial Sequence
  derived and/or modified sequence opt5 from hemagglutinin__InfluenzaA__ALN39688
augaagaccaucauugcccugggcuacauccucugccugguguucgcucagaaaauucccgggaacgacaauagcacagccacgcuuugucugggacaccaugcggucccuaacggcaccaucguuaagacaauuaccaaugauagaaucgaggugacaaacgcuaccgaacucgugcaaaauuccucuaucggggagauuugcgacagcccgcacaaaauccuggauggagaaaacuguacacuuauugacgcccugcucggcgauccccagugcgacggguuucagaauaagaaaugggaucuguucgucgagcgguccaaggccuauucuaacuguuacccuuaugacgugcccgauuacgcuagccugcgcucccucguugccucuagcggaacccuggaauuuaauaacgaguccuucaauuggacgggcgugacccagaacggcacaagcucugcuugcaucagacgguccucuagcuccuuuuucagccgccuuaauuggcugacccaucucaacuauauuuacccugcccugaaugucacaaugcccaacaacgagcaauuugacaaacuuuauaucuggggagugcaccauccugggaccgauaaagaccagauuuuccuguacgcgcagucuuccggcagaaucacgguuagcacaaagcggucccagcaagccgugaucccgaauauugggucucgccccagaauccgggauauuccuagccgcaucuccauuuacuggaccaucgucaaacccggagacauccuccugauuaacagcacaggcaaucugaucgcuccuagaggguauuuuaagauucggucuggaaaauccagcaucaugcgcucugacgcccccauuggcaaguguaagagcgaaugcaucaccccgaacggcuccaucccuaaugauaaacccuuccagaacgugaauagaauuaccuacggggcuuguccucgguaugugaagcacucuacacucaaacuggccacgggaaugcgcaacguccccgagaagcagaccagaggcaucuuuggggcgauugccggauucaucgaaaauggcugggaggggaugguugacggaugguacggcuuucggcaccagaacagcgagggcagagggcaagcugccgaucuuaaauccacacaggcugccauugaccagaucaauggaaagcugaaccgccucauuggcaaaaccaaugaaaaguuccaucaaaucgagaaggaguucagcgaaguggaagggcggauccaggaucuggagaaauauguggaggacacaaagauugaucuuuggucuuacaacgccgaacugcucgucgcucuggagaaucagcacaccaucgaccugacggauuccgaaaugaacaaacucuuugagaagacaaagaagcagcugagagaaaacgcggaggacaugggaaauggcugcuucaagauuuaucauaaaugugauaacgccugcaucgggagcauucgcaauggcaccuacgaccacaacguguaccgggacgaggcucuuaauaacagauuucaaaucaagggaguugaacugaaaucuggcuauaaggauuggauccucuggauuuccuucgccaucagcugcuuucugcuuuguguggcccugcucggguucauuaugugggcuugccagaaaggaaauauccgcuguaacauuugcaucuga

SEQ ID NO: 196659 - RNA, 1701 nt, Artificial Sequence
  derived and/or modified sequence opt5 from hemagglutinin__InfluenzaA__ALN39689
augaagaccaucauugcccugggcuacauccucugccugguguucgcucagaaaauucccgggaacgacaauagcacagccacgcuuugucugggacaccaugcggucccuaacggcaccaucguuaagacaauuaccaaugauagaaucgaggugacaaacgcuaccgaacucgugcaaaauuccucuaucggggagauuugcgacagcccgcacaaaauccuggauggagaaaacuguacacuuauugacgcccugcucggcgauccccagugcgacggguuucagaauaagaaaugggaucuguucgucgagcgguccaaggccuauucuaacuguuacccuuaugacgugcccgauuacgcuagccugcgcucccucguugccucuagcggaacccuggaauuuaauaacgaguccuucaauuggacgggcgugacccagaacggcacaagcucugcuugcaucagacgguccucuagcuccuuuuucagccgccuuaauuggcugacccaucucaacuauacauacccugcccugaaugucaccaugcccaacaacgagcaauuugacaaacuuuauauuuggggagugcaccauccugggacggauaaggaccagaucuuccuguacgcgcagucuuccggcagaauuacaguuagcaccaagcggucccagcaagccgugaucccgaauaucgggucucgcccccggauuagagauaucccuagccgcauuuccaucuacuggacaauugucaaacccggagacauccuccugauccacagcaccggcaaccugauugcuccuagaggguauuuuaagauccggucuggaaaauccagcauuaugcgcucugacgcccccaucggcaaguguaagagcgaaugcauuaccccgaauggcuccaucccuaacgauaaacccuuccagaaugugaacagaaucacauacggggcuuguccucgguaugugaagcacucuacgcucaaacuggccaccggaaugcgcaauguccccgagaagcagacaagaggcauuuuuggggcgaucgccggauucauugaaaacggcugggaggggaugguugacggaugguacggcuuucggcaucagaauagcgagggcagagggcaagcugccgaucuuaaauccacccaggcugccaucgaccagauuaacggaaagcugaaucgccucaucggcaaaacaaacgaaaaguuccaccaaauugagaaggaguucagcgaaguggaagggcggauccaggaucuggagaaauauguggaggacaccaagaucgaucuuuggucuuacaaugccgaacugcucgucgcucuggagaaccagcauacgauugaccugacagauuccgaaaugaauaaacucuuugagaagaccaaaaagcagcugagagaaaacgcggaggacaugggaaacggcugcuucaagaucuaucacaaaugugauaaugccugcauugggagcauccgcaacggcaccuacgaccacaauguguaccgggacgaggcucuuaacaauagauuucaaauuaagggaguugaacugaaaucuggcuauaaggauuggauccucuggaucuccuucgccauuagcugcuuucugcuuuguguggcccugcucggguucaucaugugggcuugccagaaaggaaacauucgcuguaauaucugcauuuga

SEQ ID NO: 196660 - RNA, 1701 nt, Artificial Sequence
  derived and/or modified sequence opt5 from hemagglutinin__InfluenzaA__ALN39690
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugaugggaaaaacuguacacugaucgacgcccuccugggagauccccagugcgacggcuuucagaauaagaaaugggaucuguucgucgaacggucuaaggcccauagcaacuguuauccuuacgacgugcccgauuaugcuucccuccgcucucugguugccagcuccgggacccuugaguuuaauaacgaauccuucaauugggcuggagugacgcaaaacggcaccucuuccagcugcauuagaggcucuaauuccagcuuuuucucucggcugaacuggcucacacaccugaauagcaucuacccugcccuuaacgucaccaugcccaacaaugagcaguuugacaagcuguauauuuggggagugcaucacccugggacagauaaagaccagaucuuccucuacgcgcagagcuccggccgcauuaccguuucuacgaagagaagccaacaggccgugaucccgaacaucgggucccggccccgcauuagagauaucccuagccggauuucuaucuauuggacaauugucaaacccggagacauccugcugaucaauuccaccggcaaccucauugcuccucgcggguacuuuaagaucagaagcggaaaaucuagcauuaugcgguccgacgcccccaucggcaaguguaagucugagugcauuacaccgaauggcagcaucccuaacgauaaacccuuccagaaugugaaccgcaucaccuacggggcuuguccuagauaugugaagcaguccacccugaaacuugccacaggaaugcggaauguccccgaacgccaaacgagaggcauuuuuggggcgaucgccggauucauugagaacggcugggaagggaugguugacggaugguacggcuuucggcaccagaauagcgagggcagagggcaggcugccgaucugaagucuacccaagcugccaucgaccagauuaacggaaaacucaaucgccugaucggcaagacaaacgagaaauuccaucagauugaaaaggaguucuccgaaguggaggggcggauccaggaucuugaaaaguauguggaggacaccaaaaucgaucuguggagcuacaaugccgagcuccuggucgcucuggaaaaccaacacacaauugaccucaccgauucugagaugaacaagcuguuugagaaaacgaagaaacagcuuagagaaaaugcggaagacaugggaaacggcugcuucaagaucuaucauaagugugauaaugccugcauuggguccauccgcaacggcacauacgaccacaauguguaucgggacgaggcucugaacaauagauuucagauuaaaggaguugagcucaagagcggcuacaaagauuggauccuguggaucuccuucgccauuucuugcuuucuucuguguguggcccuccugggguucaucaugugggcuugccagaagggaaacauucgcuguaauaucugcauuuga

SEQ ID NO: 196661 - RNA, 1701 nt, Artificial Sequence
  derived and/or modified sequence opt5 from hemagglutinin__InfluenzaA__ALN39691
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugaugggaaaaacuguacacugaucgacgcccuccugggagauccccagugcgacggcuuucagaauaagaaaugggaucuguucgucgaacggucuaaggcccauagcaacuguuauccuuacgacgugcccgauuaugcuucccuccgcucucugguugccagcuccgggacccuugaguuuaauaacgaauccuucaauugggcuggagugacgcaaaacggcaccucuuccagcugcauuagaggcucuaauuccagcuuuuucucucggcugaacuggcucacacaccuuaauuccaaguacccugcccuuaacgucaccaugcccaacaaugagcaguuugacaaacuguauaucuggggagugcaucacccugggacagauaaggaccagauuuuccucuacgcgcagccgagcggccgcaucaccguuuccacgaaaagaucucaacaggccgugauucccaacaucgggagccggccucgcaucagagauauucccucccggaucagcauuuauuggacaaucgucaagccuggagacauucugcugaucaauucuaccggcaaccucaucgcuccccgcggguacuuuaaaauuagauccggaaagagcucuaucaugcggagcgacgccccgauuggcaaguguaaauccgagugcaucacaccuaauggcucuauucccaacgauaagccuuuccagaaugugaaccgcaucaccuacggggcuugucccagauaugugaaacagagcacccugaagcuggccacaggaaugcggaauguccccgaaaaacaaacgcgcggcaucuuuggggcgauugccggauucaucgagaacggcugggaagggaugaaggacggaugguacggcuuuagacaccagaauagcgagggccgggggcaggcugccgaucugaaaagcacccaagcugccauugaccagaucaacggaaagcucaauagacugauuggcaagacaaacgagaaauuccaucagaucgaaaaggaguucucugaaguugaggggcgcauucaggaucuugaaaaauauguggaggacaccaagaucgaucugugguccuacaaugccgagcuccugguggcucuggaaaaccaacacacaaucgaccucaccgauagcgagaugaacaaacuguuugaaaagacgaagaaacagcuucgggagaaugcggaagacaugggaaacggcugcuucaagauuuaucauaaaugugauaaugccugcaucgggucuauuagaaacggcacauacgaccacgacgucuaucgcgaugaggcucugaauaaccgguuucagaucaagggaguggagcucaaauccggcuacaaggacuggauucuguggaucagcuucgccaucuccugcuuucuucuguguguugcccuccugggguucauuaugugggcuugccagaagggaaauaucagauguaacauuugcaucuga

SEQ ID NO: 196662 - RNA, 1701 nt, Artificial Sequence; identical to SEQ ID NO: 196352
  derived and/or modified sequence opt5 from hemagglutinin__InfluenzaA__ALN39692

SEQ ID NO: 196663 - RNA, 1701 nt, Artificial Sequence; identical to SEQ ID NO: 196352
  derived and/or modified sequence opt5 from hemagglutinin__InfluenzaA__ALN39693

SEQ ID NO: 196664 - RNA, 1701 nt, Artificial Sequence; identical to SEQ ID NO: 196352
  derived and/or modified sequence opt5 from hemagglutinin__InfluenzaA__ALN39694

SEQ ID NO: 196665 - RNA, 1701 nt, Artificial Sequence; identical to SEQ ID NO: 196352
  derived and/or modified sequence opt5 from hemagglutinin__InfluenzaA__ALN39695

SEQ ID NO: 196666 - RNA, 1701 nt, Artificial Sequence; identical to SEQ ID NO: 196352
  derived and/or modified sequence opt5 from hemagglutinin__InfluenzaA__ALN39696

SEQ ID NO: 196667 - RNA, 1701 nt, Artificial Sequence; identical to SEQ ID NO: 196022
  derived and/or modified sequence opt5 from hemagglutinin__InfluenzaA__ALN39697

SEQ ID NO: 196668 - RNA, 1701 nt, Artificial Sequence
  derived and/or modified sequence opt5 from hemagglutinin__InfluenzaA__ALN39698
augaagaccaucauugcccugagccacauccucugccugguguucgcucagaaaauucccggcaacgacaauuccacagccacgcuuugucuggggcaucacgcggucccuaacggaaccaucguuaagacaauuaccaaugauagaaucgaggugacaaacgcuaccgaacucgugcaaaauucuagcaucggcgagauuugcgacuccccgcaucagauccuggauggggaaaacuguacacuuauugacgcccugcucggagauccccagugcgacggcuuucagaauaaaaagugggaucuguucgucgagcggucuaaagccuacagcaacuguuauccuuacgacgugcccgauuaugcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaccucaacuacacauauccugcccugaaugucaccaugcccaacaacgagcaguuugacaaacuuuacauuuggggcgugcaucacccugggacggauaaggaccagaucuuccuguaugcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuacuuuaaaauccgguccgggaagucuucuauuaugcgcagcgacgcccccaucggaaaauguaaguccgaaugcauuaccccgaacggcucuaucccuaaugauaagcccuuccagaacgugaauagaaucacauauggcgcuuguccucgguacgugaaacacagcacgcucaagcuggccaccgggaugcgcaacguccccgagaaacagacaagaggaauuuuuggcgcgaucgccggguucauugaaaauggaugggagggcaugauggacgggugguauggauuucggcaucaaaacuccgagggcagaggccaggcugccgaucuuaagagcacccaggcugccaucgaccaaauuaaugggaaacugaaccgccucaucggaaagacaaaugaaaaauuccaccagauugagaaggaguucucugaaguugaaggccggauccaggaucuggagaaguacguggaggacaccaaaaucgaucuuugguccuauaacgccgaacugcucguggcucuggagaaucagcauacgauugaccugacagauagcgaaaugaacaagcucuuugagaaaaccaagaaacaacugagagaaaacgcggaggacauggggaauggaugcuucaagaucuaccacaagugugauaacgccugcaugggcucuauucgcaaugggaccuaugaccacaacgucuaccggaaugaggcucuuaacaauagauuucagaucaaaggcguggaacugaaguccggauacaaagacuggauucucuggaucagcuucgccaucuccugcuuucugcuuuguguugcccugcucggcuucauuaugugggcuugccagaaggggaacauccgcuguaauauuugcaucuga

SEQ ID NO: 196669 - RNA, 1701 nt, Artificial Sequence
  derived and/or modified sequence opt5 from hemagglutinin__InfluenzaA__ALN39700
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgcccccaucggaaaauguaaguccgaaugcauuaccccgaacggcucuaucccuaaugauaagcccuuccagaacgugaauagaaucacauacggcgcuuguccucgguaugugaaacacagcacgcucaagcuggccaccgggaugcgcaacguccccgagaaacagacaagaggaauuuuuggcgcgaucgccggguucauugaaaauggaugggagggcaugguugacgggugguacggauuucggcaccaaaacuccgagggcagaggccaggcugccgaucuuaagagcacccaggcugccaucgaccaaauuaaugggaaacugaaccgccucaucggaaagacaaaugaaaaauuccaucagauugagaaggaguucucugaaguggaaggccggauccaggaucuggagaaguauguggaggacaccaaaaucgaucuuugguccuacaacgccgaacugcucgucgcucuggagaaucagcacacgauugaccugacagauagcgaaaugaacaagcucuuugagaaaaccaagaaacaacugagagaaaacgcggaggacauggggaauggaugcuucaagaucuaucauaagugugauaacgccugcauuggcucuauccgcaaugggaccuacgaccacaacguguaccgggacgaggcucuuaauaacagauuucagauuaaaggcguugaacugaaguccggauauaaagauuggauccucuggaucagcuucgccauuuccugcuuucugcuuuguguggcccugcucggcuucaucaugugggcuugccagaaggggaauauuaaauguaacaucugcauuuga

SEQ ID NO: 196670 - RNA, 1701 nt, Artificial Sequence; identical to SEQ ID NO: 196071
  derived and/or modified sequence opt5 from hemagglutinin__InfluenzaA__ALN39701

SEQ ID NO: 196671 - RNA, 1701 nt, Artificial Sequence
  derived and/or modified sequence opt5 from hemagglutinin__InfluenzaA__ALN39702
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaaagucuagcuccagcuuuuucucucggcuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcgcuccagcggaagaauuacaguuuccaccaagcggucucagcaagccgugaucccgaauaucggcagccgcccccggauuagagauaucccuucccgcauuagcaucuacuggacaauugucaaacccggggacauccuccugaucaacucuaccggaaaucugauugcuccuagaggcuauuuuaagauccgguccgggaaaagcucuauuaugcgcagcgacgcccccaucggaaaguguaaguccgaaugcauuaccccgaacggcucuaucccuaaugauaaacccuuccagaacgugaauagaaucacauacggcgcuuguccucgguaugugaagcacagcacgcucaaacuggccaccgggaugcgcaacguccccgagaagcagacaagaggaauuuuuggcgcgaucgccggguucauugaaaauggaugggagggcaugguugacgggugguacggauuucggcaccagaacuccgagggcagaggccaagcugccgaucuuaaaagcacccaggcugccaucgaccagauuaaugggaagcugaaccgccucaucggaaaaacaaaugaaaaguuccaucaaauugagaaggaguucucugaaguggaaggccggauccaggaucuggagaaauauguggaggacaccaagaucgaucuuugguccuacaacgccgaacugcucgucgcucuggagaaucagcacacgauugaccugacagauagcgaaaugaacaaacucuuugagaagaccaaaaagcagcugagagaaaacgcggaggacauggggaauggaugcuucaagaucuaucauaaaugugauaacgccugcauuggcucuauccgcaaugggaccuacgaccacaacguguaccgggacgaggcucuuaauaacagauuucaaauuaagggcguugaacugaaauccggauauaaggauuggauccucuggaucagcuucgccauuuccugcuuucugcuuuguguggcccugcucggcuucaucaugugggcuugccagaaagggaauauucgcuguucuaucugcauuuga

SEQ ID NO: 196672 - RNA, 1701 nt, Artificial Sequence
  derived and/or modified sequence opt5 from hemagglutinin__InfluenzaA__ALN39703
augaagaccaucauugcccugagcuacauccucugccugguguucgcucagaaaauucccggcaacgacgauuccacagccacgcuuugucuggggcaccaugcggucccuaauggaaccaucguuaagacaauuaccaacgacagaaucgaggugacaaaugcuaccgaacucgugcaaaacucuagcaucggcgagauuugcgauuccccgcaccagauccuggacggggaaaauuguacacuuauugaugcccugcucggagacccccagugcgauggcuuucagaacaaaaagugggaccuguucgucgagcggucuaaagccuauagcaauuguuacccuuaugaugugcccgacuacgcuucccugcgcucucucguugccagcuccgggacccuggaauuuaacaaugagagcuucaacuggacgggagugacccaaaauggcacaucuuccgcuugcaucagacggagcagcuccagcuuuuucucucgccuuaacuggcugacccaucucaauuauacauacccugcccugaacgucaccaugcccaauaacgagcaguuugauaaacuuuauauuuggggcgugcaccauccugggacggacaaggaucagaucuuccuguacgcgcaguccagcggaagaauuacaguuuccaccaagcggucucaacaggccgugaucccgaacaucggcagccgcccccggauuagagacaucccuucccgcauuagcaucuacuggacaauugucaagcccggggacauccuccugaucaauucuaccggaaaccugauugcuccuagaggcuauuuuaaaauccgguccgggaagucuucuauuaugcgcagcgaugcccccaucggaaaauguaaguccgaaugcauuaccccgaauggcucuaucccuaacgacaagcccuuccagaaugugaacagaaucacauacggcgcuuguccucgguaugugaaacacagcacgcucaagcuggccaccgggaugcgcaauguccccgagaaacagacaagaggaauuuuuggcgcgaucgccggguucauugaaaacggaugggagggcaugguugaugggugguacggauuucggcaccaaaauuccgagggcagaggccaggcugccgaccuuaagagcacccaggcugccaucgaucaaauuaacgggaaacugaaucgccucaucggaaagacaaacgaaaaauuccaucagauugagaaggaguucucugaaguggaaggccggauccaggaccuggagaaguauguggaggauaccaaaaucgaccuuugguccuacaaugccgaacugcucgucgcucuggagaaccagcacacgauugaucugacagacagcgaaaugaauaagcucuuugagaaaaccaagaaacaacugagagaaaacgcggaggauauggggaacggaugcuucaagaucuaucauaagugugacaaugccugcauuggcucuauccgcaacgggaccuacgaccacaauguguaccgggaugaggcucuuaacaauagauuucagauuaaaggcguugaacugaaguccggauauaaagacuggauccucuggaucagcuucgccauuuccugcuuucugcuuuguguggcccugcucggcuucaucaugugggcuugccagaaggggaacauucgcuguaauaucugcauuuga

SEQ ID NO: 196673 - RNA, 1701 nt, Artificial Sequence; identical to SEQ ID NO: 196071
  derived and/or modified sequence opt5 from hemagglutinin__InfluenzaA__ALN39704

SEQ ID NO: 196674 - RNA, 1701 nt, Artificial Sequence; identical to SEQ ID NO: 195465
  derived and/or modified sequence opt5 from hemagglutinin__InfluenzaA__ALN39705

SEQ ID NO: 196675 - RNA, 1701 nt, Artificial Sequence
  derived and/or modified sequence opt5 from hemagglutinin__InfluenzaA__ALN39706
augaagaccaucauugcccugagcuacauccucugccugguguucgcucagaaacuucccggcaacgacaauuccacagccacgcugugucucgggcaccaugcggucccuaacggaaugauuguuaagaccaucacaaaugauagaauugaggugaccaacgcuacagaacuggugcaaaauucuagcaucggcgagaucugcgacuccccgcaccagauucuugaugggaaaaacuguacccugaucgacgcccuccugggagauccccagugcgacgauuuucagaauaagcggugggaccuguucgucgaacgcucuaaagccuauagcaacuguuacccuuaugaugugcccgacuacgcuucccucagaucucugguugccagcuccggcacacuugaguuuaaugaugaauccuucaacugggcuggggugacccaaaauggaacgucuuccgccugcauucggggcagcaacucuuccuuuuucagccgccugaauuggcucacccauucuaacuuuaaguauccugcgcugaaugucacaaugcccaacaacgagcaguucgacaaacuuuacaucuggggcgugcaccauccugggaccgauaaagaccagauuuuucuguaugcccaguccagcggaagaaucacaguuuccaccaagcggucucaacaggcugugauuccgaauaucggcagccgccccagaauccggaacauuccuucccgcaucagcauuuacuggacgaucgucaaacccggggacauucuccugaucaauucuacaggaaaccugaucgccccuagaggcuacuucaagauucaguccgggaaaagcucuaucaugcggagcgaugcucccauuggaaaguguaaguccgagugcaucaccccgaauggcucuauuccuaacgacaaacccuuucagaaugugaaccgcaucacauauggcgccuguccuagauacgugaagcaaagcacccucaaacuggcgaccgggaugcggaauguccccgaaaagcagacacgcggaaucuucggcgccauugcuggguuuaucgagaacggaugggaaggcaugaaagaugggugguauggauucagacaccagaauagcgagggccggggccaagccgcugaccuuaagagcacgcaggccgccauugaucagaucaacgggaaacugaauagacucauuggaaagaccaacgagaaguuccaccagaucgaaaaagaguuuucugaaguugagggccgcauucaagaccuggaaaaguacguggaggauacaaaaaucgaccuuugguccuauaaugcugagcugcucguggcgcuggaaaaccagcauaccaucgaucugacagacagcgagaugaacaaacucuucgaaaagaccaagaagcagcugcgggagaaugccgaagauauggggaacggaugcuuuaagauuuaccacaagugugacaaugcuugcaucggcucuauuagaaacgggacguaugaccaugaugucuaccgcgacgaggcccuuaauaaccgguuccagaucaaaggcguggagcugaaguccggauacaaagauuggauucucuggaucagcuuugccaucuccugcuuccugcuuuguguugcucugcucggcuuuauuaugugggccugccaaaaggggaauaucagauguaacauuugcaucuga

SEQ ID NO: 196676 - RNA, 1701 nt, Artificial Sequence; identical to SEQ ID NO: 195465
  derived and/or modified sequence opt5 from hemagglutinin__InfluenzaA__ALN39707

SEQ ID NO: 196677 - RNA, 1701 nt, Artificial Sequence; identical to SEQ ID NO: 196071
  derived and/or modified sequence opt5 from hemagglutinin__InfluenzaA__ALN39708

SEQ ID NO: 196678 - RNA, 1701 nt, Artificial Sequence
  derived and/or modified sequence opt5 from hemagglutinin__InfluenzaA__ALN39709
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccagcugcaugagaggcucuaauuccagcuuuuucucucggcugaacuggcucacacaucuuaauuccaaguauccugcccugaacgucaccaugcccaacaaugagcaguuugacaagcuguacauuuggggagugcaccauccugggacagauaaagaccagaucuuccucuaugcgcagagcuccggccgcauuaccguuucuacgaagagaagccaacaggccgugacaccgaacaucgggucccggccccgcauuagagauaucccuagccggaucucuauuuacuggaccaucgucaaacccggagacauucugcugaucaauuccacaggcaaccucauugcuccucgcggguacuuuaagaucagaagcggaaaaucuagcaucaugcgguccgacgcccccauuggcaaguguaagucugaaugcaucaccccgaauggcagcauuccuaacgauaaacccuuccagaaugugaaccgcaucaccuauggggcuuguccuagauacgugaagcaguccacacugaaacuugccacgggaaugcggaauguccccgagcgccaaaccagaggcauuuuuggggcgaucgccggauucaucgaaaacggcugggaggggaugguugacggaugguauggcuuucggcaccagaauagcgagggcagagggcaggcugccgaucugaagucuacacaagcugccauugaccagaucaacggaaaacucaaucgccugauuggcaagaccaacgaaaaauuccaccagaucgagaaggaguucuccgaaguggaagggcggauucaggaucuugagaaguacguggaggacacaaaaaucgaucuguggagcuauaaugccgaacuccuggucgcucuggagaaccaacauaccauugaccucacggauucugaaaugaacaagcuguuugagaaaacaaagaaacagcuuagagaaaaugcggaggacaugggaaacggcugcuucaagaucuaccacaagugugauaaugccugcaucggguccauucgcaacggcaccuaugaccaugacguguaccgggaugaggcucugaauaacagauuucagaucaaaggaguugaacucaagagcggcuacaaagacuggauucuguggaucuccuucgccauuucuugcuuucuucuguguguggcccuccugggguucaucaugugggcuugccagaagggaaauauccgcuguaacauuugcaucuga

SEQ ID NO: 196679 - RNA, 1701 nt, Artificial Sequence; identical to SEQ ID NO: 196395
  derived and/or modified sequence opt5 from hemagglutinin__InfluenzaA__ALN39710

SEQ ID NO: 196680 - RNA, 1701 nt, Artificial Sequence; identical to SEQ ID NO: 196071
  derived and/or modified sequence opt5 from hemagglutinin__InfluenzaA__ALN39711

SEQ ID NO: 196681 - RNA, 1701 nt, Artificial Sequence; identical to SEQ ID NO: 195465
  derived and/or modified sequence opt5 from hemagglutinin__InfluenzaA__ALN39712

SEQ ID NO: 196682 - RNA, 1701 nt, Artificial Sequence
  derived and/or modified sequence opt5 from hemagglutinin__InfluenzaA__ALN39713
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaggcucuagcuccagcuuuuucucucggcuuaauuggcugacccaucucaacuauacauacccugcccugaaugucaccaugcccaacaacgagcaguuugacaaacuuuauauuuggggagugcaccauccugggacggauaaggaccagaucuuccuguacgcgcaguccagcggccgcauuacaguuuccaccaagagaucucaacaggccgugaucccgaauaucgggagccggccccgcauuagagauaucccuucccggauuagcaucuacuggacaauugucaagcccggagacauccuccugaucaacucuaccggcaaucugauugcuccucgcggguauuuuaaaaucagauccggaaagagcucuauuaugcggagcgacgcccccaucggcaaauguaaguccgaaugcauuaccccgaacggcucuaucccuaaugauaagcccuuccagaacgugaaucgcaucacauacggggcuuguccuagauaugugaaacacagcacgcucaagcuggccaccggaaugcggaacguccccgagaaacagacacgcggcauuuuuggggcgaucgccggauucauugaaaauggcugggaggggaugguugacggaugguacggcuuuagacaccaaaacuccgagggccgggggcaggcugccgaucuuaagagcacccaggcugccaucgaccaaauuaauggaaaacugaacagacucaucggcaagacaaaugaaaaauuccaucagauugagaaggaguucucugaaguggaagggcgcauccaggaucuggagaaguauguggaggacaccaaaaucgaucuuugguccuacaacgccgaacugcucgucgcucuggagaaucagcacacgauugaccugacagauagcgaaaugaacaagcucuuugagaaaaccaagaaacaacugcgggaaaacgcggaggacaugggaaauggcugcuucaagaucuaucauaagugugauaacgccugcauugggucuaucagaaauggcaccuacgaccacaacguguaccgcgacgaggcucuuaauaaccgguuucagauuaaaggaguugaacugaaguccggcuauaaagauuggauccucuggaucagcuucgccauuuccugcuuucugcuuuguguggcccugcucggguucaucaugugggcuugccagaagggaaauauuagauguaacaucugcauuuga

SEQ ID NO: 196683 - RNA, 1701 nt, Artificial Sequence
  derived and/or modified sequence opt5 from hemagglutinin__InfluenzaA__ALN39714
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauugggcuggagugacgcaaaacggcaccucuuccagcugcaucagaggcucuaauuccagcuuuuucucucggcuuaacuggcugacacaucucaauuccaaguauccugcccugaacgucaccaugcccaacaaugagcaguuugacaaacuuuacauuuggggagugcaccauccugggacagauaaggaccagaccuuccuguaugcgcagccgagcggccgcaucacgguuuccacaaagagaucucaacaggccgugauucccaacaucgggagccggccucgcaucagagauauucccucccggaucagcauuuacuggaccaucgucaaaccuggagacauucuccugaucaauucuacaggcaaccugaucgcuccccgcggguacuuuaagauuagauccggaaaaagcucuaucaugcggagcgacgccccgauuggcaaguguaaguccgaaugcaucaccccuaauggcucuauucccaacgauaaaccuuuccagaaugugaaccgcaucaccuauggggcuugucccagauacgugaagcagagcacacucaaacuggccacgggaaugcggaauguccccgagcgccaaaccagaggcaucuuuggggcgauugccggauucaucgaaaacggcugggaggggaugguugacggaugguauggcuuucggcaccaaaauuccgagggcagagggcaggcugccgaucuuaagagcacacaggcugccauugaccagaucaacggaaaacugaaucgccucauuggcaagaccaacgaaaaauuccaccagaucgagaaggaguucucugaaguggaagggcggauucaggaucuggagaaguacguggaggacacaaaaaucgaucuuugguccuauaaugccgaacugcucgucgcucuggagaaccaacauaccaucgaccugacggauagcgaaaugaacaagcucuuugagaaaacaaagaaacagcugagagaaaaugcggaggacaugggaaacggcugcuucaagauuuaccacaagugugauaaugccugcaucgggucuauucgcaacggcaccuaugaccaugacguguaccgggaugaggcucuuaauaacagauuucagaucaaaggaguugaacugaaguccggcuacaaagacuggauucucuggaucagcuucgccaucuccugcuuucugcuuuguguggcccugcucggguucauuaugugggcuugccagaagggaaauauccgcuguaacauuugcaucuga

SEQ ID NO: 196684 - RNA, 1701 nt, Artificial Sequence; identical to SEQ ID NO: 196123
  derived and/or modified sequence opt5 from hemagglutinin__InfluenzaA__ALN39715

SEQ ID NO: 196685 - RNA, 1701 nt, Artificial Sequence; identical to SEQ ID NO: 195465
  derived and/or modified sequence opt5 from hemagglutinin__InfluenzaA__ALN39716

SEQ ID NO: 196686 - RNA, 1701 nt, Artificial Sequence; identical to SEQ ID NO: 195465
  derived and/or modified sequence opt5 from hemagglutinin__InfluenzaA__ALN39717

SEQ ID NO: 196687 - RNA, 1701 nt, Artificial Sequence; identical to SEQ ID NO: 196503
  derived and/or modified sequence opt5 from hemagglutinin__InfluenzaA__ALN39718

SEQ ID NO: 196688 - RNA, 1701 nt, Artificial Sequence; identical to SEQ ID NO: 195465
  derived and/or modified sequence opt5 from hemagglutinin__InfluenzaA__ALN39734

SEQ ID NO: 196689 - RNA, 1701 nt, Artificial Sequence
  derived and/or modified sequence opt5 from hemagglutinin__InfluenzaA__ALN39735
augaagaccaucauugcccugagcuacauccucugccugguguucgcucagaaaauucccggcaacgacaauuccacagccacgcuuugucuggggcaccaugcggucccuaacggaaccaucguuaagacaauuaccgaugacagaaucgaggugacaaaugcuaccgaacucgugcaaaacucuagcaucggcgagauuugcgauuccccgcaccagauccuggacggggaaaauuguacacuuauugaugcccugcucggagacccccagugcgauggcuuucagaacaaaaagugggaccuguucgucgagcggucuaaagccuauagcaauuguuacccuuaugaugugcccgacuacgcuucccugcgcucucucguugccagcuccgggacccuggaauuuaacaaugagagcuucaacuggacgggagugacccaaaauggcacaucuuccgcuugcaucagacggagcagcuccagcuuuuucucucgccuuaacuggcugacccaucucaauuauacauacccugcccugaacgucaccaugcccaauaacgagcaguuugauaaacuuuauauuuggggcgugcaccauccugggacggacaaggaucagaucuuccuguacgcgcaguccagcggaagaauuacaguuuccaccaagcggucucaacaggccgugaucccgaacaucggcagccgcccccggauuagagacaucccuucccgcauuagcaucuacuggacaauugucaagcccggggacauccuccugaucaauucuaccggaaaccugauugcuccuagaggcuauuuuaaaauccgguccgggaagucuucuauuaugcgcagcgaugcccccaucggaaaauguaaguccgaaugcauuaccccgaauggcucuaucccuaacgacaagcccuuccagaaugugaacagaaucacauacggcgcuuguccucgguaugugaaacacagcacgcucaagcuggccaccgggaugcgcaauguccccgagaaacagacaagaggaauuuuuggcgcgaucgccggguucauugaaaacggaugggagggcaugguugaugggugguacggauuucggcaccaaaauuccgagggcagaggccaggcugccgaccuuaagagcacccaggcugccaucgaucaaauuaacgggaaacugaaucgccucaucggaaagacaaacgaaaaauuccaucagauugagaaggaguucucugaaguggaaggccggauccaggaccuggagaaguauguggaggauaccaaaaucgaccuuugguccuacaaugccgaacugcucgucgcucuggagaaccagcacacgauugaucugacagacagcgaaaugaauaagcucuuugagaaaaccaagaaacaacugagagaaaacgcggaggauauggggaacggaugcuucaagaucuaucauaagugugacaaugccugcauuggcucuauccgcaacgggaccuacgaccacaauguguaccgggaugaggcucuuaacaauagauuucagauuaaaggcguugaacugaaguccggauauaaagacuggauccucuggaucagcuucgccauuuccugcuuucugcuuuguguggcccugcucggcuucaucaugugggcuugccagaaggggaacauucgcuguaauaucugcauuuga

SEQ ID NO: 196690 - RNA, 1701 nt, Artificial Sequence
  derived and/or modified sequence opt5 from hemagglutinin__InfluenzaA__ALN39736
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauacauacccugcccugaaugucaccaugcccaacaacgagcaguuugacaagcuguauauuuggggcgugcaccauccugggacggauaaggaccagaucuuccuguacgcgcagccguccggaagaauuacaguuagcaccaaacggucccaacaggccgugauccccaauaucggcucucgcccucggauucgggauauccccagccgcauuuccaucuacuggacaauugucaagccuggggacauccuccugaucaacagcaccggaaaucugauugcucccagaggcuauuuuaaaaucagagggggaaagucuuccauuaugcgcagcgacgccccgaucggcaaauguaagucugaaugcauuaccccuaacggcagcauccccaaugauaagccuuuccagaacgugaauagaaucacauacggggcuuguccccgguaugugaaacacuccacgcucaagcuggccaccggaaugcgcaacguccccgagaaacagacaagaggcauuuuuggggcgaucgccggauucauugaaaauggcugggaggggaugguugacggaugguacggcuuucggcaccaaaacucugagggcagagggcaggcugccgaucuuaagagcacccaggcugccaucgaccaaauuaauggaaaacugaaccgccucaucggcaagacaaaugaaaaauuccaucagauugagaaggaguucuccgaaguggaagggcggauccagaaccuggagaaguauguggaggauaccaaaaucgaccuuuggagcuacaaugccgaacugcucgucgcucuggagaaccagcacacgauugaucugacagacucugaaaugaacaagcucuuugagaaaaccaagaaacaacugagagaaaaugcggaggauaugggaaacggcugcuucaagaucuaucauaagugugacaaugccugcauuggguccauccgcaacggcaccuacgaucacaauguguaccgggacgaggcucuuaacaauagauuucagauuaaaggaguugaacuuaagagcggcuauaaagacuggauccucuggaucucuuucgccauuuccugcuuucugcuuuguguggcccugcucggguucaucaugugggcuugccagaagggaaacauucgcuguaauaucugcauuuga

SEQ ID NO: 196691 - RNA, 1701 nt, Artificial Sequence; identical to SEQ ID NO: 196071
  derived and/or modified sequence opt5 from hemagglutinin__InfluenzaA__ALN39737

SEQ ID NO: 196692 - RNA, 1701 nt, Artificial Sequence
  derived and/or modified sequence opt5 from hemagglutinin__InfluenzaA__ALN39738
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccugugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccagaacggcacaucuuccgcuugcaucagacggagcagcuccagcuuuuucucucgccugaauuggcucacccaucugaacuauacauacccugcccuuaaugucaccaugcccaacaacgagcaauuugacaagcuguauauuuggggcgugcaccauccugggacggauaaggaccagaucuuccucuacgcgcaguccagcggaagaauuacaguuuccaccaaacggucucagcaagccgugaucccgaauaucggcagccgcccccggauuagagauaucccuucccgcauuagcaucuacuggacaauugucaagcccggggacauccugcugaucaacucuaccggaaaucucauugcuccuagaggcuauuuuaaaauccgguccgggaagucuucuauuaugcgcagcgacgcccccaucggaaaauguaaguccgaaugcauuaccccgaacggcucuaucccuaaugauaagcccuuccagaacgugaauagaaucacauacggcgcuuguccucgguaugugaaacacagcacgcugaagcuggccaccgggaugcgcaacguccccgagaaacagacaagaggaauuuuuggcgcgaucgccggguucauugaaaauggaugggagggcaugguugacgggugguacggauuucggcaccagaacuccgagggcagaggccaagcugccgaucuuaagagcacccaggcugccaucgaccagauuaaugggaaacucaaccgccugaucggaaagacaaaugaaaaauuccaucaaauugagaaggaguucucugaaguggaaggccggauccaggaucuugagaaguauguggaggacaccaaaaucgaucugugguccuacaacgccgaacuccuggucgcucuggagaaucagcacacgauugaccucacagauagcgaaaugaacaagcuguuugagaaaaccaagaaacagcuuagagaaaacgcggaggacauggggaauggaugcuucaagaucuaucauaagugugauaacgccugcauuggcucuauccgcaaugggaccuacgaccacaacguguaccgggacgaggcucugaauaacagauuucaaauuaaaggcguugaacucaaguccggauauaaagauuggauccuguggaucagcuucgccauuuccugcuuucuucuguguguggcccuccugggcuucaucaugugggcuugccagaaggggaauauucgcuguaacaucugcauuuga

SEQ ID NO: 196693 - RNA, 1701 nt, Artificial Sequence
  derived and/or modified sequence opt5 from hemagglutinin__InfluenzaA__ALN39739
augaagaccaucauugcccugggcuacauccucugccugguguucgcucagaaaauucccgggaacgacaauagcacagccacgcuuugucugggacaccaugcggucccuaacggcaccaucguuaagacaauuaccaaugauagaaucgaggugacaaacgcuaccgaacucgugcaaaauuccucuaucggggagauuugcgacagcccgcacaaaauccuggauggagaaaacuguacacuuauugacgcccugcucggcgauccccagugcgacggguuucagaauaagaaaugggaucuguucgucgagcgguccaaggccuauucuaacuguuacccuuaugacgugcccgauuacgcuagccugcgcucccucguugccucuagcggaacccuggaauuuaauaacgaguccuucaauuggacgggcgugacccagaacggcacaagcucugcuugcaucagacgguccucuagcuccuuuuucagccgccuuaauuggcugacccaucucgacuauacauacccugcccugaacgucaccaugcccaauaacgagcaauuugauaaacuuuauauuuggggagugcaccauccugggacggacaaggaucagaucuuccuguacgcgcagucuuccggcagaauuacaguuagcaccaagcggucccagcaagccgugaucccgaacaucgggucucgcccccggauuagagacaucccuagccgcauuuccaucuacuggacaauugucaaacccggagacauccuccugaucaauagcaccggcaaccugauugcuccuagaggguauuuuaagauccggucuggaaaauccagcauuaugcgcucugaugcccccaucggcaaguguaagagcgaaugcauuaccccgaauggcuccaucccuaacgacaaacccuuccagaaugugaacagaaucacauacggggcuuguccucgguaugugaagcacucuacgcucaaacuggccaccggaaugcgcaauguccccgagaagcagacaagaggcauuuuuggggcgaucgccggauucauugaaaacggcugggaggggaugguugauggaugguacggcuuucggcaccagaauagcgagggcagagggcaagcugccgaccuuaaauccacccaggcugccaucgaucagauuaacggaaagcugaaucgccucaucggcaaaacaaacgaaaaguuccaucaaauugagaaggaguucagcgaaguggaagggcggauccaggaccuggagaaauauguggaggauaccaagaucgaccuuuggucuuacaaugccgaacugcucgucgcucuggagaaccagcacacgauugaucugacagacuccgaaaugaauaaacucuuugagaagaccaaaaagcagcugagagaaaacgcggaggauaugggaaacggcugcuucaagaucuaucauaaaugugacaaugccugcauugggagcauccgcaacggcaccuacgaccacaauguguaccgggaugaggcucuuaacaauagauuucaaauuaagggaguugaacugaaaucuggcuauaaggacuggauccucuggaucuccuucgccauuagcugcuuucugcuuuguguggcccugcucggguucaucaugugggcuugccagaaaggaaacauucgcuguaauaucugcauuuga

SEQ ID NO: 196694 - RNA, 1701 nt, Artificial Sequence
  derived and/or modified sequence opt5 from hemagglutinin__InfluenzaA__ALN39740
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaaagucuagcuccagcuuuuucucucggcuuaauuggcugacccaucucaacuauacauacccugcccugaaugucaccgugcccaacaacgagcaguuugacaaacuuuauauuuggggcguucaccauccugggacggauaaggaccagaucuuccuguacgcgcgcuccagcggaagaauuacaguguccaccaagcggucucagcaagccgucaucccgaauaucggcuaccgcccccggauuagagauaucccuagccgcauuuccaucuauuggacaauugugaaacccggggacauccuccugaucaacagcaccggaaaucugauugcuccuagaggcuacuuuaagauccggucugggaaauccagcauuaugcgcucugacgcccccaucggaaaguguaagagcgaaugcauuaccccgaacggcuccaucccuaaugauaaacccuuccagaacgugaauagaaucacauauggcgcuuguccucgguacgucaagcacucuacgcucaaacuggccaccgggaugcgcaacguucccgagaagcagacaagaggaauuuuuggcgcgaucgccggguucauugaaaauggaugggagggcaugguggacgggugguauggauuucggcaccagaacagcgagggcagaggccaagcugccgaucuuaaauccacccaggcugccaucgaccagauuaaugggaagcugaaccgccucaucggaaaaacaaaugaaaaguuccaucaaauugagaaggaguucagcgaaguggaaggccggauccaggaucuggagaaauacgucgaggacaccaagaucgaucuuuggucuuauaacgccgaacugcucguggcucuggagaaucagcacacgauugaccugacagauuccgaaaugaacaaacucuuugagaagaccaaaaagcagcugagagaaaacgcggaggacauggggaauggaugcuucaagaucuaccauaaaugugauaacgccugcauuggcagcauccgcaaugggaccuacgaccacaacguuuaucgggacgaggcucuuaauaacagauuucaaauuaagggcguggaacugaaaucuggauacaaggauuggauccucuggaucuccuucgccauuagcugcuuucugcuuugugucgcccugcucggcuucaucaugugggcuugccagaaagggaauauucgcuguaacaucugcauuuga

SEQ ID NO: 196695 - RNA, 1701 nt, Artificial Sequence; identical to SEQ ID NO: 195465
  derived and/or modified sequence opt5 from hemagglutinin__InfluenzaA__ALN39741

SEQ ID NO: 196696 - RNA, 1701 nt, Artificial Sequence
  derived and/or modified sequence opt5 from hemagglutinin__InfluenzaA__ALN39742
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggaagaauuacaguuuccaccaagcggucucaacaggccgugaucccgaauaucggcagccgcccccggauuagagauaucccuucccgcauuagcaucuacuggacaauugucaagcccggggacauccuccugaucaacucuaccggaaaucugauugcuccuagaggcuauuuuaaaauccgguccgggaagucuucuauuaugcgcagcgacgcccccaucggaaaauguaaguccgaaugcauuaccccgaacggcucuaucccuaaugauaagcccuuccagaacgugaauagaaucacauacggcgacuguccucgguaugugaaacacagcacgcucaagcuggcuaccgggaugcgcaacguccccgagaaacagacaagaggaauuuuuggcgccaucgcgggguucauugaaaauggaugggagggcaugguugaugggugguacggauuucggcaccaaaacuccgagggcagaggccaggccgcugaccuuaagagcacccaggccgcuaucgaucaaauuaaugggaaacugaaccgccucaucggaaagacaaaugaaaaauuccaucagauugagaaggaguucucugaaguggaaggccggauccaggaccuggagaaguauguggaggauaccaaaaucgaccuuugguccuacaacgccgaacugcucgucgcccuggagaaucagcacacgauugaucugacagacagcgaaaugaacaagcucuuugagaaaaccaagaaacaacugagagaaaacgcugaggauauggggaauggaugcuucaagaucuaucauaagugugacaacgcgugcauuggcucuauccgcaaugggaccuacgaccacaacguguaccgggaugaggcccuuaauaacagauuucagauuaaaggcguugaacugaaguccggauauaaagacuggauccucuggaucagcuucgcuauuuccugcuuucugcuuuguguggcccugcucggcuucaucaugugggccugccagaaggggaauauucgcuguaacaucugcauuuga

SEQ ID NO: 196697 - RNA, 1701 nt, Artificial Sequence
  derived and/or modified sequence opt5 from hemagglutinin__InfluenzaA__ALN39743
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaaagucuagcuccagcuuuuucucucggcuuaauuggcugacccaucucaacuauauuuacccugcccugaaugucacaaugcccaacaacgagcaguuugacaaacuuuauaucuggggcgugcaccauccugggaccgauaaagaccagauuuuccuguacgcgcaguccagcggacgcaucacgguuuccacaaagagaucucaacaggccgugaucccgaauauuggcagccggccccgcaucagagauauuccuucccggaucagcauuuacuggaccaucgucaaacccggggacauccuccugauuaacucuacaggaaaucugaucgcuccucgcggcuauuuuaagauuagauccgggaaaagcucuaucaugcggagcgacgcccccauuggaaaguguaaguccgaaugcaucaccccgaacggcucuaucccuaaugauaaacccuuccagaacgugaaucgcauuaccuacggcgcuuguccuagauaugugaagcacagcacacucaaacuggccacggggaugcggaacguccccgagaagcagacccgcggaaucuuuggcgcgauugccggguucaucgaaaauggaugggagggcaugguugacgggugguacggauuuagacaccaaaacuccgagggccggggccaggcugccgaucuuaaaagcacacaggcugccauugaccaaaucaaugggaagcugaacagacucauuggaaaaaccaaugaaaaguuccaucagaucgagaaggaguucucugaaguggaaggccgcauccaggaucuggagaaauauguggaggacacaaagauugaucuuugguccuacaacgccgaacugcucgucgcucuggagaaucagcacaccaucgaccugacggauagcgaaaugaacaaacucuuugagaagacaaagaagcaacugcgggaaaacgcggaggacauggggaauggaugcuucaagauuuaucauaaaugugauaacgccugcaucggcucuauuagaaaugggaccuacgaccacaacguguaccgcgacgaggcucuuaauaaccgguuucagaucaagggcguugaacugaaauccggauauaaggauuggauccucuggauuagcuucgccaucuccugcuuucugcuuuguguggcccugcucggcuucauuaugugggcuugccagaaagggaauaucagauguaacauuugcaucuga

SEQ ID NO: 196698 - RNA, 1701 nt, Artificial Sequence
  derived and/or modified sequence opt5 from hemagglutinin__InfluenzaA__ALN39744
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaaagucuagcuccagcuuuuucucucggcuuaauuggcugacccaucucaacuauacauacccugcccugaaugucaccaugcccaacaacgagcaguuugacaaacuuuauauuuggggcgugcaccauccugggacggauaaggaccagaucuuccuguacgcgcaguccagcggacgcauuacaguuuccaccaagagaucucaacaggccgugaucccgaauaucggcagccggccccgcauuagagauaucccuucccggauuagcaucuacuggacaauugucaaacccggggacauccuccugaucaacucuaccggaaaucugauugcuccucgcggcuauuuuaagaucagauccgggaaaagcucuauuaugcggagcgacgcccccaucggaaaguguaaguccgaaugcauuaccccgaacggcucuaucccuaaugauaaacccuuccagaacgugaaucgcaucacauacggcgcuuguccuagauaugugaagcacagcacgcucaaacuggccaccgggaugcggaacguccccgagaagcagacacgcggaauuuuuggcgcgaucgccggguucauugaaaauggaugggagggcaugguugacgggugguacggauuuagacaccaaaacuccgagggccggggccaggcugccgaucuuaaaagcacccaggcugccaucgaccaaauuaaugggaagcugaacagacucaucggaaaaacaaaugaaaaguuccaucagauugagaaggaguucucugaaguggaaggccgcauccaggaucuggagaaauauguggaggacaccaagaucgaucuuugguccuacaacgccgaacugcucgucgcucuggagaaucagcacacgauugaccugacagauagcgaaaugaacaaacucuuugagaagaccaaaaagcaacugcgggaaaacgcggaggacauggggaauggaugcuucaagaucuaucauaaaugugauaacgccugcauuggcucuaucagaaaugggaccuacgaccacaacguguaccgcgacgaggcucuuaauaaccgguuucagauuaagggcguugaacugaaauccggauauaaggauuggauccucuggaucagcuucgccauuuccugcuuucugcuuuguguggcccugcucggcuucaucaugugggcuugccagaaagggaauauuagauguaacaucugcauuuga

SEQ ID NO: 196699 - RNA, 1701 nt, Artificial Sequence
  derived and/or modified sequence opt5 from hemagglutinin__InfluenzaA__ALN39745
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaaagagcagcuccagcuuuuucucucggcuuaauuggcugacccaucucaacuauaaguacccugcccugaaugucacaaugcccaacaacgagcaguuugacaaacuuuauauuuggggcgugcaccauccugggaccgauaaggaccagaucuuccuguacgcgcaguccagcggacgcauuacgguuuccacaaaaagaucucaacaggccgugaucccgaauaucggcagccggccccgcauuagagauaucccuucccggauuagcaucuacuggaccauugucaagcccggggacauccuccugaucaacucuacaggaaaucugauugcuccucgcggcuauuuuaaaaucagauccgggaagucuucuauuaugcggagcgacgcccccaucggaaaguguaaauccgaaugcauuaccccgaacggcucuaucccuaaugauaagcccuuccagaacgugaaucgcaucaccuacggcgcuuguccuagauaugugaaacacagcacacucaagcuggccacggggaugcggaacguccccgagaaacagacccgcggaauuuuuggcgcgaucgccggguucauugaaaauggaugggagggcaugguugacgggugguacggauuuagacaccaaaacuccgagggccggggccaggcugccgaucuuaagagcacacaggcugccaucgaccaaauuaaugggaaacugaacagacucaucggaaagaccaaugaaaaguuccaucagauugagaaagaguucucugaaguggaaggccgcauccaggaucuggagaaguauguggaggacacaaaaaucgaucuuugguccuacaacgccgaacugcucgucgcucuggagaaucagcacaccauugaccugacggauagcgaaaugaacaagcucuuugagaaaacaaagaagcaacugcgggaaaacgcggaggacauggggaauggaugcuucaaaaucuaucauaagugugauaacgccugcauuggcucuaucagaaaugggaccuacgaccacaacguguaccgcgacgaggcucuuaauaaccgguuucagauuaaaggcguugaacugaaguccggauauaaagauuggauccucuggaucagcuucgccauuuccugcuuucugcuuuguguggcccugcucggcuucaucaugugggcuugccagaaggggaauauuagauguaacaucugcauuuga

SEQ ID NO: 196700 - RNA, 1701 nt, Artificial Sequence; identical to SEQ ID NO: 196698
  derived and/or modified sequence opt5 from hemagglutinin__InfluenzaA__ALN39746

SEQ ID NO: 196701 - RNA, 1701 nt, Artificial Sequence; identical to SEQ ID NO: 196393
  derived and/or modified sequence opt5 from hemagglutinin__InfluenzaA__ALN39747

SEQ ID NO: 196702 - RNA, 1701 nt, Artificial Sequence
  derived and/or modified sequence opt5 from hemagglutinin__InfluenzaA__ALN39748
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcagcuccagcuuuuucucucgccuuaauuggcugacccaucucaacuaugccuacccugcgcugaaugucacaaugcccaacaacgagcaguuugacaagcuguauauuuggggcgugcaccauccugggaccgauaaggaccagaucuuccuguacgcccaguccagcggaagaauuacgguuuccacaaaacggucucaacaggcugugaucccgaauaucggcagccgcccccggauuagagauaucccuucccgcauuagcaucuacuggaccauugucaagcccggggacauccuccugaucaacucuacaggaaaucugauugccccuagaggcuauuuuaaaauccucuccgggaagucuucuauuaugcggagcgacgcucccaucggaaaauguaaguccgaaugcauuaccccgaacggcucuaucccuaaugauaagcccuuccagaacgugaaucgcaucaccuacggcgccuguccuagauaugugaaacacagcacacugaaacuugcgacggggaugcggaacguccccgagaagcagacccgcggaauuuuuggcgccaucgcuggguucauugaaaauggaugggagggcaugguugacgggugguacggauuuagacaccaaaacuccgagggccggggccaggccgcugaucuuaagagcacacaggccgccaucgaccaaauuaaugggaaacucaacagacugaucggaaagaccaaugaaaaauuccaucagauugagaaggaguucucugaaguggaaggccgcauccaggaucuugagaaguauguggaggacacaaaaaucgaucugugguccuacaacgcugaacuccuggucgcgcuggagaaucagcacaccauugaccucacggauagcgaaaugaacaagcuguuugagaaaacaaagaaacaacuucgggaaaacgccgaggacauggggaauggaugcuucaagaucuaucauaagugugauaacgcuugcauuggcucuaucagaaaugggaccuacgaccacaacguguaccgcgacgaggcccugaauaaccgguuucagauuaaaggcguugaacucaaguccggauauaaagauuggauccuguggaucagcuucgccauuuccugcuuucuucuguguguggcucuccugggcuucaucaugugggccugccagaaggggaauauuagauguaacaucugcauuuga

SEQ ID NO: 196703 - RNA, 1701 nt, Artificial Sequence
  derived and/or modified sequence opt5 from hemagglutinin__InfluenzaA__ALN39749
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcaacuccccgcaccagauucuugacggggaaaauuguacacugaucgaugcccuccugggagacccccagugcgauggcuuucagaacaaaaagugggaccuguucgucgagcggucuaaagccuauagcaauuguuacccuuaugaugugcccgacuacgcuucccuccgcucucugguugccagcuccgggacccuugaauuuaacaaugagagcuucaacugggcuggagugacgcaaaauggcaccucuuccagcugcauuagaggcucuaacuccagcuuuuucucucggcugaauuggcucacacaucugaacuccaaguauccugcccuuaacgucaccaugcccaauaacgagcaguuugauaagcuguacaucuggggagugcaccauccugggacagacaaagaucagauuuuccucuaugcgcagccgagcggccgcaucaccguuuccacgaagagaucucaacaggccgugauucccaauaucgggagccggccucgcaucagagacauucccucccggaucagcauuuacuggacaaucgucaaaccuggagauauucugcugaucaacucuaccggcaaucucaucgcuccccgcggguacuuuaagauuagauccggaaaaagcucuaucaugcggagcgacgccccgauuggcaaguguaaguccgaaugcaucacaccuaacggcucuauucccaaugacaaaccuuuccagaacgugaaucgcaucaccuauggggcuugucccagauacgugaagcagagcacccugaaacuugccacaggaaugcggaacguccccgagcgccaaacgagaggcaucuuuggggcgauugccggauucaucgaaaauggcugggaggggaugguugauggaugguauggcuuucggcaccagaacuccgagggcagagggcaggcugccgaccucaagagcacccaagcugccauugaucagaucaauggaaaacugaaccgccugauuggcaagacaaaugaaaaauuccaccagaucgagaaggaguucucugaaguggaagggcggauucaggaccuugagaaguacguggaggauaccaaaaucgaccugugguccuauaacgccgaacuccuggucgcucuggagaaccaacauacaaucgaucucaccgacagcgaaaugaauaagcuguuugagaaaacgaagaaacagcuuagagaaaacgcggaggauaugggaaauggcugcuucaagauuuaccacaagugugacaacgccugcaucgggucuauucgcaauggcacauaugaucaugacguguaccgggacgaggcucugaacaauagauuucagaucaaaggaguugaacucaaguccggcuacaaagauuggauucuguggaucagcuucgccaucuccugcuuucuucuguguguggcccuccugggguucauuaugugggcuugccagaagggaaacauccgcuguaauauuugcaucuga

SEQ ID NO: 196704 - RNA, 1701 nt, Artificial Sequence; identical to SEQ ID NO: 195465
  derived and/or modified sequence opt5 from hemagglutinin__InfluenzaA__ALN39750

SEQ ID NO: 196705 - RNA, 1701 nt, Artificial Sequence; identical to SEQ ID NO: 195465
  derived and/or modified sequence opt5 from hemagglutinin__InfluenzaA__ALN39789

SEQ ID NO: 196706 - RNA, 1701 nt, Artificial Sequence; identical to SEQ ID NO: 195995
  derived and/or modified sequence opt5 from hemagglutinin__InfluenzaA__ALO75895

SEQ ID NO: 196707 - RNA, 1701 nt, Artificial Sequence
  derived and/or modified sequence opt5 from hemagglutinin__InfluenzaA__ALO75907
auggagaagaucgugcugcuccuggccauugucagccuuguuaaaggcgaccagaucugcauuggguaccacgcuaacaauuccaccgaacaaguggauacaaucauggagaagaacgugacggucacccaugcccaggacauucuggaaaagacacacaauggaaagcucugugaucugaacggcgugaaaccccuuauccugaaggacugcucuguugcggggugguuccucggaaauagaaugugugaugaguuuauccgggugccugaauggagcuauauugucgagcgcgcuaacccggccaaugaccugugcuaccccggcaaccugaaugauuaugaggaacucaagcaucugcuuuccagaaucaaccacuucgagaaaacccugauuaucccuaagucuagcuggcccaaucauacauccucuggggugagcgccgcuuguccuuaccagggaaugcccuccuuuuuccggaacguuguguggcucaccaaaaagaaugacgccuauccuacaauuaaaaugagcuacaacaauaccuaucgcgaagaucugcuuauccuguggggcauucaccacucuaacaacgcugccgagcagacgaaucucuacaagaacccgaccacauacgucuccgugggcaccagcacacugaaucaaagacuggagcccaagaucgcgacccggucucaggugaacgggcagcgcggaagaauggacuuuuucuggacgauccucaaaccuaaugaugccauucauuuugaauccaacggcaauuucaucgcucccgaguaugccuacaagauugucaaaaagggggacagcacaaucaugaaaucugaaauggaguauggacacugcaacaccaagugucagacaccuauuggcgcuaucaauuccagcaugcccuuucauaacauccacccgcugaccauuggggaaugcccuaaauacguuaaguccaauaaacuugugcuggccaccggacuccggaacucuccccugcgcgagagacggcgcaaaagaggccuuuucggcgcgaucgccggguuuauugagggaggcuggcaagggaugguggauggaugguauggcuaccaccauagcaaugaacagggguccggauaugcugccgaccgggagagcacacagaaggcuaucgacggcgucacgaacaaaguuaauucuauuaucgauaagaugaacacccaguucgaagccgugggccgcgaguuuaacaaucuggaaagacggaucgagaaccucaauaaaaagauggaggacggguuccuggauguguggacauacaacgccgaacugcucguccugauggagaaugaaagaacccuugacuuccacgauuccaacgugaagaaucuguacgacaaaguucgccuccaacugcgggauaacgcuaaggagcuuggaaauggcuguuuugaguucuaucauaaaugcgacaacgaauguauggagagcgugagaaaugggacauacgauuauccucuguacucugaagaggcgcgccucaagcgggaagagauuagcggagucaaacuggaguccaucggcaccuaucagauucugucuaacuacagcacgguggccuccagccucgcucuggccaucauugucgccgggcuuucucuguggaugugcuccaauggcagccuccagugcagaaucuguauuuga

SEQ ID NO: 196708 - RNA, 1701 nt, Artificial Sequence
  derived and/or modified sequence opt5 from hemagglutinin__InfluenzaA__ALO75919
auggagaagaucgugcugcuccuggccauugucagccuuguuaaaggcgaccagaucugcauuggguaccacgcuaacaauuccaccgaacaaguggauacaaucauggagaagaacgugacggucacccaugcccaggacauucuggaaaagacacacaauggaaagcucugugaucugaacggcgugaaaccccuuauccugaaggacugcucuguugcgggguggcuccauggaaauagaaugugugaugaguucauccgggugccugaauggagcuauauugucgagcgcgcuaacccggccaaugaccugugcuaccccggcaaccugaaugauuaugaggaacucaagcaucugcuuuccagaaucaaccacuuugagaaaacccugauuaucccuaagucuagcuggcccaaucacacauccucuggggugagcgccgcuuguccuuaccagggaaugcccuccuucuuucggaacguuguguggcucaccaaaaagaaugacgccuauccuacaauuaaaaugagcuacaacaauaccuaucgcgaagaucugcuuauccuguggggcauucaccauucuaacaacgcugccgagcagacgaaucucuacaagaacccgaccacauacgucuccgugggcaccagcacacugaaucaaagacuggagcccaagaucgcgacccggucucaggugaacgggcagcgcggaagaauggacuucuuuuggacgauccucaaaccuaaugaugccauucacuucgaauccaacggcaauuuuaucgcucccgaguaugccuacaagauugucaaaaagggggacagcacaaucaugaaaucugaaauggaguauggacauugcaacaccaagugucagacaccuauuggcgcuaucaauuccagcaugcccuuccacaacauccacccgcugaccauuggggaaugcccuaaauacguuaaguccaauaaacuugugcuggccaccggacuccggaacucuccccugcgcgagagacggcgcaaaagaggccuuuuuggcgcgaucgccggguucauugagggaggcuggcaagggaugguggauggaugguauggcuaccaucacagcaaugaacagggguccggauaugcugccgaccgggagagcacacagaaggcuaucgacggcgucacgaacaaaguuaauucuauuaucgauaagaugaacacccaguuugaagccgugggccgcgaguucaacaaucuggaaagacggaucgagaaccucaauaaaaagauggaggacggguuucuggauguguggacauacaacgccgaacugcucguccugauggagaaugaaagaacccuugacuuccaugauuccaacgugaagaaucuguacgacaaaguucgccuccaacugcgggauaacgcuaaggagcuuggaaauggcuguuucgaauuuuaucacaaaugcgacaacgaguguauggagagcgugagaaaugggacauacgauuauccucuguacucugaagaggcgagccucaagcgcgaagagauuuccggagucaaacuggagucuaucggcaccuaucagauucugagcaucuacuccacgguggccagcucucucgcucuggccauuaucgucgccgggcuuucccuguggaugugcagcaacggcucucuccagugccggauuuguaucuga

SEQ ID NO: 196709 - RNA, 1683 nt, Artificial Sequence
  derived and/or modified sequence opt5 from hemagglutinin__InfluenzaA__ALT20080
auggagaccgugagccugaucacaauucuccuggucgccacgguuuccaacgcugacaagaucugcauuggcuaccagucuaccaauagcacagaaaccguggauacacuuaccgagaacaaugugcccgucacacacgccaaagaacugcuccauaccgagcacaacgggaugcugugugcgacgucccuuggacaaccucugauccucgauaccugcacaauugaaggccugaucuaugggaauccgucuugugaccugagccucgagggaagagagugguccuacaucguggaacggcccucugcuguuaacggccugugcuauccugggaauguggagaaccuugaggaacugcgcagccucuucuccagcgccagaucuuaccagcggauucagaucuuucccgacaccauuuggaaugucuccuaugauggaacaagcaccgccuguucuggcuccuucuaccgcagcaugagauggcugacgcggaagaacggcgacuauccuauccaggaugcucaauacacaaauaaccaggggaaaaauauucuuuuuauguggggaaucaaccaucccccuaccgacacaacccagcgcgaucuguacaccagaacagacacgaccacaucuguggccaccgaggaaauuaaucggaucuucaagccgcucaucggcccccgcccucugguuaacgggcugaugggaagaauugauuauuacugguccgugcucaaacccggccagacacugcggaucaagagcgacgggaaccuuauugcuccuugguuuggacacauccuguccggcgagucucauggccgcauucucaagaccaaucugaaaagagggagcugcacgguccaaugucagacagaaaagggaggccuuaacaccacccugcccuuccagaauguguccaaauaugccuuugggaacugcagcaaguacaucggaaucaaaucucucaagcuggcggugggccugcggaaugucccgucccgcagcucuagaggacucuucggggccauugcuggcuuuaucgagggcggguggagcggacugguugccggcugguauggguuccagcacuccaacgaucaaggagugggcauggcugccgaccgggacucuacacagaaggcgauugauaaaaucaccagcaaggugaauaacauugucgacaaaaugaauaagcaguacgaaaucaucgaucacgaguuuuccgagguggaaacaagacuuaacaugauuaauaacaaaaucgacgaucaaauucaggacaucugggccuauaaugcugagcugcucguucugcuugaaaaccagaagacgcuggaugagcaugacgccaaugugaacaaccucuacaauaaagucaagcgcgcucuggggagcaacgccguggaagauggcaagggauguuucgagcuguaccacaaaugcgacgaucaguguauggagaccauucggaauggcacauauaacagacgcaaguaccaagaagagucuaaacucgaacggcagaagaucgaggggguuaaacuggaauccgagggaaccuauaagauucuuacaaucuacagcaccguggccucuucccuggucaucgcuaugggcuuugcggccuuccucuucugggcuaugagcaauggguccugcagaugcaacauuuguaucuga

SEQ ID NO: 196710 - RNA, 1701 nt, Artificial Sequence
  derived and/or modified sequence opt5 from hemagglutinin__InfluenzaA__ALT66860
augaaggccauccuggugguccuccuguacaccuucacaacggcuaacgccgacacccuuugcauuggcuaucacgcgaauaacagcacagauaccguugacacagugcuggagaagaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccaacucugacaaugggaccugcuauccgggcgauuuuauuaacuacgaagaacugcgggagcagcuuagcuccgucagcucuuucgaacgcuuugagaucuuccccaagacauccagcuggccuaaucacgacucuaacaagggagugaccgcugccuguccccaugcuggcgccaaauccuuuuauaagaaucugaucuggcucguuaaaaagggcaacagcuacccuaaacugaaucaaucuuauauuaacgauaaggggaaggaagugcuuguccuguggggaauccaccaccccuccacaaccgcggaccagcagagccucuaccagaacgccgaugcuuacguguucgugggcacguccagauauucuaaaaaguuuaaaccugagauugccacacggccgaagguccgcgaccaagaggggagaaugaauuacuauuggacccugguugaacccggagauaaaaucacauucgaggcuaccggcaaccugguggugccucgguacgccuuuaccauggaacgcaaugcggggagcggaauuaucauuuccgacacacccguccaugauugcaacacgaccugucagacaccugagggcgccaucaauaccagccuccccuuccagaacauccacccgauuacaaucggcaagugcccuaaauaugugaagucuaccaagcugagacuugcuacggggcugcggaauguucccuccauucagagccgcggacucuuuggcgccaucgcuggguucauugaaggaggcuggacagggaugguggacggaugguacggcuaucaucaccaaaacgagcagggcucuggguacgccgccgaccugaaaagcacccagaaugcuaucgauaagaucaccaacaaagucaauuccgugauugagaagaugaacacacaguuuaccgcgguuggaaaagaguucaaucaccuugagaagagaaucgaaaaccugaauaagaaaguggacgauggcuuccucgacauuuggacauacaacgccgagcugcugguccuccuggaaaacgagcggacgcuugauuaucaugacucuaaugugaagaaccuguacgagaaaguccgcaaucaacucaagaacaaugcuaaagaaaucgggaacggauguuuugaguucuaucacaagugcgauaauaccuguauggaaagcgugaagaacggcacauacgacuauccuaaauacuccgaggaagccaagcugaauagagagaaaauugaugggguuaaacuugagagcacccggaucuaucagauccuggccauuuacucuacaguggcuuccagccucguccuggugguuucucugggcgccaucuccuuuuggaugugcagcaacggaucccuccagugccgcauuuguaucuga

SEQ ID NO: 196711 - RNA, 1701 nt, Artificial Sequence
  derived and/or modified sequence opt5 from hemagglutinin__InfluenzaA__AMA65391
augaaggccauccuggugguccuccuguacaccuucacaacggcuaacgccgacacccuuugcauuggcuaucacgcgaauaacagcacagauaccguugacacagugcuggagaagaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccaacucugacaaugggaccugcuauccgggcgauuuuauuaacuacgaagaacugcgggagcagcuuagcuccgucagcucuuucgaacgcuuugagaucuuccccaagacauccagcuggccuaaucacgacucuaacaagggagugaccgcugccuguccccaugcuggcgccaaauccuuuuauaagaaucugaucuggcucguuaaaaagggcaacagcuacccuaaacugaaucaaucuuauauuaacgauaaggggaaggaagugcuuguccuguggggaauccaccaccccuccacaaccgcggaccagcagagccucuaccagaacgccgaugcuuacguguucgugggcacguccagauauucuaaaaaguuuaaaccugagauugccacacggccgaagguccgcgggcaagagggaagaaugaauuacuauuggacccugguugaacccggcgacaaaaucacauucgaggcuaccgggaaccugguggugccucgguacgccuuuaccauggaacgcaaugcgggaagcggcauuaucauuuccgauacacccguccaugacugcaacacgaccugucagacaccugagggcgccaucaauaccagccuccccuuccagaacauccacccgauuacaaucgggaagugcccuaaauaugugaagucuaccaagcugagacuugcuacgggacugcggaauguucccuccauucagagccgcggccucuuuggggccaucgcuggauucauugaaggcggguggacaggaaugguggauggcugguacggcuaucaucaccaaaacgagcaggggucuggauacgccgccgaccugaaaagcacccagaaugcuaucgacaagaucaccaacaaagucaauuccgugauugagaagaugaacacacaguuuaccgcgguuggcaaagaguucaaucaccuugagaagagaaucgaaaaccugaauaagaaaguggaugacggguuccucgauauuuggacauacaacgccgagcugcugguccuccuggaaaacgagcggacgcuugacuaucaugauucuaaugugaagaaccuguacgagaaaguccgcaaucaacucaagaacaaugcuaaagaaaucggaaacggcuguuuugaguucuaucacaagugcgacaauaccuguauggaaagcgugaagaacgggacauacgauuauccuaaauacuccgaggaagccaagcugaauagagagaaaauugacggcguuaaacuugagagcacccggaucuaucagauccuggccauuuacucuacaguggcuuccagccucguccuggugguuuuucugggagccaucucuuucuggaugugcuccaacggcagccuccagugccgcauuuguaucuga

SEQ ID NO: 196712 - RNA, 1701 nt, Artificial Sequence
  derived and/or modified sequence opt5 from hemagglutinin__InfluenzaA__AMA65393
augaaggccauccuggugguccuccuguacaccuucacaacggcuaacgccgacacccuuugcauuggcuaucacgcgaauaacagcacagauaccguugacacagugcuggagaagaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccaacucugacaaugggaccugcuauccgggcgauuuuauuaacuacgaagaacugcgggagcagcuuagcuccgucagcucuuucgaacgcuuugagaucuuccccaagacauccagcuggccuaaucacgacucuaacaagggagugaccgcugccuguccccaugcuggcgccaaauccuuuuauaagaaucugaucuggcucguuaaaaagggcaacagcuacccuaaacugaaucaaucuuauauuaacgauaaggggaaggaagugcuuguccuguggggaauccaccaccccuccacaaccgcggaccagcagagccucuaccagaacgccgaugcuuacguguucgugggcacguccagauauucuaaaaaguuuaaaccugagauugccacacggccgaagguccgcgaccaagaggggagaaugaauuacuauuggacccugguugaacccggagauaaaaucacauucgaggcuaccggcaaccugguggugccucgguacgccuuuaccauggaacgcaaugcggggagcggaauuaucauuuccgacacacccguccaugauugcaacacgaccugucagacaccugagggcgccaucaauaccagccuccccuuccagaacauccacccgauuacaaucggcaagugcccuaaauaugugaagucuaccaagcugagacuugcuacggggcugcggaauguucccuccauucagagccgcggacucuuuggcgccaucgcuggguucauugaaggaggcuggacagggaugguggacggaugguacggcuaucaucaccaaaacgagcagggcucuggguacgccgccgaccugaaaagcacccagaaugcuaucgauaagaucaccaacaaagucaauuccgugauugagaagaugaacacacaguuuaccgcgguuggaaaagaguucaaucaccuugagaagagaaucgaaaaccugaauaagaaaguggacgauggcuuccucgacauuuggacauacaacgccgagcugcugguccuccuggaaaacgagcggacgcuugauuaucaugacucuaaugugaagaaccuguacgagaaaguccgcaaucaacucaagaacaaugcuaaagaaaucgggaacggauguuuugaguucuaucacaagugcgauaauaccuguauggaaagcgugaagaacggcacauacgacuauccuaaauacuccgaggaagccaagcugaauagagagaaaauugaugggguuaaacuugagagcacccggaucuaucagauccuggccauuuacucucccguggcuuccagccucguccuggugguuuuucugggcgccaucucuuucuggaugugcuccaacggaagccuccagugccgcauuuguaucuga

SEQ ID NO: 196713 - RNA, 1701 nt, Artificial Sequence
  derived and/or modified sequence opt5 from hemagglutinin__InfluenzaA__BAA02768
augaaggccaaacugcucgugcugcuuugcgcuuucaccgccacagacgcggauacgaucuguauuggcuaccacgcuaacaauagcaccgacacagucgauaccguucuggagaagaacgugacagugacccauuccgucaaucuccuggaagacucucacaacgggaaacuuugcagacugaagggaaucgccccgcuccagcugggcaauuguagcauugccggguggauccugggaaacccugagugcgaaucccucuuuucuaaagagagcugguccuauauugcugaaacacccaauucugagaacggcaccuguuaccccggguauuucgccgauuacgaggaacugcgggagcaacuuagcuccgugagcucuuuugaacgcuucgagaucuuuccuaaggaguccagcuggcccaaucauacgguuaccaagggagugacagcuucuugcucccacaacggcaaaagcucuuucuauagaaaucugcucuggcugaccggcaagaacgggcuuuacccuaaucuguccaaaagcuaugucaacaauaaggaaaaagaggugcucguucuguggggagugcaucaccccuccaacaucggcgaccagcgggccauuuaccacacagaaaacgcguacgucucuguggugagcucccauuauagccgcagauuuaccccugagaucgccaagcggccgaagguccgcgggcaggaaggaagaauuaauuacuauuggacgcugcucgagcccggcgauacaaucauuuucgaggcuaacgggaaucugaucgccccuugguacgcuuuugcccuuucucggggauucggcuccggcauuaucaccagcaacgcgucuauggacgaaugugaugccaaaugccagacaccccaaggggcuaucaauagcucccugccuuuucagaacguucaccccgugaccauuggagaguguccgaaguaugugcgcucuaccaaacucagaauggucacaggccugcggaauaucccuagcauucagucccgcgggcuuuucggagccaucgcuggcuuuauugaagggggauggacgggcaugaucgacggcugguacggguaucaucaccagaacgagcaaggaagcggcuacgccgccgaucagaagucuacccagaaugcuaucaacgggauuacaaauaaagugaacuccguuaucgaaaagaugaauacccaguucacagcggugggaaaagaguucaacaagcuggagagacggauggaauaccucaauaagaaagucgacgauggcuuucuggacauuuggaccuauaacgccgagcugcucgugcugcuugaaaacgagcgcacgcuggacuuccacgauagcaauguuaagaaccucuacgaaaaagugaagucucaacugaaaaauaacgcuaaggagaucggguauggcugcuuugaguucuaccauaaguguaauaacgaaugcauggaguccgucaaaaauggaacauaugacuaccccaaguauagcgaagaguccaaacuuaacagagagaagauugauggcgugaaacuggaaucuaugggggucuaccagauccucgccaucuacagcaccguggccuccucucugguucugcucgugagccugggagcuauuuccuuuuggaugugcagcaauggcucucuucagugucggaucugcauuuga

SEQ ID NO: 196714 - RNA, 1701 nt, Artificial Sequence
  derived and/or modified sequence opt5 from hemagglutinin__InfluenzaA__BAA02769
augaaggccaaacugcucgugcugcuuugcgcuuucaccgccacagacgcggauacgaucuguauuggcuaccacgcuaacaauagcaccgacacagucgauaccguucuggagaagaacgugacagugacccauuccgucaaucuccuggaagacucucacaacgggaaacuuugcagacugaagggaaucgccccgcuccagcugggcaauuguagcauugccggguggauccugggaaacccugagugcgaaucccucuuuucuaaagagagcugguccuauauugcugaaacacccaauucugagaacggcaccuguuaccccggguauuucgccgauuacgaggaacugcgggagcaacuuagcuccgugagcucuuuugaacgcuucgagaucuuuccuaaggaguccagcuggcccaaucauacgguuaccaagggagugacagcuucuugcucccacaacggcaaaagcucuuucuauagaaaucugcucuggcugaccggcaagaacgggcuuuacccuaaucuguccaaaagcuaugucaacaauaaggaaaaagaggugcucguucuguggggagugcaucaccccuccaacauccgggaccagcgcgccauuuaccacacagaaaacgcguacgucucuguggugagcucccauuauagcagacgguuuaccccugagaucgccaagcgcccgaaggucagagaucaggaaggccggauuaauuacuauuggacgcugcucgagcccggggacacaaucauuuucgaggcuaacggaaaucugaucgccccuugguacgcuuuugcccuuucucgcggcuucggguccggaauuaucaccagcaacgcgucuauggaugaaugugacgccaaaugccagacaccccaaggcgcuaucaauagcucccugccuuuucagaacguucaccccgugaccauuggcgaguguccgaaguaugugagaucuaccaaacuccggauggucaaggggcugcgcaauaucccuagcauucaguccagaggacuuuucggcgccaucgcuggguuuauugaaggaggcuggacagggaugaucgauggaugguacggcuaucaucaccagaacgagcaaggcagcggguacgccgccgaccagaaaucuacgcagaaugcuaucaacggaauuaccaauaaggugaacuccguuaucgaaaagaugaauacacaguucaccgcggugggcaaggaguucaacaagcuggagcggcgcauggaauaccucaauaaaaaggucgaugacggguuucuggacauuuggacauauaacgccgagcugcucgugcugcuugaaaacgagagaacccuggauuuccacgacagcaauguuaaaaaccucuacgaaaaggugaaaucucaacugaagaauaacgcuaaggagaucggauauggcugcuuugaguucuaccauaaauguaauaacgaaugcauggaguccgucaagaaugggacguaugauuaccccaaauauagcgaagaguccaaacuuaaccgggagaaaauugacggcgugaagcuggaaucuaugggagucuaccagauccucgccaucuacagcacaguggccuccucucugguucugcucgugagccugggcgcuauuuccuuuuggaugugcagcaaugggucucuucaguguagaaucugcauuuga

SEQ ID NO: 196715 - RNA, 1689 nt, Artificial Sequence
  derived and/or modified sequence opt5 from hemagglutinin__InfluenzaA__BAC43764
auggccaucauuuaccugauccuccuguucaccgcugugagaggcgaccagauuugcaucggguaucacgccaacaauagcacagagaaggucgauacgauucuugaacggaacguuaccgugacacaugcgaaaaauauccuggagaagacccacaacggaaaacucuguaagcugaauggcauucccccucuugaacugggggacugcuccaucgcuggauggcuccugggcaacccggagugugaucgccugcucaucgugcccgaauggucuuacauuauggagaaagagaauccuagagacgggcugugcuaucccggaucuuuuaacgauuacgaagaacuuaagcaucugcucuccucugucaagcacuucgaaaaagugaagauccugccuaaagaccgguggacacaacauaccacaaccggcggcagccgcgccugugccguuuccgggaaucccagcuuuuucagaaacaugguguggcuuacgaagaaaggaagcaauuauccugucgcuaagggcuccuacaacaauaccagcggggagcagaugcugauuaucuggggagugcaccacccgauugaugagacagaacagaucacccucuaucagaacguuggcacauacgugucugucgggaccuccacgcugaauaagcggagcacacccgagaucgccacccgcccuaaagugaacggacugggcucuagaauggaauuuuccuggacacuccuggacaugugggauaccauuaacuucgagagcaccggcaaucuuaucgcucccgaauacggguuuaagauuucuaaacggggauccagcggcaucaugaagacagaggggacgcuggagaacugcgaaaccaaaugucaaacaccucucggagccauuaauaccacacugcccuuccauaacgugcacccgcuuaccaucggcgagugcccuaaguaugucaaauccgaaaagcugguucucgcgacggggcugcgcaaugugccccagaucgagucuagaggacuguuuggcgccauugcuggcuucaucgaagggggauggcagggcaugguggacgggugguacggauaucaucacagcaacgaucagggcuccggguacgccgcugacaaggagagcacacaaaaagccuuugauggcauuaccaauaaggucaacucugugaucgagaaaaugaauacccaguucgaagcgguuggaaaggaguuuuccaaccucgaacggcgccuggagaaucuuaacaaaaagauggaagacggcuuccuggacguguggacauauaaugccgagcuccugguccuuauggagaacgaaagaacccuggauuuccacgacagcaaugugaagaaccucuacgauaaaguucggaugcagcugcgcgacaacgugaaggagcuggggaauggauguuuugaguucuaucauaaaugcgaugacgaguguaugaacucugucaagaauggcacauacgauuacccuaaauaugaggaagagagcaagcucaacagaaaugaaauuaagggggugaaacuguccucuaugggagucuaccagauccuugcuaucuaugccacgguggcuggcagccugucccucgccauuaugauggccgggaucagcuuuuggaugugcucuaacggcucccugcaauuccggauuugcaucuga

SEQ ID NO: 196716 - RNA, 1707 nt, Artificial Sequence
  derived and/or modified sequence opt5 from hemagglutinin__InfluenzaA__BAE07201
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugaaaagacacacaaugggaagcugugugaucucgacggagugaaaccccugauccuuagagauugcagcguugcgggcuggcugcucgggaacccuaugugugacgaguuuaucaaugugccggaaugguccuauauugucgagaaggcuaaccccgccaaugaucugugcuacccuggagacuucaacgauuaugaggaacugaagcaucuccugucucggaucaaucacuuugagaaaauucagaucauucccaagaacagcugguccucucaugaagccagccuuggcguguccagcgcuuguccuuaccaggggaaaucuuccuucuuucgcaauguuguguggcugaucaagaaaaacaaugccuaucccaccauuaagagaagcuacaacaauacaaaccaagaggaccuccugguccuuuggggaauccaccacccuaacgaugcugccgagcagacccggcuguaucagaauccgacaaccuacaucucugugggcacguccacccucaaccagcgccuggugcccaagauugcgacaagaagcaaagucaauggccaaaacgggcggauggaguucuuuuggaccauccugaagccuaaugacgccauuaacuucgaaucuaauggaaacuuuaucgcucccgaauacgccuauaaaauuguuaagaaaggcgauuccgcuaucaugaaguccgagcucgaauacgggaauugcaacacaaaaugucagaccccuaugggagccaucaauuccucuaugcccuuccauaacauucacccgcugacgaucggcgagugcccuaaguaugugaaaagcaaucgccuugugcuggcgacagggcucagaaacagcccccagcgggagcgcagacggaaaaagcgcggacuguuuggcgccauugcuggcuucaucgaagggggauggcagggcauggucgacgggugguacggauaucaucacagcaaugagcaaggcucuggguacgccgcugacaaagaauccacccagaaggccauugauggagugacaaacaaaguuaacagcaucaucgacaagaugaauacccaguuugaggccgugggcagagaguucaacaaucuugaacggcgcauugagaaccugaauaagaaaauggaagauggcuuccucgacgucuggaccuauaacgcugagcugcuggugcucauggaaaaugagagaacacuggauuuucacgacucuaacguuaagaaucuuuacgauaaagugcggcugcaacucagagacaacgcgaaggaacuggggaauggauguuucgaguuuuaccauaaaugcgauaacgaguguauggaaagcguccgcaauggcacguaugacuacccucaguauuccgaggaagcccggcuuaagagagaggagaucucuggggugaagcuggaaagcauuggaaccuaccagauccucuccauuuauagcacagucgcuucuucccuggcccuggccaucaugguggcuggccucagccuguggaugugcucuaacgggucccuucagugccgcauuuguaucuga

SEQ ID NO: 196717 - RNA, 1701 nt, Artificial Sequence
  derived and/or modified sequence opt5 from hemagglutinin__InfluenzaA__BAH95823
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauauucacccgaucacaauuggcaagugcccuaagcaugugaaaagcacgaagcugagacuugcuaccgggcugcggaacguucccuccauccagucucgcggacucuuuggcgccauugccggguucaucgagggaggcuggacagggaugguggacggaugguauggcuaccaccaccagaaugaacaaggcagcggguaugcugcggaucugaaauccacccagaacgccaucgacgagauuacaaauaaggucaacagcgugaucgagaaaaugaauacccaguuuacggcuguuggaaaggaguucaaccaucuugagaagagaauugaaaaucugaacaaaaagguggaugacggcuuccucgauaucuggacauacaaugccgagcugcugguccuccuggaaaacgagcggacccuugacuaccacgauucuaaugugaaaaaccuguaugagaagguccgcucccagcucaaaaacaaugccaaggaaauugggaacggauguuuugaguucuaccauaagugcgacaauaccuguauggaaagcgugaaaaacggcacauaugauuacccuaaguauucugaggaagcuaaacugaauagagaggagaucgacgggguuaaacuugaauccacccggaucuaccaaauucuggccaucuauagcacaguggcguccucucucguccuggugguuagccugggcgcuauuuccuuuuggaugugcucuaacggaagccuccagugccgcaucuguauuuga

SEQ ID NO: 196718 - RNA, 1701 nt, Artificial Sequence; identical to SEQ ID NO: 185680
  derived and/or modified sequence opt5 from hemagglutinin__InfluenzaA__BAH95824

SEQ ID NO: 196719 - RNA, 1707 nt, Artificial Sequence
  derived and/or modified sequence opt5 from hemagglutinin__InfluenzaA__BAJ07997
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugagaaaacacacaaugggaagcugugugaucucgacggagugaaaccccugauccuuagagauugcagcguugcgggcuggcugcucgggaacccuaugugugacgaauuuaucaaugugccggaaugguccuauauugucgagaaggcuaaccccgccaaugaucugugcuacccuggagacuucaacgauuaugaggaacugaagcaucuccugucucggaucaaucacuuugagaaaauucagaucauucccaagaacagcugguccucucaugaagccagccuuggcguguccagcgcuuguccuuaccaggggaaaucuuccuucuuucgcaauguuguguggcugaucaagaaaaacaaugccuaucccaccauuaagagaagcuacaacaauacaaaccaagaggaccuccugguccuuuggggaauccaccacccuaacgaugcugccgagcagacccggcuguaucagaauccgacaaccuacaucucugugggcacguccacccucaaccagcgccuggugcccaagauugcgacaagaagcaaagucaauggccaaucugggcggauggaguucuuuuggaccauccugaagccuaacgacgccauuaauuucgaauccaacggaaauuuuaucgcucccgaauacgccuauaaaauuguuaagaaaggcgauagcgcuaucaugaaguccgagcucgaauacgggaacugcaauacaaaaugucagaccccuaugggagccaucaacucuagcaugcccuuccauaauauucacccgcugacgaucggcgagugcccuaaguaugugaaguccaaccgccuugugcuggcgacagggcucagaaauagcccccagcgggagcgcagacggaaaaagcgcggacuguuuggcgccauugcuggcuucaucgaagggggauggcagggcauggucgacgggugguacggauaucaucacucuaacgagcaaggcuccggguacgccgcugacaaagaaagcacccagaaggccauugauggagugacaaauaaaguuaacucuaucaucgacaagaugaacacccaguuugaggccgugggcagagaguucaauaaccuugaacggcgcauugagaaucugaacaagaaaauggaagauggcuuccucgacgucuggaccuauaaugcugagcugcuggugcucauggaaaacgagagaacacuggauuuucacgacagcaauguuaagaaccuuuacgauaaagugcggcugcaacucagagacaaugcgaaggaacuggggaacggauguuucgaguuuuaccauaaaugcgauaaugaguguauggaauccguccgcaacggcacguaugacuacccucaguauucugaggaagcccggcuuaagagagaggagaucagcggggugaagcuggaauccauuggaaccuaccagauccucagcauuuauucuacagucgcuuccagccuggcccuggccaucaugguggcuggccucucucuguggaugugcuccaaugggagccuucagugccgcauuuguaucuga

SEQ ID NO: 196720 - RNA, 1701 nt, Artificial Sequence
  derived and/or modified sequence opt5 from hemagglutinin__InfluenzaA__BAJ39949
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacacauacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacgagauuacgaauaaggucaacuccgugaucgagaaaaugaauacacaguuuaccgccguuggaaaggaguucaaccaccuugagaagagaauugaaaaucugaacaaaaagguggaugacggcuuccucgauaucuggaccuacaaugcuaaacugcugguccuccugaagaacgagcggacacuugacuaucaugauagcaaugugaaaaaccuguacgaaaagguccgcucucagcucaagaacaaugccaaagagauugggaacggauguuuugaguucuaucacaagugcgacaauaccuguauggaauccgugaaaaacggcacauacgauuauccuaaguacagcgaggaagccaaacugaauagagaggaaaucgacgggguuaaacuugagucuacgcggaucuaucaaauucuggcuaucuacuccaccguggccagcucccucguccuggugguuucucugggcgcgauuagcuuuuggaugugcuccaacggaucucuccagugccgcaucuguauuuga

SEQ ID NO: 196721 - RNA, 1701 nt, Artificial Sequence
  derived and/or modified sequence opt5 from hemagglutinin__InfluenzaA__BAJ39950
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucgccgagaccuccucuagcgacaacggcacgugcuauccgggggauuuuauugacuacgaagaacugcgggagcagcuuuccagcgugucuuccuucgaacgcuuugagaucuuccccaagaccagcucuuggccuaaucacgauuccaacaagggagucacagcugccuguccccaugcgggcgccaagagcuuuuauaagaaucugaucuggcucgugaaaaagggcaacucuuacccuaaacuguccaagagcuauauuaaugacaaggggaaagaaguucuugugcuguggggaauccaccaccccuccaccucugcugaucaacagagccucuaccagaacgccgacgcuuacgucuucgugggcacauccagauauagcaagaaauuuaagccugagauugccauccggccgaaagugcgcgaucaggaggggagaaugaauuacuauuggacccuggucgaacccggagacaagauuacguucgaggcgacaggcaaccugguugugccucgguacgccuuugcuauggaacgcaacgccgggucuggaaucauuaucuccgauacccccgugcaugacugcaauacaaccugucaaaccccuaaaggcgcuaucaacacaagccuccccuuccagaauauucacccgaucacgauuggcaagugcccuaaguaugucaaaucuaccaagcugagacuugccacagggcugcggaacgugcccagcauccagucccgcggacucuuuggcgccauugcuggguucaucgagggaggcuggaccgggaugguugacggaugguacggcuaucaucaccagaaugaacaaggcucuggguacgcggccgaucugaaaagcacacagaacgcuaucgacgagauuaccaauaaggugaacuccgucaucgagaaaaugaauacgcaguuuacagccgugggaaaggaguucaaccaccuugagaagagaauugaaaaucugaacaaaaagguugaugacggcuuccucgauaucuggaccuacaaugccgagcugcuggugcuccuggaaaacgagcggacccuugacuaucaugauagcaaugucaaaaaccuguacgagaaggugcgcucucagcucaaaaacaaugcuaaggaaauugggaacggauguuuugaguucuaucacaagugcgacaauacauguauggaauccgucaaaaacggcaccuacgauuauccuaaguacagcgaggaagccaaacugaauagagaggagaucgacggggugaaacuugaaucuacacggaucuaucaaauucuggcgaucuacuccacgguugcuagcucccucgugcuggucgugucucugggcgccauuagcuuuuggaugugcuccaacggaucucuccagugccgcaucuguauuuga

SEQ ID NO: 196722 - RNA, 1701 nt, Artificial Sequence
  derived and/or modified sequence opt5 from hemagglutinin__InfluenzaA__BAJ39951
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacacauacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcuuucagucccgcggacucuucggcgcuaucgccggguuuauugagggaggcuggacagggaugguggacggaugguacggcuaucaucaccagaaugaacaaggcucuggguacgccgcugaucugaaaagcacccagaacgcgaucgacgagaucacgaauaaggucaacuccgugauugagaaaaugaauacacaguucaccgccguuggaaaggaguucaaccaccuugagaagagaaucgaaaaucugaacaaaaagguggaugacggcuuucucgauauuuggaccuacaaugcugagcugcugguccuccuggaaaacgagcggacacuugacuaucaugauagcaaugugaaaaaccuguacgagaagguccgcucucagcucaaaaacaaugccaaggaaaucgggaacggauguuucgaguuuuaucacaagugcgacaauaccuguauggaauccgugaaaaacggcacauacgauuauccuaaguacagcgaggaagccaaacugaauagagaggagauugacgggguuaaacuugaaucuacgcggaucuaucaaauccuggcuauuuacuccaccguggccagcucccucguccuggugguuucucugggcgcgaucagcuucuggaugugcuccaacggaucucuccagugccgcauuuguaucuga

SEQ ID NO: 196723 - RNA, 1701 nt, Artificial Sequence; identical to SEQ ID NO: 192296
  derived and/or modified sequence opt5 from hemagglutinin__InfluenzaA__BAJ39952

SEQ ID NO: 196724 - RNA, 1701 nt, Artificial Sequence
  derived and/or modified sequence opt5 from hemagglutinin__InfluenzaA__BAJ39953
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacacauacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacgagauuacgaauaaggucaacuccgugaucgagaaaaugaauacacaguuuaccgccguuggaaaggaguucaaccaccuugagaagagaauugaaaaucugaacaaaaagguggaugacggcuuccucgauaucuggaccuacaaugcuaaacugcugguccuccuggagaacgaacggacacuugacuaucaugauagcaaugugaagaaccuguacgagaaaguccgcucucagcucaagaacaaugccaaggagauugggaacggauguuuugaguucuaucacaaaugcgacaauaccuguauggaauccgugaagaacggcacauacgauuauccuaaauacagcgaagaggccaagcugaauagagaagagaucgacgggguuaaacuugagucuacgcggaucuaucaaauucuggcuaucuacuccaccguggccagcucccucguccuggugguuucucugggcgcgauuagcuuuuggaugugcuccaacggaucucuccagugccgcaucuguauuuga

SEQ ID NO: 196725 - RNA, 1701 nt, Artificial Sequence; identical to SEQ ID NO: 192296
  derived and/or modified sequence opt5 from hemagglutinin__InfluenzaA__BAJ39954

SEQ ID NO: 196726 - RNA, 1701 nt, Artificial Sequence
  derived and/or modified sequence opt5 from hemagglutinin__InfluenzaA__BAJ39955
augaaggccauccuggugguccuccuguacaccuucgcuacagccaacgcggacacgcuuagcauuggcuaucacgcuaauaacuccaccgauacaguugacaccgugcuggagaaaaaugugacagucacccauucugugaaccuccuggaagauaagcacaaugggaaacuuugcaagcugagaggaguugcuccccuccaucugggcaaauguaacaucgccggguggauucugggaaauccugagugcgaaagccucuccacagccucuagcugguccuacaucguggagaccucuagcuccgacaacggcacguguuauccgggggauuuuauugacuacgaagaacugcgggagcagcuuagcucugucuccagcuucgaacgcuuugagaucuuccccaagaccucuuccuggccuaaucacgauagcaacaagggagugacagccgcuugcccccaugccggcgcgaaaucuuuuuauaagaaucugaucuggcucguuaaaaagggcaacuccuacccuaaacugagcaaguccuauauuaaugacaaggggaaagaagugcuuguccuguggggaauccaccaccccucuauuagcgccgaucaacagucccucuaccagaacgcugacaccuacguguucgugggcacaagcagauauucuaagaaauuuaagccugagaucgccauucggccgaaaguccgcgaucaggaggggagaaugaauuacuauuggacccugguugaacccggagacaagaucacguucgaggcuacaggcaaccugguggugccucgguacgccuuugcgauggaacgcaacgccggguccggaauuaucaucagcgauacccccguccaugacuguaauacaaccugccaaaccccuaaaggcgcuauuaacacaucucuccccuuccagaauauccacccgauuacgaucggcaaguguccuaaguaugugaaaagcaccaagcugagacuugccacagggcugcggaacguucccuccauucagucucgcggacucuuuggcgcuaucgccggguucaucgagggaggcuggaccgggaugguggacggaugguacggcuaucaucaccagaaugaacaaggcagcggguacgccgcugaucugaaauccacacagaacgcgauugacgagaucaccaauaaggucaacagcgugauugagaaaaugaauacgcaguuuacagccguuggaaaggaguucaaccaccuugagaagagaaucgaaaaucugaacaaaaagguggaugacggcuuccucgauauuuggaccuacaaugcugagcugcugguccuccuggaaaacgagcggacccuugacuaucaugauucuaaugugaaaaaccuguacgagaagguccgcucccagcucaaaaacaaugccaaggaaaucgggaacggaugcuuugaguucuaucacaagugugacaauacaugcauggaaagcgugaaaaacggcaccuacgauuauccuaaguacucugaggaagccaaacugaauagagaggagaucgacgggguuaaacuugaauccacacggauuuaucaaauccuggcuauuuacagcacgguggccuccucucucguccuggugguuagccugggcgcgaucuccuuuuggauguguucuaacggaagccuccagugcaagauuugcaucuga

SEQ ID NO: 196727 - RNA, 1701 nt, Artificial Sequence; identical to SEQ ID NO: 196721
  derived and/or modified sequence opt5 from hemagglutinin__InfluenzaA__BAJ39956

SEQ ID NO: 196728 - RNA, 1701 nt, Artificial Sequence; identical to SEQ ID NO: 192296
  derived and/or modified sequence opt5 from hemagglutinin__InfluenzaA__BAJ39957

SEQ ID NO: 196729 - RNA, 1701 nt, Artificial Sequence
  derived and/or modified sequence opt5 from hemagglutinin__InfluenzaA__BAJ39958
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaaggucaaaucucagcucaagaacaaugccaaggaaauugggaacggauguuuugaguucuaucacaaaugcgacaauacauguauggaauccgugaagaacggcaccuacgauuauccuaaauacagcaaggaggcuaaacugaaucgcgaaaagaucgacgggguuaaacuugagucuacaagaaucuaucaaauucuggccaucuacuccacgguggcgagcucccucguccuggugguuucucugggcgcuauuagcuuuuggaugugcuccaacggaucucuccagugccggaucuguauuuga

SEQ ID NO: 196730 - RNA, 1701 nt, Artificial Sequence
  derived and/or modified sequence opt5 from hemagglutinin__InfluenzaA__BAJ39959
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccuuuauccagagccgcggacucuucggcgccauugccggguuuaucgagggaggcuggaccgggaugguggacggaugguacggcuaucaucaccagaaugaacaaggcuccggguacgcugcggaucugaaaucuacacagaacgccaucgacgagauuaccaauaaggucaacagcgugaucgagaaaaugaauacgcaguucacagcuguuggaaaggaguucaaccaccuugagaagagaauugaaaaucugaacaaaaagguggaugacggcuuucucgauaucuggaccuacaaugccgagcugcugguccuccuggaaaacgagcggacccuugacuaucaugauuccaaugugaaaaaccuguacgagaaggucaaaagccagcucaagaacaaugccaaggaaauugggaacggauguuucgaguuuuaucacaaaugcgacaauacauguauggaaucugugaagaacggcaccuacgauuauccuaaauacuccaaggaggcuaaacugaaucgcgaagagaucgacgggguuaaacuugagagcacaagaaucuaucaaauucuggccaucuacucuacgguggcguccagccucguccuggugguuucccugggcgcuauuucuuucuggaugugcagcaacggaucccuccagugccggaucuguauuuga

SEQ ID NO: 196731 - RNA, 1701 nt, Artificial Sequence; identical to SEQ ID NO: 185693
  derived and/or modified sequence opt5 from hemagglutinin__InfluenzaA__BAJ39960

SEQ ID NO: 196732 - RNA, 1701 nt, Artificial Sequence; identical to SEQ ID NO: 186322
  derived and/or modified sequence opt5 from hemagglutinin__InfluenzaA__BAJ39961

SEQ ID NO: 196733 - RNA, 1701 nt, Artificial Sequence
  derived and/or modified sequence opt5 from hemagglutinin__InfluenzaA__BAJ39962
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucgccgagaccuccucuagcgacaacggcacgugcuauccgggggauuuuauugacuacgaagaacugcgggagcagcuuuccagcgugucuuccuucgaacgcuuugagaucuuccccaagaccagcucuuggccuaaucacgauuccaacaagggagucacagcugccuguccccaugcgggcgccaagagcuuuuauaagaaucugaccuggcucgugaaaaagggcaacucuuacccuaaacuguccaagagcuauaucaaugacaaggggaaagaaguucuugugcuguggggcauucaccaccccuccacaucugcugaucaacagagccucuaccagaacgccgacgcuuacgucuucgugggaaccuccagauauagcaagaaauuuaagccugagaucgccauucggccgaaagugcgcgaucaggaggggagaaugaauuacuauuggacgcuggucgaacccggagacaagaucacauucgaggcgaccggcaaccugguugugccucgguacgccuuugcuauggaacgcaacgccgggucuggaauuaucauuuccgauacacccgugcaugacugcaauaccaccugucaaacaccuaaaggcgcuaucaacacgagccuccccuuccagaauauccacccgauuaccaucggcaagugcccuaaguaugucaaaucuacaaagcugagacuugccaccgggcugcggaacgugcccuuuauucagagccgcggacucuucggcgccaucgcuggguuuauugagggaggcuggacagggaugguugacggaugguacggcuaucaucaccagaaugaacaaggcuccggguacgcggccgaucugaaaucuacccagaacgcuaucgacgagaucacgaauaaggugaacagcgucauugagaaaaugaauacacaguucaccgccgugggaaaggaguucaaccaccuugagaagagaaucgaaaaucugaacaaaaagguugaugacggcuuucucgauauuuggaccuacaaugccgagcugcuggugcuccuggaaaacgagcggacacuugacuaucaugauuccaaugucaaaaaccuguacgagaaggugaaaagccagcucaagaacaaugcuaaggaaaucgggaacggauguuucgaguuuuaucacaaaugcgacaauaccuguauggaaucugucaagaacggcacauacgauuauccuaaauacuccaaggaggccaaacugaaucgcgaagagauugacggggugaaacuugagagcacgagaaucuaucaaauccuggcgauuuacucuaccguugcuuccagccucgugcuggucgugucccugggcgccaucucuuucuggaugugcagcaacggaucccuccagugccggauuuguaucuga

SEQ ID NO: 196734 - RNA, 1701 nt, Artificial Sequence; identical to SEQ ID NO: 185693
  derived and/or modified sequence opt5 from hemagglutinin__InfluenzaA__BAJ39963

SEQ ID NO: 196735 - RNA, 1701 nt, Artificial Sequence; identical to SEQ ID NO: 192296
  derived and/or modified sequence opt5 from hemagglutinin__InfluenzaA__BAJ39964

SEQ ID NO: 196736 - RNA, 1701 nt, Artificial Sequence; identical to SEQ ID NO: 185693
  derived and/or modified sequence opt5 from hemagglutinin__InfluenzaA__BAJ39965

SEQ ID NO: 196737 - RNA, 1701 nt, Artificial Sequence; identical to SEQ ID NO: 185693
  derived and/or modified sequence opt5 from hemagglutinin__InfluenzaA__BAJ39966

SEQ ID NO: 196738 - RNA, 1701 nt, Artificial Sequence
  derived and/or modified sequence opt5 from hemagglutinin__InfluenzaA__BAJ39967
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaacuccugucuacagccagcuccuggucuuacaucguggagaccagcuccucugacaacggcacgugcuauccgggggauuuuauugacuacgaagaacuucgggagcagcugagcuccgucagcucuuucgaacgcuuugagaucuuccccaagaccuccagcuggccuaaucacgauucugacaagggagugacagccgcuuguccccaugccggcgcgaaauccuuuuauaagaaccucaucuggcugguuaaaaagggcaauagcuacccuaaacuuucuaaguccuauauuaacgauaaggggaaagaagugcugguccucuggggaauccaccaccccagcaccuccgccgaccaacagucucuguaccagaaugcugaugccuacguguucgugggcacaagcagauauuccaagaaauuuaagccugagauugcuauccggccgaaaguccgcgaccaggaggggagaaugaacuacuauuggacccugguugaacccggagauaagauuacguucgaggccacaggcaaucucguggugccucgguacgcguuugccauggaacgcaacgcugggagcggaaucauuaucucugacacccccguccaugacugcaacacaaccugucaaaccccuaaaggcgccaucaauacaucccugcccuuccagaacauucacccgaucacgauuggcaagugcccuaaguaugugaaaagcaccaaacuuagacuggcuacagggcuccggaauguucccucuauccagagccgcggacuguuuggcgccauugccggguucaucgagggaggcuggaccgggaugguggauggaugguacggcuaucaucaccagaacgaacaaggcuccggguacgcugcggaccuuaagucuacacagaaugccaucgaugagauuaccaacaaggucaauagcgugaucgagaaaaugaacacgcaguuuacagcucugggaaaggaguucaaucaccucgagaagaaaauugaaaaccugaauaagaaaguugacgauggcuuccuggacaucuggaccuacaacgccgagcuccuggugcuucuggaaaaugagagaacccucgauuaucaugacuccaacgucaagaaucuguacgagaaagugcggagccagcuuaagaacaacgccaaggaaauugggaauggauguuuugaguucuaucacaaaugcgauaacacauguauggaaucugucaagaauggcaccuacgacuauccuaaauacuccgaggaagcuaagcugaaccgcgaggagaucgauggggugaaacucgaaagcacaagaaucuaucaaauucuggccaucuacucuacgguugcguccagccuggugcucgucgugucccugggcgcuauuucuuuuuggaugugcagcaauggaucccuucagugccggaucuguauuuga

SEQ ID NO: 196739 - RNA, 1701 nt, Artificial Sequence; identical to SEQ ID NO: 191221
  derived and/or modified sequence opt5 from hemagglutinin__InfluenzaA__BAJ39968

SEQ ID NO: 196740 - RNA, 1701 nt, Artificial Sequence; identical to SEQ ID NO: 192296
  derived and/or modified sequence opt5 from hemagglutinin__InfluenzaA__BAJ39969

SEQ ID NO: 196741 - RNA, 1701 nt, Artificial Sequence; identical to SEQ ID NO: 185693
  derived and/or modified sequence opt5 from hemagglutinin__InfluenzaA__BAJ39970

SEQ ID NO: 196742 - RNA, 1701 nt, Artificial Sequence; identical to SEQ ID NO: 185693
  derived and/or modified sequence opt5 from hemagglutinin__InfluenzaA__BAJ39971

SEQ ID NO: 196743 - RNA, 1701 nt, Artificial Sequence; identical to SEQ ID NO: 186322
  derived and/or modified sequence opt5 from hemagglutinin__InfluenzaA__BAJ39972

SEQ ID NO: 196744 - RNA, 1701 nt, Artificial Sequence
  derived and/or modified sequence opt5 from hemagglutinin__InfluenzaA__BAJ39973
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacacauacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacgagauuacgaauaaggucaacuccgugaucgagaaaaugaauacacaguuuaccgccguuggaaaggaguucaaccaccuugagaagagaauugaaaaucugaacaaaaagguggaugacggcuuccucgauaucuggaccuacaaugcugagcugcugguccuccuggaaaacgagcggacacuugacuaucaugauagcaaugugaaaaaccuguacgagaaggucaaaucucagcucaagaacaaugccaaggaaauugggaacggauguuuugaguucuaucacaaaugcgacaauaccuguauggaauccgugaagaacggcacauacgauuauccuaaauacagcgaggaagccaagcugaaucgcgaggagaucgacgggguuaaacuugaaucuacgagaaucuaucaaauucuggcuaucuacuccaccguggccagcucccucguccuggugguuucucugggcgcgauuagcuuuuggaugugcuccaacggaucucuccagugccggaucuguauuuga

SEQ ID NO: 196745 - RNA, 1701 nt, Artificial Sequence; identical to SEQ ID NO: 185693
  derived and/or modified sequence opt5 from hemagglutinin__InfluenzaA__BAJ39974

SEQ ID NO: 196746 - RNA, 1701 nt, Artificial Sequence; identical to SEQ ID NO: 186262
  derived and/or modified sequence opt5 from hemagglutinin__InfluenzaA__BAJ39975

SEQ ID NO: 196747 - RNA, 1701 nt, Artificial Sequence
  derived and/or modified sequence opt5 from hemagglutinin__InfluenzaA__BAJ39976
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugagaaacuuuguaagcugagagggguugcuccccuccaucugggaaaaugcaacaucgccggcuggauucuggggaauccugaaugugagucucucagcacagccuccucuuggagcuacaucguggaaaccuccucuagcgacaacggaacgugcuauccgggcgauuuuauugacuacgaggagcugcgggaacagcuuuccagcgucucuuccuucgagcgcuuugaaaucuuccccaagaccagcucuuggccuaaucacgauuccaacaagggggugacagccgcuuguccccaugccggagcgaaaucuuuuuauaagaaucugaucuggcucguuaaaaagggcaacagcuacccuaaacuguccaagagcuauauuaaugacaagggcaaagaggugcuuguccugugggggauccaccaccccuccaccucugccgaucaacagagccucuaccagaacgcugacgccuacguguucgugggaacauccagauauagcaagaaauuuaagccugagauugcuauccggccgaaaguccgcgaucaggaaggcagaaugaauuacuauuggacccugguugagcccggggacaagauuacguucgaagccacaggaaaccugguggugccucgguacgcguuugccauggagcgcaacgcuggcucugggaucauuaucuccgauacccccguccaugacugcaauacaaccugucaaaccccuaaaggagccaucaacacaagccuccccuuccagaauauucacccgaucacgauuggcaagugcccuaaguaugugaaaucuaccaagcugagacuugcuacaggccugcggaacguucccagcauccagucccgcgggcucuuuggagccauugccggcuucaucgaagggggauggaccggcaugguggacgggugguacggauaucaucaccagaaugagcaaggcucuggcuacgcugcggaucugaaaagcacacagaacgccaucgacaagauuaccaauaaagucaacuccgugaucgagaagaugaauacgcaguuuacagcuguugggaaggaauuuaaccaccuugagaaaagaauugaaaaucugaacaagaaaguggaugacggauuccucgauaucuggaccuacaaugccgagcugcugguccuccuggaaaacgagcggacccuugacuaucaugauagcaaugugaagaaccuguacgagaaaguccgcucucagcucaagaacaaugccaaggaaauuggcaacggguguuucgaguucuaucacaaaugcgacaauacauguauggaauccgugaagaacggaaccuacgauuauccuaaauacagcgaggaagcuaagcugaauagagaggagaucgacggcguuaaacuugaaucuacacggaucuaucaaauucuggccaucuacuccacgguggcgagcucccucguccuggugguuucucugggggcuauuaacuuuuggaugugcagcaauggcucccuccagugccgcaucuguauuuga

SEQ ID NO: 196748 - RNA, 1701 nt, Artificial Sequence; identical to SEQ ID NO: 185693
  derived and/or modified sequence opt5 from hemagglutinin__InfluenzaA__BAJ39977

SEQ ID NO: 196749 - RNA, 1701 nt, Artificial Sequence
  derived and/or modified sequence opt5 from hemagglutinin__InfluenzaA__BAJ39978
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacucuaucacgauuggcaagugcccgaaguaugugaaaagcaccaagcugagacuugcuacagggcugcggaacguuccuuccauccagucucgcggacucuuuggcgccauugccggguucaucgaaggaggcuggaccgggaugguggacggaugguacggcuaucaucaccagaaugagcaaggcagcggguacgcugcggaccugaaauccacacagaacgccaucgaugagauuaccaauaaggucaacagcgugaucgaaaagaugaauacgcaguuuacagcuguuggaaaggaguucaaccaccuugaaaagagaauugagaaucugaacaaaaagguggacgauggcuuccucgacaucuggaccuacaaugccgaacugcugguccuccuggagaacgagcggacccuugauuaucaugacucuaaugugaaaaaccuguacgaaaaggucaaaucccagcucaagaacaaugccaaggagauugggaacggauguuuugaguucuaucacaaaugcgauaauacauguauggagagcgugaagaacggcaccuacgacuaucccaaauacucugaagaggcuaagcugaaucgcgagaaaaucgaugggguuaaacuugaauccacaagaaucuaucaaauucuggccaucuacagcacgguggcguccucucucguccuggugguuagccugggcgcuauuuccuuuuggaugugcucuaacggaagccuccagugccggaucuguauuuga

SEQ ID NO: 196750 - RNA, 1701 nt, Artificial Sequence
  derived and/or modified sequence opt5 from hemagglutinin__InfluenzaA__BAJ39979
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaacuccugucuacagccagcuccuggucuuacaucguggagaccagcuccucugacaacggcacgugcuauccgggggauuuuauugacuacgaagaacuucgggagcagcugagcuccgucagcucuuucgaacgcuuugagaucuuccccaagaccuccagcuggccuaaucacgauucugacaagggagugacagccgcuuguccccaugccggcgcgaaauccuuuuauaagaaccucaucuggcugguuaaaaagggcaauagcuacccuaaacuuucuaaguccuauauuaacgauaaggggaaagaagugcugguccucuggggaauccaccaccccagcaccuccgccgaccaacagucucuguaccagaaugcugaugccuacguguucgugggcacaagcagauauuccaagaaauuuaagccugagauugcuauccggccgaaaguccgcgaccaggaggggagaauggauuacuauuggacccugguugaacccggagacaagauuacguucgaggccacaggcaaccucguggugccucgguacgcguuugccauggaacgcaaugcugggagcggaaucauuaucucugacacccccguccauaacugcaacacaaccugucaaaccccuaaaggcgccaucaauacaucccugcccuuccagaacauucacccgaucacgauuggcaagugcccuaaguaugugaaaagcaccaaacuuagacuggcuacagggcuccggaauguucccucuauccagagccgcggacuguuuggcgccauugccggguucaucgagggaggcuggaccgggaugguggauggaugguacggcuaucaucaccagaacgaacaaggcuccggguacgcugcggaccuuaagucuacacagaaugccaucgauaagauuaccaacaaagucaauagcgugaucgagaagaugaacacgcaguuuacagcuguuggaaaggaguucaaucaccuggaaaacagaauugagaaucucaacaaaaagguggacgauggcuuccuggacaucuggaccuacaaugccgaacugcucguccugcuugagaacgaacggacccuggauuaucaugacuccaaugugaaaaaccucuacgagaagguccgcagccagcugaaaaacaaugccaaggagauugggaacggauguuuugaguucuaucacaagugcgauaauacauguauggagucugugaaaaacggcaccuacgacuauccuaaguacuccgaagaggcuaaacuuaauagagaagagaucgaugggguuaagcuggagagcacacggaucuaucaaauucucgccaucuacucuacgguggcguccagccugguccuggugguuucccucggcgcuauuucuuuuuggaugugcagcaacggaucccugcagugccgcaucuguauuuga

SEQ ID NO: 196751 - RNA, 1701 nt, Artificial Sequence; identical to SEQ ID NO: 192296
  derived and/or modified sequence opt5 from hemagglutinin__InfluenzaA__BAJ39980

SEQ ID NO: 196752 - RNA, 1701 nt, Artificial Sequence
  derived and/or modified sequence opt5 from hemagglutinin__InfluenzaA__BAJ39981
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcucuaaguaugugaaaagcaccaagcugagacuugcuacagggcugcggaacguuccuuccauccagucucgcggacucuuuggcgccauugccggguucaucgagggaggcuggaccgggaugguggacggaugguacggcuaucaucaccagaaugaacaaggcagcggguacgcugcggaucugaaauccacacagaacgccaucgacgagauuaccaauaaggucaacagcgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauucuaaugugaaaaaccuguacgagaaggucaaaucccagcucaagaacaaugccaaggaaauugggaacggauguuuugaguucuaucacaaaugcgacaauacauguauggaaagcgugaagaacggcaccuacgauuaucccaaauacucuaaggaggcuaaacugaaucgcgaaaagaucgacgggguuaaacuugaguccacaagaaucuaucaaauucuggccaucuacagcacgguggcguccucucucguccuggugguuagccugggcgcuauuuccuuuuggaugugcucuaacggaagccuccagugccggaucuguauuuga

SEQ ID NO: 196753 - RNA, 1701 nt, Artificial Sequence
  derived and/or modified sequence opt5 from hemagglutinin__InfluenzaA__BAJ39982
augaaggccauccuggugguccuccuguacaccuucgcuacagccaacgcggcuacgcuuugcauuggcuaucacgccaauaacagcaccgacacaguugauacccugcucgagaaaaaugugacagugacccauuccgucaaccugcuugaagacaagcacaaugggaaacuguguaagcucagaggaguggcuccccugcaucugggcaaaugcaacaucgccggguggauucucggaaauccugagugugaaucucugagcacagccuccucuuggagcuacaucguugagaccuccucuagcgauaacggcacgugcuauccgggggacuuuauugauuacgaagaacuucgggagcagcuguccagcgugucuuccuucgaacgcuuugagaucuuccccaagaccagcucuuggccuaaucacgacuccaacaagggagucacagcugccuguccccaugcgggcgccaagagcuuuuauaagaaucucaucuggcuggugaaaaagggcaacucuuacccuaaacuuuccaagagcuauauuaaugauaaggggaaagaaguucuggugcucuggggaauccaccaccccuccaccucugcugaccaacagagccuguaccagaacgccgaugcuuacgucuucgugggcacauccagauauagcaagaaauuuaagccugagauugccauccggccgaaagugcgcgaccaggaggggagaaugaauuacuauuggacccuggucgaacccggagauaagauuacguucgaggcgacaggcaaccucguugugccucgguacgccuuugcuauggaacgcaacgccgggucuggaaucauuaucuccgacacccccgugcaugauugcaauacaaccugucaaaccccuaaaggcgcuaucaacacaagccugcccuuccagaauauucacccgaucacgauuggcaagugcccuaaguaugucaaaucuaccaaacuuagacuggccacagggcuccggaacgugcccagcauccagucccgcggacuguuuggcgccauugcuggguucaucgagggaggcuggaccgggaugguugacggaugguacggcuaucaucaccagaaugaacaaggcucuggguacgcggccgaccuuaaaagcacacagaacgcuaucgaugagauuaccaauaaggugaacuccgucaucgagaaaaugaauacgcaguuuacagccgugggaaaggaguucaaccaccuggagaagagaauugaaaaucucaacaaaaagguugacgauggcuuccuggacaucuggaccuacaaugccgagcugcucgugcugcuugaaaacgagcggacccuggauuaucaugacagcaaugucaaaaaccucuacgagaaggugcgcucucagcugaaaaacaaugcuaaggaaauugggaacggauguuuugaguucuaucacaagugcgauaauacauguauggaauccgucaaaaacggcaccuacgacuauccuaaguacagcgaggaagccaaacuuaauagagaggagaucgauggggugaagcuggaaucuacacggaucuaucaaauucucgcgaucuacuccacgguugcuagcucccuggugcuggucgugucucucggcgccauuagcuuuuggaugugcuccaacggaucucugcagugccgcaucuguauuuga

SEQ ID NO: 196754 - RNA, 1701 nt, Artificial Sequence; identical to SEQ ID NO: 196721
  derived and/or modified sequence opt5 from hemagglutinin__InfluenzaA__BAJ39983

SEQ ID NO: 196755 - RNA, 1701 nt, Artificial Sequence
  derived and/or modified sequence opt5 from hemagglutinin__InfluenzaA__BAJ39984
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaacuccugucuacagccagcuccuggucuuacaucguggagaccagcuccucugacaacggcacgugcuauccgggggauuuuauugacuacgaagaacuucgggagcagcugagcuccgucagcucuuucgaacgcuuugagaucuuccccaagaccuccagcuggccuaaucacgauucuaacaagggagugacagccgcuuguccccaugccggcgcgaaauccuuuuauaagaaucucaucuggcugguuaaaaagggcaacagcuacccuaaacuuucuaaguccuauauuaaugacaaggggaaagaagugcugguccucuggggaauccaccaccccagcaccuccgccgaucaacagucucuguaccagaacgcugacgccuacguguucgugggcacaagcagauauuccaagaaauuuaagccugagauugcuauccggccgaaaguccgcgaucaggaggggagaaugaauuacuauuggacccugguugaacccggagacaagauuacguucgaggccacaggcaaccucguggugccucgguacgcguuugccauggaacgcaacgcugggagcggaaucauuaucucugauacccccguccauaauugcaacacaaccugucaaaccccuaaaggcgccaucaauacaucccugcccuuccagaacauucacccgaucacgauuggcaagugcccuaaguaugugaaaagcaccaaacuuagacuggcuacagggcuccggaauguucccucuauccagagccgcggacuguuuggcgccauugccggguucaucgagggaggcuggaccgggaugguggacggaugguacggcuaucaucaccagaacgaacaaggcuccggguacgcugcggaccuuaaaucuacacagaaugccaucgauaagauuaccaacaaagucaauagcgugaucgagaagaugaacacgcaguuuacagcuguuggaaaggaguucaaucaccuggaaaagagaauugagaaccucaauaagaaaguggacgauggcuuccuggacaucuggaccuacaacgccgaacugcucguccugcuugagaaugaacggacccuggauuaucaugacuccaacgugaagaaccucuacgagaaaguccgcagccagcugaagaauaacgccaaggagauugggaauggauguuuugaguucuaucacaaaugcgauaacacauguauggagucugugaagaauggcaccuacgacuauccuaaauacuccgaagaggcuaaacuuaacagagaagagaucgaugggguuaagcuggagagcacacggaucuaucaaauucucgccaucuacucuacgguggcguccagccugguccuggugguuucccucggcgcuauuucuuuuuggaugugcagcaauggaucccugcagugccgcaucuguauuuga

SEQ ID NO: 196756 - RNA, 1701 nt, Artificial Sequence; identical to SEQ ID NO: 185693
  derived and/or modified sequence opt5 from hemagglutinin__InfluenzaA__BAJ39985

SEQ ID NO: 196757 - RNA, 1701 nt, Artificial Sequence
  derived and/or modified sequence opt5 from hemagglutinin__InfluenzaA__BAJ39987
augaagaccauccuggugguccuccuguacacauucgccacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaaaaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacaccuacguguucgugggcacguccagauauagcaagaaauuuaagccugagauugcuauccggccgaaaguccgcgaucaggaggggagaaugaauuacuauuggacacugguugaacccggagacaagauuaccuucgaggccacaggcaaccugguggugccucgguacgcuuuugccauggaacgcaacgcggggucuggaaucauuaucuccgauacccccguccaugacugcaauaccacaugucaaacgccuaaaggcgccaucaacaccagccuccccuuccagaauauucacccgaucacaauuggcaagugcccuaaguaugugaaaucuaccaagcugagacuugcuacagggcugcggaacguucccagcauccagucccgcggacucuuuggcgccauugcuggguucaucgagggaggcuggaccgggaugguggacggaugguacggcuaucaucaccagaaugaacaaggcucuggguacgccgccgaucugaaaagcacgcagaacgcuaucgacgagauuacaaauaaggucaacuccgugaucgagaaaaugaauacccaguuuaccgcgguuggaaaggaguucaaccaccuugagaagagaauugaaaaucugaacaaaaagguggaugacggcuuccucgauaucuggacauacaaugccgagcugcugguccuccuggaaaacgagcggacccuugacuaucaugauagcaaugugaaaaaccuguacgagaagguccgcucucagcucaaaaacaaugcuaaggaaauugggaacggauguuuugaguucuaucacaagugcgacaauacauguauggaauccgugaaaaacggcacguacgauuauccuaaguacagcaaagaggccaagcugaauagagaagagaucgacgggguuaaacuugagucuacccggaucuaucaaauucuggccaucuacuccacaguggcuagcucccucguccuggugguuucucugggcgccauuagcuuuuggaugugcuccaacggaucucuccagugccgcaucuguauuuga

SEQ ID NO: 196758 - RNA, 1701 nt, Artificial Sequence
  derived and/or modified sequence opt5 from hemagglutinin__InfluenzaA__BAJ39988
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagcauuuaccagaacgcugacgccuacguguucgugggcacauccagauauagcaagaaauuuaagccugagaucgcuauucggccgaaaguccgcgaucaggaggggagaaugaauuacuauuggacccucguugaacccggagacaagaucacguucgaggccacaggcaaccugguggugccucgguacgcguuugccauggaacgcaacgcugggucuggaauuaucaucuccgauacccccguccaugacugcaauacaaccugucaaaccccuaaaggcgccauuaacacaagccugcccuuccagaauauccacccgauuacgaucggcaagugcucuaaguaugugaaaagcaccaagcucagacuggcuacagggcuucggaacguuccuuccauucagucucgcggacuguuuggcgccaucgccggguucaucgagggaggcuggaccgggaugguggacggaugguacggcuaucaucaccagaaugaacaaggcagcggguacgcugcggaucucaaauccacacagaacgccauugacgagaucaccaauaaggucaacagcgugauugagaaaaugaauacgcaguuuacagcuguuggaaaggaguucaaccaccuggagaagagaaucgaaaaucuuaacaaaaagguggaugacggcuuccuggauauuuggaccuacaaugccgagcuccugguccugcucgaaaacgagcggacccuggacuaucaugauucuaaugugaaaaaccuuuacgagaagguccgcucccagcugaaaaacaaugccaaggaaaucgggaacggauguuuugaguucuaucacaagugcgacaauacauguauggaaagcgugaaaaacggcaccuacgauuaucccaaguacucugaggaagcuaaacucaauagagaggagaucgacgggguuaagcuggaauccacacggauuuaucaaauccuugccauuuacagcacgguggcguccucucugguccucgugguuagccugggcgcuaucuccuuuuggaugugcucuaacggaagccugcagugccgcauuuguaucuga

SEQ ID NO: 196759 - RNA, 1701 nt, Artificial Sequence; identical to SEQ ID NO: 187007
  derived and/or modified sequence opt5 from hemagglutinin__InfluenzaA__BAJ39989

SEQ ID NO: 196760 - RNA, 1701 nt, Artificial Sequence; identical to SEQ ID NO: 185693
  derived and/or modified sequence opt5 from hemagglutinin__InfluenzaA__BAJ39990

SEQ ID NO: 196761 - RNA, 1701 nt, Artificial Sequence; identical to SEQ ID NO: 185693
  derived and/or modified sequence opt5 from hemagglutinin__InfluenzaA__BAJ39993

SEQ ID NO: 196762 - RNA, 1701 nt, Artificial Sequence
  derived and/or modified sequence opt5 from hemagglutinin__InfluenzaA__BAJ39994
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacacauacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaccacaaucggcaagugcccuaaguaugugaaaucuaccaagcugagacuugccacagggcugcggaacguucccagcauucagucccgcggacucuuuggcgcuaucgccggguucauugagggaggcuggaccgggaugguggacggaugguacggcuaucaucaccagaaugaacaaggcucuggguacgccgcugaucugaaaagcacgcagaacgcgaucgacgagaucacaaauaaggucaacuccgugauugagaaaaugaauacccaguuuaccgccguuggaaaggaguucaaccaccuugagaagagaaucgaaaaucugaacaaaaagguggaugacggcuuccucgauauuuggacauacaaugcugagcugcugguccuccuggaaaacgagcggacccuugacuaucaugauagcaaugugaaaaaccuguacgagaaggucaaaucucagcucaagaacaaugccaaggaaaucgggaacggauguuuugaguucuaucacaaaugcgacaauacaugucuggaauccgugaagaacggcacguacgauuauccuaaauacagcgaggaagccaaacuuaaucgcgagaagauugacgggguuaagcuggagucuaccagaaucuaucaaauccucgcuauuuacuccacaguggccagcucccugguccuggugguuucucucggcgcgaucagcuuuuggaugugcuccaacggaucucugcagugccggauuuguaucuga

SEQ ID NO: 196763 - RNA, 1701 nt, Artificial Sequence; identical to SEQ ID NO: 185693
  derived and/or modified sequence opt5 from hemagglutinin__InfluenzaA__BAJ39996

SEQ ID NO: 196764 - RNA, 1701 nt, Artificial Sequence
  derived and/or modified sequence opt5 from hemagglutinin__InfluenzaA__BAJ39997
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacacauacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaccacaaucggcaagugcccuaaguaugugaaaucuaccaagcugagacuugccacagggcugcggaacguucccagcauucagucccgcggacucuuuggcgcuaucgccggguucauugagggaggcuggaccgggaugguggacggaugguacggcuaucaucaccagaaugaacaaggcucuggguacgccgcugaucugaaaagcacgcagaacgcgaucgacgagaucacaaauaaggucaacuccgugauugagaaaaugaauacccaguuuaccgccguuggaaaggaguucaaccaccuugagaagagaaucgaaaaucugaacaaaaagguggaugacggcuuccucgauauuuggacauacaaugcugagcugcugguccuccuggaaaacgagcggacccuugacuaucaugauagcaaugugaaaaaccuguacgagaagguccgcucucagcucaaaaacaaugccaaggaaaucgggaacggauguuuugaguucuaucacaagugcgacaauacauguauggaauccgugaaaaacggcacguacgauuauccuaaguacagcgaggaagccaaacugaauagagaggagauugacgggguuaaacuugaaucuacccggaucuaucaaauccuggcuauuuacuccacaguggccagcucccucguccuggugguuucucugggcgcgaucagcuuuuggaugugcuccaacggaucucuccagugccgcauuuguaucuga

SEQ ID NO: 196765 - RNA, 1701 nt, Artificial Sequence; identical to SEQ ID NO: 185693
  derived and/or modified sequence opt5 from hemagglutinin__InfluenzaA__BAJ39998

SEQ ID NO: 196766 - RNA, 1701 nt, Artificial Sequence
  derived and/or modified sequence opt5 from hemagglutinin__InfluenzaA__BAJ39999
augaaggccauccuggugguccuccuguacaccuucgcuacagccaacgcggacacgcuuugcauuggcuaucacgcuaauaacagcaccgauacaguugacaccgugcuggagagaaaugugacagucacccauuccgugaaccuccuggaagauaaacacaaugggaagcuguguaaacugcggggaguugcgccccuccaucugggcaagugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgcgagcagcuuuccagcgucucuuccuucgaaagauuugagaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaagugcuuguccuguggggaauccaccaccccuccaccucugccgaucaacagagccucuaccagaacgcugacacauacguguucgugggcaccucccgguauagcaaaaaguuuaaaccugagauugccauccgcccgaaggucagagaucaggaggggcggaugaauuacuauuggacgcugguugaacccggagacaaaauuacauucgaggcuaccggcaaccugguggugccucgcuacgccuuugcgauggaaagaaacgccgggucuggaaucauuaucuccgauacacccguccaugacugcaauaccaccugucaaacaccuaagggcgcuaucaacacgagccuccccuuccagaauauucacccgaucaccauuggcaaaugcccuaaguaugugaagucuacaaaacugcggcuugccaccgggcugcgcaacguucccagcauccaguccagaggacucuuuggcgcuauugccggguucaucgagggaggcuggacagggaugguggacggaugguacggcuaucaucaccagaaugaacaaggcucuggguacgccgcugaucuuaagagcacccagaacgcgaucgacgagauuacgaauaaagucaacuccgugaucgagaagaugaauacacaguuuaccgccguuggaaaagaguucaaccaccuugagaagcggauugaaaaucugaacaagaaaguggaugacggcuuccucgauaucuggaccuacaaugcugagcugcugguccuccuggaaaacgagcgcacacuugacuaucaugauagcaaugugaagaaccuguacgagaaagucagaucucagcucaagaacaaugccaaagaaauugggaacggauguuuugaguucuaucacaagugcgacaauaccuguauggaauccgugaagaacggcacauacgauuauccuaaauacagcgaggaagccaagcugaaucgggaggagaucgacgggguuaaacuugaaucuacgcgcaucuaucaaauucuggcuaucuacuccaccguggccagcucccucguccuggugguuucucugggcgcgauuagcuuuuggaugugcuccaacggaucucuccagugcagaaucuguauuuga

SEQ ID NO: 196767 - RNA, 1701 nt, Artificial Sequence
  derived and/or modified sequence opt5 from hemagglutinin__InfluenzaA__BAJ40000
augaagaccauccuggugguccuccuguacacauucgccacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacaccuacguguucgugggcacguccagauauagcaagaaauuuaagccugagauugcuauccggccgaaaguccgcgaucaggaggggagaaugaauuacuauuggacacugguugaacccggagacaagauuaccuucgaggccacaggcaaccugguggugccucgguacgcuuuugccauggaacgcaacgcggggucuggaaucauuaucuccgauacccccguccaugacugcaauaccacaugucaaacgccuaaaggcgccaucaacaccagccuccccuuccagaauauucacccgaucacaauuggcaagugcccuaaguaugugaaaucuaccaagcugagacuugcuacagggcugcggaacguucccagcauccagucccgcggacucuuuggcgccauugcuggguucaucgagggaggcuggaccgggaugguggacggaugguacggcuaucaucaccagaaugaacaaggcucuggguacgccgccgaucugaaaagcacgcagaacgcuaucgacgagauuacaaauaaggucaacuccgugaucgagaaaaugaauacccaguuuaccgcgguuggaaaggaguucaaccaccuugagaagagaauugaaaaucugaacaaaaagguggaugacggcuuccucgauaucuggacauacaaugccgagcugcugguccuccuggaaaacgagcggacccuugacuaucaugauagcaaugugaaaaaccuguacgagaagguccgcucucagcucaaaaacaaugcuaaggaaauugggaacggauguuuugaguucuaucacaagugcgacaauacauguauggaauccgugaaaaacggcacguacgauuauccuaaguacagcgaggaagccaaacugaauagagaggagaucgacgggguuaaacuugaaucuacccggaucuaucaaauucuggccaucuacuccacaguggcuagcucccucguccuggugguuucucugggcgccauuagcuuuuggaugugcuccaacggaucucuccagugccgcaucuguauuuga

SEQ ID NO: 196768 - RNA, 1701 nt, Artificial Sequence; identical to SEQ ID NO: 190703
  derived and/or modified sequence opt5 from hemagglutinin__InfluenzaA__BAJ40001

SEQ ID NO: 196769 - RNA, 1701 nt, Artificial Sequence; identical to SEQ ID NO: 185693
  derived and/or modified sequence opt5 from hemagglutinin__InfluenzaA__BAJ40002

SEQ ID NO: 196770 - RNA, 1701 nt, Artificial Sequence; identical to SEQ ID NO: 190703
  derived and/or modified sequence opt5 from hemagglutinin__InfluenzaA__BAJ40003

SEQ ID NO: 196771 - RNA, 1701 nt, Artificial Sequence
  derived and/or modified sequence opt5 from hemagglutinin__InfluenzaA__BAJ40004
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagaaacagccgcuuguccccaugccggcgcgaaaucuuuuuauaagaaucugaucuggcucgugaaaaagggcaacagcuacccuaaacuguccaagagcuauauuaaugacaaggggaaagagguucuugugcuguggggaauccaccaccccuccaccucugccgaucaacagagccucuaccagaacgcugacgccuacgucuucgugggcacauccagauauagcaagaaauuuaagccugagauugcuauccggccgaaagugcgcgaucaggaagggagaaugaauuacuauuggacccuggucgagcccggagacaagauuacguucgaagccacaggcaaccugguugugccucgguacgcguuugccauggagcgcaacgcugggucuggaaucauuaucuccgauacccccgugcaugacugcaauacaaccugucaaaccccuaaaggcgccaucaacacaagccuccccuuccagaauauucacccgaucacgauuggcaagugcccuaaguaugucaaaucuaccaagcugagacuugcuacagggcugcggaacgugcccagcauccagucccgcggacucuuuggcgccauugccggguucaucgaaggaggcuggaccgggaugguugacggaugguacggcuaucaucaccagaaugagcaaggcucuggguacgcugcggaucugaaaagcacacagaacgccaucgacaagauuaccaauaaagugaacuccgucaucgagaagaugaauacgcaguuuacagcugugggaaaggaguucaaccaccuugagaaaagaauugaaaaucugaacaagaaaguugaugacggcuuccucgauaucuggaccuacaaugccgagcugcuggugcuccuggaaaacgagcggacccuugacuaucaugauagcaaugucaagaaccuguacgagaaagugaagucucagcucaagaacaaugccaaagaaauugggaacggauguuuugaguucuaucacaagugcgacaauacauguauggaauccgucaaaaacggcaccuacgauuauccuaaguacagcgaggaagcuaaacugaaucgcgagaagaucgacggggugaaacuugagucuacaagaaucuaucaaauucuggccaucuacuccacgguugcgagcucccucgugcuggucgugucucugggcgcuauuagcuuuuggaugugcuccaacggaucucuccagugccggaucuguauuuga

SEQ ID NO: 196772 - RNA, 1701 nt, Artificial Sequence
  derived and/or modified sequence opt5 from hemagglutinin__InfluenzaA__BAJ40006
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggagagaagugcuuguccuguggggaauccaccaccccuccaccucugccgaucaacagagccucuaccagaacgcugacacauacguguucgugggcaccucccgguauagcaaaaaguuuaaaccugagauugccauccgcccgaaggucagagaucaggaggggcggaugaauuacuauuggacgcugguugaacccggagacaaaauuacauucgaggcuaccggcaaccugguggugccucgcuacgccuuugcgauggaaagaaacgccgggucuggaaucauuaucuccgauacacccguccaugacugcaauaccaccugucaaacaccuaagggcgcuaucaacacgagccuccccuuccagaauauucacccgaucaccauuggcaaaugcccuaaguaugugaagucuacaaaacugcggcuugccaccgggcugcgcaacguucccagcauccaguccagaggacucuuuggcgcuauugccggguucaucgagggaggcuggacagggaugguggacggaugguacggcuaucaucaccagaaugaacaaggcucuggguacgccgcugaucuuaagagcacccagaacgcgaucgacgagauuacgaauaaagucaacuccgugaucgagaagaugaauacacaguuuaccgccguuggaaaagaguucaaccaccuggagaagcggauugaaaaucugaacaagaaaguggaugacggcuuccucgauaucuggaccuacaaugcugagcugcugguccuccuggaaaacgagcgcacacuugacuaucaugauagcaaugugaagaaccuguacgagaaagucagaucucagcucaagaacaaugccaaagaaauugggaacggauguuuugaguucuaucacaagugcgacaauaccuguauggaauccgugaagaacggcacauacgauuauccuaaauacagcgaggaagccaagcugaaucgggaggagaucgacgggguuaaacuugaaucuacgcgcaucuaucaaauucuggcuaucuacuccaccguggccagcucccucguccuggugguuucucugggcgcgauuagcuuuuggaugugcuccaacggaucucuccagugcagaaucuguauuuga

SEQ ID NO: 196773 - RNA, 1701 nt, Artificial Sequence; identical to SEQ ID NO: 185693
  derived and/or modified sequence opt5 from hemagglutinin__InfluenzaA__BAJ40007

SEQ ID NO: 196774 - RNA, 1701 nt, Artificial Sequence
  derived and/or modified sequence opt5 from hemagglutinin__InfluenzaA__BAJ40008
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacauugccgagcugcugguccuccuggaaaaugagcggacccuugacuaucaugauagcaacgugaaaaaucuguacgagaagguccgcucucagcucaaaaacaacgccaaggaaaucgggaauggauguuuugaguucuaucacaagugcgacaacacauguauggaauccgugaaaaauggcaccuacgauuauccuaaguacagcgaggaagcuaaacugaacagagaggagaucgacgggguuaaacuugaaucuacacggauuuaucaaauccuggccauuuacuccacgguggcgagcucccucguccuggugguuucucugggcgcuaucagcuuuuggaugugcuccaauggaucucuccagugccgcauuuguaucuga

SEQ ID NO: 196775 - RNA, 1701 nt, Artificial Sequence
  derived and/or modified sequence opt5 from hemagglutinin__InfluenzaA__BAJ40009
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccgacaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaauggauuacuauuggacccugguugaacccggagacaagauuacguucgaggccacaggcaaccugguggugccucgguacgcguuugccauggaacgcaaugcugggucuggaaucauuaucuccgacacccccguccauaacugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggauggaugguacggcuaucaucaccagaacgaacaaggcucuggguacgcugcggaccugaaaagcacacagaaugccaucgauaagauuaccaacaaagucaauuccgugaucgagaagaugaacacgcaguuuacagcuguuggaaaggaguucaaucaccuugaaaacagaauugagaaucugaacaaaaagguggacgauggcuuccucgacaucuggaccuacaaugccgaacugcugguccuccuggagaacgaacggacccuugauuaucaugacagcaaugugaaaaaccuguacgagaagguccgcucucagcucaaaaacaaugccaaggagauugggaacggauguuuugaguucuaucacaagugcgauaauacauguauggaguccgugaaaaacggcaccuacgacuauccuaaguacagcgaagaggcuaaacugaauagagaagagaucgaugggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 196776 - RNA, 1701 nt, Artificial Sequence
  derived and/or modified sequence opt5 from hemagglutinin__InfluenzaA__BAJ40010
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaacuccugucuacagccagcuccuggucuuacaucguggagaccagcuccucugacaacggcacgugcuauccgggggauuuuauugacuacgaagaacuucgggagcagcugagcuccgucagcucuuucgaacgcuuugagaucuuccccaagaccuccagcuggccuaaucacgauucugacaagggagugacagccgcuuguccccaugccggcgcgaaauccuuuuauaagaaccucaucuggcugguuaaaaagggcaauagcuacccuaaacuuucuaaguccuauauuaacgauaaggggaaagaagugcugguccucuggggaauccaccaccccagcaccuccgccgaccaacagucucuguaccagaaugcugaugccuacguguucgugggcacaagcagauauuccaagaaauuuaagccugagauugcuauccggccgaaaguccgcgaccaggaggggagaauggauuacuauuggacccugguugaacccggagacaagauuacguucgaggccacaggcaaccucguggugccucgguacgcguuugccauggaacgcaaugcugggagcggaaucauuaucucugacacccccguccauaacugcaacacaaccugucaaaccccuaaaggcgccaucaauacaucccugcccuuccagaacauucacccgaucacgauuggcaagugcccuaaguaugugaaaagcaccaaacuuagacuggcuacagggcuccggaauguucccucuauccagagccgcggacuguuuggcgccauugccggguucaucgagggaggcuggaccgggaugguggauggaugguacggcuaucaucaccagaacgaacaaggcuccggguacgcugcggaccuuaaaucuacacagaaugccaucgauaagauuaccaacaaagucaauagcgugaucgagaagaugaacacgcaguuuacagcuguuggaaaggaguucaaucaccuggaaaagagaauugagaaccucaauaagaaaguggacgauggcuuccuggacaucuggaccuacaacgccgaacugcucguccugcuugagaaugaacggacccuggauuaucaugacuccaacgugaagaaucucuacgagaaaguccgcagccagcugaagaacaacgccaaggagauugggaauggauguuuugaguucuaucacaaaugcgauaacacauguauggagucugugaagaauggcaccuacgacuauccuaaauacuccgaagaggcuaaacuuaacagagaagagaucgaugggguuaagcuggagagcacacggaucuaucaaauucucgccaucuacucuacgguggcguccagccugguccuggugguuucccucggcgcuauuucuuuuuggaugugcagcaauggaucccugcagugccgcaucuguauuuga

SEQ ID NO: 196777 - RNA, 1701 nt, Artificial Sequence; identical to SEQ ID NO: 196766
  derived and/or modified sequence opt5 from hemagglutinin__InfluenzaA__BAJ40011

SEQ ID NO: 196778 - RNA, 1701 nt, Artificial Sequence
  derived and/or modified sequence opt5 from hemagglutinin__InfluenzaA__BAJ40012
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggaucaaacuugaaucuacacggauuuaucaaauccuggccauuuacuccacgguugcgagcucccucgugcuggucgugucucugggcgcuaucagcuuuuggaugugcuccaacggaucucuccagugccgcauuuguaucuga

SEQ ID NO: 196779 - RNA, 1701 nt, Artificial Sequence; identical to SEQ ID NO: 196766
  derived and/or modified sequence opt5 from hemagglutinin__InfluenzaA__BAJ40013

SEQ ID NO: 196780 - RNA, 1701 nt, Artificial Sequence; identical to SEQ ID NO: 196766
  derived and/or modified sequence opt5 from hemagglutinin__InfluenzaA__BAJ40014

SEQ ID NO: 196781 - RNA, 1701 nt, Artificial Sequence
  derived and/or modified sequence opt5 from hemagglutinin__InfluenzaA__BAJ40015
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaauaccagcucuuggccuaaccacgauuccaauaagggagugacagccgcuuguccccaugccggcgccaagagcuuuuauaaaaaccugaucuggcucguuaagaaaggcaauucuuacccuaagcuguccaaaagcuauauuaacgacaaggggaaggaagugcuuguccuguggggaauccaccaccccuccaccucugccgaucaacagagccucuaccagaaugcugacacauacguguucgugggcaccuccagauauagcaaaaaguuuaaaccugagauugccauccggccgaagguccgcgaucaggaggggagaaugaacuacuauuggacgcugguugaacccggagacaaaauuacauucgaggcuaccggcaaccugguggugccucgguacgccuuugcgauggaacgcaaugccgggucuggaaucauuaucuccgauacacccguccaugacugcaacaccaccugucaaacaccuaagggcgcuaucaauacgagccuccccuuccagaacauucacccgaucaccauuggcaaaugcccuaaguaugugaagucuacaaaacugagacuugccaccgggcugcggaauguucccagcauccagucccgcggacucuuuggcgcuauugccggguucaucgagggaggcuggacagggaugguggacggaugguacggcuaucaucaccagaacgaacaaggcucuggguacgccgcugaucuuaagagcacccagaaugcgaucgacgagauuacgaacaaagucaauuccgugaucgagaagaugaacacacaguuuaccgccguuggaaaagaguucaaucaccuggagaagagaauugaaaaccugaauaagaaaguggaugacggcuuccucgauaucuggaccuacaacgcugagcugcugguccuccuggaaaaugagcggacacuugacuaucaugauagcaacgugaagaaccuguacgagaaaguccgcucucagcucaagaauaacgccaaagaaauugggaauggauguuuugaguucuaucacaagugcgacaacaccuguauggaauccgugaagaauggcacauacgauuauccuaaauacagcgaggaagccaagcugaacagagaggagaucgacgggguuaaacuugaaucuacgcggaucuaucaaauucuggcuaucuacuccaccguggccagcucccucguccuggugguuucucugggcgcgauuagcuuuuggaugugcuccaauggaucucuccagugccgcaucuguauuuga

SEQ ID NO: 196782 - RNA, 1701 nt, Artificial Sequence; identical to SEQ ID NO: 196766
  derived and/or modified sequence opt5 from hemagglutinin__InfluenzaA__BAJ40016

SEQ ID NO: 196783 - RNA, 1701 nt, Artificial Sequence
  derived and/or modified sequence opt5 from hemagglutinin__InfluenzaA__BAJ40017
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccaacucugacaauggcacgugcuauccgggggauuuuauugacuacgaagaacugcgggagcagcuuagcuccgucagcucuuucgaacgcuuugagaucuuccccaagaccuccagcuggccuaaccacgauucuaauaagggagugacagccgcuuguccccaugccggcgcgaaauccuuuuauaagaaccugaucuggcucguuaaaaagggcaauagcuacccuaaacugucuaaguccuauauuaacgacaaggggaaagaagugcuuguccuguggggaauccaccaccccagcaccuccgccgaucaacagucucucuaccagaaugcugacgccuacguguucgugggcacaagcagauauuccaagaaauuuaagccugagauugcuauccggccgaaaguccgcgaucaggaggggagaaugaacuacuauuggacccugguugaacccggagacaagauuacguucgaggccacaggcaaccugguggugccucgguacgcguuugccauggaacgcaaugcugggagcggaaucauuaucucugauacccccguccaugacugcaacacaaccugucaaaccccuaaaggcgccaucaauacaucccuccccuuccagaacauucacccgaucacgauuggcaagugcccuaaguaugugaaaagcaccaagcugagacuugcuacagggcugcggaauguucccucuauccagagccgcggacucuuuggcgccauugccggguucaucgagggaggcuggaccgggaugguggacggaugguacggcuaucaucaccagaacgaacaaggcuccggguacgcugcggaucugaaaucuacacagaaggccaucgacgagauuaccaauaaagucaacagcgugaucgagaagaugaauacgcaguuuacagcuguuggaaaggaguucaaccaccuugagaaaagaauugaaaaucugaacaagaaaguggaugacggcuuccucgauaucuggaccuacaaugccgagcugcugguccuccuggaaaacgagcggacccuugacuaucaugauuccaaugugaagaaccuguacgagaaaguccgcagccagcucaagaacaaugccaaggaaauugggaacggauguuuugaguucuaucacaaaugcgacaauacauguauggaaucugugaagaacggcaccuacgauuauccuaaauacuccgaggaagcuaagcugaauagagaggagaucgacgggguuaaacuugaaagcacacggaucuaucaaauucuggccaucuacucuacgguggcguccagccucguccuggugguuucccugggcgcuauuucuuuuuggaugugcagcaacggaucccuccagugccgcaucuguauuuga

SEQ ID NO: 196784 - RNA, 1701 nt, Artificial Sequence; identical to SEQ ID NO: 186857
  derived and/or modified sequence opt5 from hemagglutinin__InfluenzaA__BAJ40018

SEQ ID NO: 196785 - RNA, 1701 nt, Artificial Sequence; identical to SEQ ID NO: 196772
  derived and/or modified sequence opt5 from hemagglutinin__InfluenzaA__BAJ40019

SEQ ID NO: 196786 - RNA, 1701 nt, Artificial Sequence; identical to SEQ ID NO: 196772
  derived and/or modified sequence opt5 from hemagglutinin__InfluenzaA__BAJ40020

SEQ ID NO: 196787 - RNA, 1701 nt, Artificial Sequence
  derived and/or modified sequence opt5 from hemagglutinin__InfluenzaA__BAJ40021
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagaaacagccgcuuguccccaugccggcgcgaaaucuuuuuauaagaaucugaucuggcucgugaaaaagggcaacagcuacccuaaacuguccaagagcuauauuaaugacaaggggaaagagguucuugugcuguggggaauccaccaccccuccaccucugccgaucaacagagccucuaccagaacgcugacgccuacgucuucgugggcacauccagauauagcaagaaauuuaagccugagauugcuauccggccgaaagugcgcgaucaggaagggagaaugaauuacuauuggacccuggucgagcccggagacaagauuacguucgaagccacaggcaaccugguugugccucgguacgcguuugccauggagcgcaacgcugggucuggaaucauuaucuccgauacccccgugcaugacugcaauacaaccugucaaaccccuaaaggcgccaucaacacaagccuccccuuccagaauauucacccgaucacgauuggcaagugcccuaaguaugucaaaucuaccaagcugagacuugcuacagggcugcggaacgugcccagcauccagucccgcggacucuuuggcgccauugccggguucaucgaaggaggcuggaccgggaugguugacggaugguacggcuaucaucaccagaaugagcaaggcucuggguacgcugcggaucugaaaagcacacagaacgccaucgacaagauuaccaauaaagugaacuccgucaucgagaagaugaauacgcaguuuacagcugugggaaaggaguucaaccaccuugagaaaagaauugaaaaucugaacaagaaaguugaugacggcuuccucgauaucuggaccuacaaugccgagcugcuggugcuccuggaaaacgagcggacccuugacuaucaugauagcaaugucaagaaccuguacgagaaagugcgcucucagcucaagaacaaugccaaggaaauugggaacggauguuuugaguucuaucacaaaugcgacaauacauguauggaauccgucaagaacggcaccuacgauuauccuaaauacagcgaggaagcuaagcugaauagagaggagaucgacggggugaaacuugaaucuacacggaucuaucaaauucuggccaucuacuccacgguugcgagcucccucgugcuggucgugucucugggcgcuauuagcuuuuggaugugcuccaacggaucucuccagugccgcaucuguauuuga

SEQ ID NO: 196788 - RNA, 1701 nt, Artificial Sequence; identical to SEQ ID NO: 186857
  derived and/or modified sequence opt5 from hemagglutinin__InfluenzaA__BAJ40023

SEQ ID NO: 196789 - RNA, 1701 nt, Artificial Sequence
  derived and/or modified sequence opt5 from hemagglutinin__InfluenzaA__BAJ40024
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacacauacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacgagauuacgaauaaggucaacuccgugaucgagaaaaugaauacacaguuuaccgccguuggaaaggaguucaaccaccuugagaagagaauugaaaaucugaacaaaaagguggaugacggcuuccucgauaucuggaccuacaaugcugagcugcugguccuccuggaaaacgagcggacacuugacuaucaugauagcaaugugaaaaaccuguacgagaagguccgcucucagcucaaaaacaaugccaaggaaauugggaacggauguuuugaguucuaucacaagugcgacaauaccuguauggaauccgugaaaaacggcacauacgauuauccuaaguacagcgaggaagccaaacugaauagagagaagaucgacgggguuaaacuugagucuacgcggaucuaucaaauucuggcuaucuacuccaccguggccagcucccucguccuggugguuucucugggcgcgauuagcuuuuggaugugcuccaacggaucucuccagugccgcaucuguauuuga

SEQ ID NO: 196790 - RNA, 1701 nt, Artificial Sequence; identical to SEQ ID NO: 196766
  derived and/or modified sequence opt5 from hemagglutinin__InfluenzaA__BAJ40025

SEQ ID NO: 196791 - RNA, 1701 nt, Artificial Sequence; identical to SEQ ID NO: 186857
  derived and/or modified sequence opt5 from hemagglutinin__InfluenzaA__BAJ40026

SEQ ID NO: 196792 - RNA, 1701 nt, Artificial Sequence
  derived and/or modified sequence opt5 from hemagglutinin__InfluenzaA__BAJ40027
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagaaacagccgcuuguccccaugccggcgcgaaaucuuuuuauaagaaucugaucuggcucgugaaaaagggcaacagcuacccuaaacuguccaagagcuauauuaaugacaaggggaaagagguucuugugcuguggggaauccaccaccccuccaccucugccgaucaacagagccucuaccagaacgcugacgccuacgucuucgugggcacauccagauauagcaagaaauuuaagccugagauugcuauccggccgaaagugcgcgaucaggaagggagaaugaauuacuauuggacccuggucgagcccggagacaagauuacguucgaagccacaggcaaccugguugugccucgguacgcguuugccauggagcgcaacgcugggucuggaaucauuaucuccgauacccccgugcaugacugcaauacaaccugucaaaccccuaaaggcgccaucaacacaagccuccccuuccagaauauucacccgaucacgauuggcaagugcccuaaguaugucaaaucuaccaagcugagacuugcuacagggcugcggaacgugcccagcauccagucccgcggacucuuuggcgccauugccggguucaucgaaggaggcuggaccgggaugguugacggaugguacggcuaucaucaccagaaugagcaaggcucuggguacgcugcggaucugaaaagcacacagaacgccaucgacaagauuaccaauaaagugaacuccgucaucgagaagaugaauacgcaguuuacagcugugggaaaggaguucaaccaccuugagaaaagaauugaaaaucugaacaagaaaguugaugacggcuuccucgauaucuggaccuacaaugccgagcugcuggugcuccuggaaaacgagcggacccuugacuaucaugauagcaaugucaagaaccuguacgagaaagugaagucucagcucaagaacaaugccaaagaaauugggaacggauguuuugaguucuaucacaagugcgacaauacauguauggaauccgucaaaaacggcaccuacgauuauccuaaguacagcgaggaagcuaaacugaaucgcgaggagaucgacggggugaaacuugaaucuacaagaaucuaucaaauucuggccaucuacuccacgguugcgagcucccucgugcuggucgugucucugggcgcuauuagcuuuuggaugugcuccaacggaucucuccagugccggaucuguauuuga

SEQ ID NO: 196793 - RNA, 1701 nt, Artificial Sequence
  derived and/or modified sequence opt5 from hemagglutinin__InfluenzaA__BAJ40028
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccgcuuucaucgaagggggauggaccggcaugguggacgggugguacggauaucaucaccagaaugaacaaggcucuggcuacgcggccgaucugaaaagcacacagaacgcuaucgacaagauuaccaauaaagucaacuccgugaucgagaagaugaauacgcaguuuacagccguugggaaggaguucaaccaccuugagaaaagaauugagaaucugaacaagaaaguggaugacggauuccucgauaucuggaccuacaaugccgaacugcugguccuccuggagaacgaacggacccuugacuaucaugauagcaaugugaagaaccuguacgagaaaguccgcucucagcucaagaacaaugcuaaggagauuggcaacggguguuuugaguucuaucacaaaugcgacaauacauguauggaguccgugaagaacggaaccuacgauuauccuaaauacagcgaagaggccaagcugaauagagaagagaucgacggcguuaaacuugagucuacacggaucuaucaaauucuggcgaucuacuccacgguggcuagcucccucguccuggugguuucucugggggccauuagcuuuuggaugugcuccaacggcucucuccagugccgcaucuguauuuga

SEQ ID NO: 196794 - RNA, 1701 nt, Artificial Sequence; identical to SEQ ID NO: 196766
  derived and/or modified sequence opt5 from hemagglutinin__InfluenzaA__BAJ40029

SEQ ID NO: 196795 - RNA, 1701 nt, Artificial Sequence
  derived and/or modified sequence opt5 from hemagglutinin__InfluenzaA__BAJ40030
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauugacuacgaagaacugaaggagcagcuuuccagcgucucuuccuucgaacgguuugagaucuuccccaagaccagcucuuggccuaaucacgauuccaacaaaggagugacagccgcuuguccccaugccggcgccaagagcuuuuauaaaaaucugaucuggcucguuaagaaaggcaacucuuacccuaagcuguccaagagcuauauuaaugacaaagggcgcgaagugcuuguccuguggggaauccaccaccccuccaccucugccgaucaacagagccucuaccagaacgcugacacauacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacgagauuacgaauaaggucaacuccgugaucgagaaaaugaauacacaguuuaccgccguuggaaaggaguucaaccaccuugagaagagaauugaaaaucugaacaaaaagguggaugacggcuuccucgauaucuggaccuacaaugcugagcugcugguccuccuggaaaacgagcggacacuugacuaucaugauagcaaugugaaaaaccuguacgagaagguccgcucucagcucaaaaacaaugccaaggaaauugggaacggauguuuugaguucuaucacaagugcgacaauaccuguauggaauccgugaaaaacggcacauacgauuauccuaaguacagcgaggaagccaaacugaauagagaggagaucgacgggguuaaacuugaaucuacgcggaucuaucaaauucuggcuaucuacuccaccguggccagcucccucguccuggugguuucucugggcgcgauuagcuuuuggaugugcuccaacggaucucuccagugccgcaucuguauuuga

SEQ ID NO: 196796 - RNA, 1701 nt, Artificial Sequence; identical to SEQ ID NO: 185693
  derived and/or modified sequence opt5 from hemagglutinin__InfluenzaA__BAJ40031

SEQ ID NO: 196797 - RNA, 1701 nt, Artificial Sequence; identical to SEQ ID NO: 196766
  derived and/or modified sequence opt5 from hemagglutinin__InfluenzaA__BAJ40032

SEQ ID NO: 196798 - RNA, 1701 nt, Artificial Sequence; identical to SEQ ID NO: 196795
  derived and/or modified sequence opt5 from hemagglutinin__InfluenzaA__BAJ40033

SEQ ID NO: 196799 - RNA, 1701 nt, Artificial Sequence
  derived and/or modified sequence opt5 from hemagglutinin__InfluenzaA__BAJ40034
augaaggccauccuggugguccuccuguacaccuucgcuacagccaacgcggacacgcuuugcauuggcuaucacgcuaauaacagcaccgauacaguugacaccgugcuggagagaaaugugacagucacccauuccgugaaccuccuggaagauaagcacaaugggaagcuguguaaacugcggggaguugcgccccuccaucugggcaagugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgcgagcagcuuuccagcgucucuuccuucgaaagauuugagaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaagugcuuguccuguggggaauccaccaccccuccaccucugccgaucaacagagccucuaccagaacgcugacacauacguguucgugggcaccucccgguauagcaaaaaguuuaaaccugagauugccauccgcccgaaggucagagaucaggaggggcggaugaauuacuauuggacgcugguugaacccggagacaaaauuacauucgaggcuaccggcaaccugguggugccucgcuacgccuuugcgauggaaagaaacgccgggucuggaaucauuaucuccgauacacccguccaugacugcaauaccaccugucaaacaccuaagggcgcuaucaacacgagccuccccuuccagaauauucacccgaucaccauuggcaaaugcccuaaguaugugaagucuacaaaacugcggcuugccaccgggcugcgcaacguucccagcauccaguccagaggacucuuuggcgcuauugccggguucaucgagggaggcuggacagggaugguggacggaugguacggcuaucaucaccagaaugaacaaggcucuggguacgccgcugaucuuaagagcacccagaacgcgaucgacgagauuacgaauaaagucaacuccgugaucgagaagaugaauacacaguuuaccgccguuggaaaagaguucaaccaccuugagaagcggauugaaaaucugaacaagaaaguggaugacggcuuccucgauaucuggaccuacaaugcugagcugcugguccuccuggaaaacgagcgcacacuugacuaucaugauagcaaugugaagaaccuguacgagaaagucagaucucagcucaagaacaaugccaaagaaauugggaacggauguuuugaguucuaucacaagugcgacaauaccuguauggaauccgugaagaacggcacauacgauuauccuaaauacagcgaggaagccaagcugaaucgggagaaaaucgacgggguuaaacuugagucuacgcgcaucuaucaaauucuggcuaucuacuccaccguggccagcucccucguccuggugguuucucugggcgcgauuagcuuuuggaugugcuccaacggaucucuccagugcagaaucuguauuuga

SEQ ID NO: 196800 - RNA, 1701 nt, Artificial Sequence
  derived and/or modified sequence opt5 from hemagglutinin__InfluenzaA__BAJ40035
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacacauacguguucgugggcaccuccagauauagcaagaaauuuaagccugagauugccauccggccgaaaguccgcgaucaggaggggagaaugaauuacuauuggacgcugguugaacccggagacaagauuaaauucgaggcuacaggcaaccugguggugccucgguacgccuuugcgauggaacgcaacgccgggucuggaaucauuaucuccgauacccccguccaugacugcaauacaaccugucaaaccccuaagggcgcuaucaacacaagccuccccuuccagaauauucacccgaucacgauuggcaagugcccuaaauaugugaagucuaccaaacugagacuugccacagggcugcggaacguucccagcauccagucccgcggacucuuuggcgcuauugccggguucaucgagggaggcuggaccgggaugguggacggaugguacggcuaucaucaccagaaugaacaaggcucuggguacgccgcugaucuuaagagcacacagaacgcgaucgacgagauuaccaauaaagucaacuccgugaucgagaagaugaauacgcaguuuacagccguuggaaaggaguucaaccaccuggagaaaagaauugaaaaucugaacaagaaaguggaugacggcuuccucgauaucuggaccuacaaugcugagcugcugguccuccuggaaaacgagcggacccuugacuaucaugauagcaaugugaagaaccuguacgagaaaguccgcaaccagcucaagaauaacgccaaggaaauugggaauggauguuuugaguucuaucacaaaugcgacaacacauguauggaaucugugaagaauggcaccuacgauuauccuaaauacuccgaggaagccaagcugaacagagaggagaucgacgggguuaaacuugaaagcacacggaucuaucaaauucuggcuaucuacucuacgguggccuccagccucguccuggugguuucccugggcgcgauuucuuuuuggaugugcagcaauggaucccuccagugccgcaucuguauuuga

SEQ ID NO: 196801 - RNA, 1701 nt, Artificial Sequence
  derived and/or modified sequence opt5 from hemagglutinin__InfluenzaA__BAJ40036
augaaggccauccuggugguccucauuuacaccuucgcuacagccaacgcggacacgcugugcaucggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggaacauccagauauagcaagaaauuuaagccugagaucgcuauucggccgaaaguccgcgaucaggaggggagaaugaauuacuauuggaccaucguugaacccggagacaagauuacguucgaggccacaggcaaccucguggugccucgguacgcguuugccauggaacgcaacgcugggucuggaaucaucauuuccgauacccccguccaugacugcaauacaaccugucaaaccccuaaaggcgccaucaacacaagccugcccuuccagaauauucacccgaucacgauuggcaagugcccuaaguaugugaaaucuaccaagcugagacucgcuacagggcugcggaacguucccagcauccagucccgcggacuuuuuggcgccaucgccggguucauugagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccucgagaagagaauugaaaaucugaacaaaaagguggaugacggcuuccuugauaucuggaccuacaaugccgagcugcucguccugcuggaaaacgagcggacccucgacuaucaugauagcaaugugaaaaaccuguacgagaaggucaaaucucagcuuaagaacaaugccaaggaaaucgggaacggauguuuugaguucuaucacaaaugcgacaauacauguauggaauccgugaagaacggcaccuacgauuauccuaaauacagcgaggaagcuaagcugaaucgcgaggagauugacgggguuaaacucgaaucuacaagaaucuaucaaauucuggccaucuacuccacgguggcgagcucccuuguccuggugguuucucucggcgcuauuagcuuuuggaugugcuccaacggaucucugcagugccggaucuguauuuga

SEQ ID NO: 196802 - RNA, 1701 nt, Artificial Sequence; identical to SEQ ID NO: 192296
  derived and/or modified sequence opt5 from hemagglutinin__InfluenzaA__BAJ40037

SEQ ID NO: 196803 - RNA, 1701 nt, Artificial Sequence
  derived and/or modified sequence opt5 from hemagglutinin__InfluenzaA__BAJ40038
augaaggccauccugcucgugcugcuuuacaccuucgcuacagccaacgcggacacgcugugcauuggcuaucacgcuaauaacagcaccgauacagucgacaccguucucgagaagaaugugacagugacccauuccgucaaccugcuugaagauaagcacaaugggaaacuguguaagcucagaggaguggcuccccugcaucugggcaaaugcaacaucgccggguggauucucggaaauccugagugugaaucucugagcacagccuccucuuggagcuacaucguugagaccuccucuagcgacaacggcacgugcuauccgggggauuuuauugacuacgaagaacuucgggagcagcuguccagcgugucuuccuucgaacgcuuugagaucuuccccaagaccagcucuuggccuaaucacgauuccaacaagggagucacagccgcuuguccccaugccggcgcgaaaucuuuuuauaagaaucucaucuggcuggugaaaaagggcaacagcuacccuaaacuuuccaagagcuauauuaaugacaaggggaaagaaguucuggugcucuggggaauccaccaccccuccaccucugccgaucaacagagccuguaccagaacgcugacacauacgucuucgugggcaccuccagauauagcaagaaauuuaagccugagauugccauccggccgaaagugcgcgaucaggaggggagaaugaauuacuauuggacgauugucgaacccggagacaagaucacauucgaggcuaccggcaaccugguugugccucgguacgccuuugcgauggaacgcaacgccgggucuggaauuaucaucuccgauacacccgugcaugacugcaauaccaccugucaaacaccuaaaggcgcuauuaacacgagccuccccuuccagaauauccacccgauuaccaucggcaagugcccuaaguaugucaaaucuacaaagcugagacuugccaccgggcugcggaacgugcccagcauucagucccgcggacucuuuggcgcuaucgccggguucaucgagggaggcuggacagggaugguugacggaugguacggcuaucaucaccagaaugaacaaggcucuggguacgccgcugaucugaaaagcacccagaacgcgauugacgagaucacgaauaaggugaacuccgucauugagaaaaugaauacacaguuuaccgccgugggaaaggaguucaaccaccuugagaagagaaucgaaaaucugaacaaaaagguugaugacggcuuccucgauauuuggaccuacaaugcugagcugcuggugcuccuggaaaacgagcggacacuugacuaucaugauagcaaugucaaaaaccuguacgagaaggugcgcucucagcucaaaaacaaugccaaggaaaucgggaacggauguuuugaguucuaucacaagugcgacaauaccuguauggaauccgucaaaaacggcacauacgauuauccuaaguacagcgaggaagccaaacugaauagagaggagaucgacggggugaaacuugaaucuacgcggauuuaucaaauccuggcuauuuacuccaccguugccagcucccucgugcuggucgugucucugggcgcgaucagcuuuuggaugugcuccaacggaucucuccagugccgcauuuguaucuga

SEQ ID NO: 196804 - RNA, 1701 nt, Artificial Sequence; identical to SEQ ID NO: 185693
  derived and/or modified sequence opt5 from hemagglutinin__InfluenzaA__BAJ40039

SEQ ID NO: 196805 - RNA, 1701 nt, Artificial Sequence
  derived and/or modified sequence opt5 from hemagglutinin__InfluenzaA__BAJ40040
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggagagaagugcuuguccuguggggaauccaccaccccuccaccucugccgaucaacagagccucuaccagaacgcugacacauacguguucgugggcaccucccgguauagcaaaaaguuuaaaccugagauugccauccgcccgaaggucagagaucaggaggggcggaugaauuacuauuggacgcugguugaacccggagacaaaauuacauucgaggcuaccggcaaccugguggugccucgcuacgccuuugcgauggaaagaaacgccggguauggaaucauuaucucugauacacccguccaugacugcaauaccaccugucaaacaccuaagggcgcuaucaacacgucccuccccuuccagaauauucacccgaucaccauuggcaaaugcccuaaguacguuaagagcacaaaacugcggcuugccaccgggcugcgcaacgugcccucuauccagagcagaggacucuuuggcgcuauugccggguucaucgagggaggcuggacagggaugguggacggaugguauggcuaccaucaccagaaugaacaaggcuccggguacgccgcugaucugaagucuacccagaacgcgaucgacgagauuacgaauaaagucaacagcgugaucgagaagaugaauacacaguuuaccgccguuggaaaagaguucaaccaccuugagaagcggauugaaaaucugaacaagaaaguggaugacggcuuccucgauaucuggaccuauaaugcugagcugcugguccuccuggaaaacgagcgcacacuugacuaccaugauuccaaugugaagaaccuguaugagaaagucagaagccagcucaagaacaaugccaaagaaauugggaacggauguuuugaguucuaccacaagugcgacaauaccuguauggaaucugugaagaacggcacauaugauuacccuaaauauuccgaggaagccaagcugaaucgggaggagaucgacgggguuaaacuugaaagcacgcgcaucuaccaaauucuggcuaucuacucuaccguggccuccagccucguccuggugguuucccugggcgcgauuucuuuuuggaugugcagcaacggaucccuccagugcagaaucuguauuuga

SEQ ID NO: 196806 - RNA, 1701 nt, Artificial Sequence; identical to SEQ ID NO: 192296
  derived and/or modified sequence opt5 from hemagglutinin__InfluenzaA__BAJ40041

SEQ ID NO: 196807 - RNA, 1701 nt, Artificial Sequence
  derived and/or modified sequence opt5 from hemagglutinin__InfluenzaA__BAJ40042
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauugacuacgaagaacugaaggagccccuuuccagcgucucuuccuucgaacgguuugagaucuucccuaagaccagcucuuggcccaaucacgauuccaacaaaggagugacagccgcuuguccucaugccggcgccaagagcuuuuauaaaaaucugaucuggcucguuaagaaaggcaacucuuaccccaagcuguccaagagcuauauuaaugacaaagggcgcgaagugcuuguccuguggggaauccaccacccuuccaccucugccgauagacagagccucuaccaaaacgcugacacauacguguucgugggcaccucccgguauagcaagaaauuuaagccggagauugccauccgccccaaagucagagaucaggaggggcggaugaauuacuauuggacgcugguugaaccuggagacaagauuacauucgaggcuaccggcaaccugguggugccccgcuacgccuuugcgauggaaagaaacgccgggucuggaaucauuaucuccgauacaccuguccaugacugcaauaccaccugucagacacccaaaggcgcuaucaacacgagccucccguuccagaauauucacccuaucaccauuggcaagugccccaaguaugugaaaucuacaaagcugcggcuugccaccgggcugcgcaacguuccuagcauccaauccagaggacucuuuggcgcuauugccggguucaucgagggaggcuggacagggaugguggacggaugguacggcuaucaucaccagaaugaacagggcucuggguacgccgcugaucugaaaagcacccagaacgcgaucgacgagauuacgaauaaggucaacuccgugaucgagaaaaugaauacacaauuuaccgccguuggaaaggaguucaaccaccuugagaagcggauugaaaaucugaacaaaaagguggaugacggcuuccucgauaucuggaccuacaaugcugagcugcugguccuccuggaaaacgagcgcacacuugacuaucaugauagcaaugugaaaaaccuguacgagaaggucagaucucagcucaaaaacaaugccaaggaaauugggaacggauguuuugaguucuaucacaagugcgacaauaccuguauggaauccgugaaaaacggcacauacgauuaucccaaguacagcgaggaagccaaacugaaucgggaggagaucgacgggguuaaacuugaaucuacgcgcaucuaucagauucuggcuaucuacuccaccguggccagcucccucguccuggugguuucucugggcgcgauuagcuuuuggaugugcuccaacggaucucuccagugcagaaucuguauuuga

SEQ ID NO: 196808 - RNA, 1701 nt, Artificial Sequence; identical to SEQ ID NO: 192296
  derived and/or modified sequence opt5 from hemagglutinin__InfluenzaA__BAJ40043

SEQ ID NO: 196809 - RNA, 1701 nt, Artificial Sequence
  derived and/or modified sequence opt5 from hemagglutinin__InfluenzaA__BAJ40044
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauugacuacgaagaacagaaggagcaacuguccagcgucucuuccuucgaacgguuugagaucuuccccaagaccagcucuuggccuaaucacgauuccaacaaaggagugacagccgcuuguccccaugccggcgccaagagcuuuuauaaaaaucuuaucuggcugguuaagaaaggcaacucuuacccuaagcucuccaagagcuauauuaaugacaaagggaaggaagugcugguccuuuggggaauccaccaccccuccaccucugccgaucagcagagccuguaccagaacgcugacgccuacguguucgugggcacaucccgcuauagcaaaaaguuuaaaccugagauugcuaucagaccgaagguccgggaucaagaggggcgcaugaauuacuauuggacccucguugaacccggagacaaaauuacguucgaggccacaggcaaccugguggugccuagauacgcguuugccauggaaaucaacgcugggucuggaauuaucaucuccgauacccccguccaugacugcaauacaaccugucagaccccuaagggcgccauuaacacaagccugcccuuccagaauauccacccgauuacgaucggcaagugcccuaaauaugugaagucuaccaaacuccggcuggcuacagggcuucgcaacguucccagcauucaguccagaggacuguuuggcgccaucgccggguucaucgagggaggcuggaccgggaugguggacggaugguacggcuaucaucaccaaaaugaacagggcucuggguacgcugcggaucucaagagcacacagaacgccauugacaaaaucaccaauaaggucaacuccgugauugagaagaugaauacgcaguuuacagcuguuggaaaagaguucaaccaccuggaaaagcggaucgagaaucuuaacaaaaagguggaugacggcuuccuggauauuuggaccuacaaugccgaacuccugguccugcucgagaacgaacgcacccuggacuaucaugauagcaaugugaaaaaccuuuacgagaaggucagaucucaacugaagaacaaugccaaagagaucgggaacggauguuuugaguucuaucacaagugcgacaauacauguauggaguccgugaaaaacggcaccuacgauuauccuaaguacagcgaagaggcuaaacucaaucgggaagagaucgacgggguuaagcuggagucuacacgcauuuaucagauccuugccauuuacuccacgguggcgagcucccugguccucgugguuucucugggcgcuaucagcuuuuggaugugcuccaacggaucucugcagugcagaauuuguaucuga

SEQ ID NO: 196810 - RNA, 1701 nt, Artificial Sequence; identical to SEQ ID NO: 196772
  derived and/or modified sequence opt5 from hemagglutinin__InfluenzaA__BAJ40045

SEQ ID NO: 196811 - RNA, 1701 nt, Artificial Sequence
  derived and/or modified sequence opt5 from hemagglutinin__InfluenzaA__BAJ40046
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggccggugcaacaucgccggguggauucugggaaauccugagugugaaucucucagcacagccuccucuuggagcuacaucguggagaccuccauuucugacaacggcacgugcuauccgggggauuuuaucgacuacgaggaacugaaagagcagcuuagcuccgucagcucuuucgaacgcuuugagaucuuccccaagaccuccagcuggccuaaucacgauucuaacaagggagugacagccgcuuguccccaugccggcgcgaaauccuuuuauaagaaucugauuuggcucguuaaaaagggcaacagcuacccuaaacugucuaaguccuauaucaaugacaaggggaaagaagugcuuguccuguggggcauucaccaccccagcaccuccgccgaucaacagucucucuaccagaacgcugacgccuacguguucgugggaacaagcagauauuccaagaaauuuaagccugagaucgcuauucggccgaaaguccgcgaucaggaggggagaaugaauuacuauuggacccugguugaacccggagacaagaucacguucgaggccacaggcaaccugguggugccucgguacgcguuugccauggaacgcaacgcugggagcggaauuaucaucucugauacccccguccaugacugcaauacaaccugucaaaccccuaaaggcgccauuaacacaucccuccccuuccagaauauccacccgauuacgaucggcaagugcccuaaguaugugaaaagcaccaagcugagacuugcuacagggcugcggaacguucccucuauucagagccgcggacucuuuggcgccaucgccggguucaucgagggaggcuggaccgggaugguggacggaugguacggcuaucaucaccagaaugaacaaggcuccggguacgcugcggaucugaaaucuacacagaacgccauugacaagaucaccaauaaagucaacagcgugauugagaagaugaauacgcaguuuacagcuguuggaaaggaguucaaccaccuugaaaagaagaucgagaaucugaacaaaaagguggaugacggcuuccucgauauuuggaccuacaaugccaaacugcugguccuccuggaaaacgagagaacccuugacuaucaugauuccaaugugaagaaccuguacgaaaagguccggagccagcucaaaaacaaugccaaggagaucgggaacggauguuuugaguucuaucacaaaugcgacaauacauguauggaaucugugaagaacggcaccuacgauuauccuaaauacuccgaggaagcuaagcugaaucgcgaggaaaucgacgggguuaaacuugagagcacaagaauuuaucaaauccuggccauuuacucuacgguggcguccagccucguccuggugguuucccugggcgcuaucucuuuuuggaugugcagcaacggaucccuccagugccggauuuguaucuga

SEQ ID NO: 196812 - RNA, 1701 nt, Artificial Sequence; identical to SEQ ID NO: 196795
  derived and/or modified sequence opt5 from hemagglutinin__InfluenzaA__BAJ40047

SEQ ID NO: 196813 - RNA, 1701 nt, Artificial Sequence; identical to SEQ ID NO: 196766
  derived and/or modified sequence opt5 from hemagglutinin__InfluenzaA__BAJ40048

SEQ ID NO: 196814 - RNA, 1701 nt, Artificial Sequence
  derived and/or modified sequence opt5 from hemagglutinin__InfluenzaA__BAJ40050
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauugacuacgaagaacugaaggagcagcuuuccagcgucucuuccuucgaacgguuugagaucuuccccaagaccagcucuuggccuaaucacgauuccaacaaaggagugacagccgcuuguccccaugccggcgccaagagcuuuuauaaaaaucugaucuggcucguuaagaaaggcaacucuuacccuaagcuguccaagagcuauauuaaugacaaagggaaggaagugcuuguccuguggggaauccaccaccccuccaccucugccgaucaacagagccucuaccagaacgcugacgccuacguguucgugggcacaucccgcuauagcaaaaaguuuaaaccugagauugcuaucagaccgaagguccgggaucaggaggggcgcaugaauuacuauuggacccugguugaacccggagacaaaauuacguucgaggccacaggcaaccugguggugccuagauacgcguuugccauggaacggaacgcugggucuggaaucauuaucuccgauacccccguccaugacugcaauacaaccugucaaaccccuaagggcgccaucaacacaagccuccccuuccagaauauucacccgaucacgauuggcaagugcccuaaauaugugaagucuaccaaacugcgccuugcuacagggcugagaaacguucccagcauccagucccggggacucuuuggcgccauugccggguucaucgagggaggcuggaccgggaugguggacggaugguacggcuaucaucaccagaaugaacaaggcucuggguacgcugcggaucuuaagagcacacagaacgccaucgacaaaauuaccaauaaggucaacuccgugaucgagaagaugaauacgcaguuuacagcuguuggaaaagaguucaaccaccuugaaaagcgcauugagaaucugaacaaaaagguggaugacggcuuccucgauaucuggaccuacaaugccgaacugcugguccuccuggagaacgaaagaacccuugacuaucaugauagcaaugugaaaaaccuguacgagaagguccggucucagcucaagaacaaugccaaagagauugggaacggauguuuugaguucuaucacaagugcgacaauacauguauggaguccgugaaaaacggcaccuacgauuauccuaaguacagcgaagaggcuaaacugaaucgcgaagagaucgacgggguuaagcuggagucuacaagaaucuaucaaauucuggccaucuacuccacgguggcgagcucccucguccuggugguuucucugggcgcuauuagcuuuuggaugugcuccaacggaucucuccagugccggaucuguauuuga

SEQ ID NO: 196815 - RNA, 1701 nt, Artificial Sequence; identical to SEQ ID NO: 186857
  derived and/or modified sequence opt5 from hemagglutinin__InfluenzaA__BAJ40051

SEQ ID NO: 196816 - RNA, 1701 nt, Artificial Sequence
  derived and/or modified sequence opt5 from hemagglutinin__InfluenzaA__BAJ40052
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggagagaagugcuuguccuguggggaauccaccaccccuccaccacagccgaucaacagucucucuaccagaacgcugacaccuacguguucgugggcacgagccgguauuccaaaaaguuuaaaccugagauugccauccgcccgaaggucagagaucaggaggggcggaugaauuacuauuggacacugguugaacccggagacaaaauuaccuucgaggcuacaggcaaccugguggugccucgcuacgccuuugcgauggaaagaaacgccgggagcggaaucauuaucucugauacccccguccaugacugcaauaccacaugucaaacgccuaagggcgcuaucaacaccucccuccccuuccagaauauucacccgaucacaauuggcaaaugcccuaaguauguuaagagcaccaaacugcggcuugccacagggcugcgcaacgugcccucuauccagagcagaggacucuuuggcgcuauugccggguucaucgagggaggcuggaccgggaugguggacggaugguacggcuaucaucaccagaaugaacaaggcuccggguacgccgcugaucugaagucuacgcagaacgcgaucgacgagauuacaaauaaagucaacagcgugaucgagaagaugaauacccaguuuaccgccguuggaaaagaguucaaccaccuugagaagcggauugaaaaucugaacaagaaaguggaugacggcuuccucgauaucuggacauacaaugcugagcugcugguccuccuggaaaacgagcgcacccuugacuaucaugauuccaaugugaagaaccuguacgagaaagucagaagccagcucaagaacaaugccaaagaaauugggaacggauguuuugaguucuaucacaagugcgacaauacauguauggaaucugugaagaacggcacguacgauuauccuaaauacuccgaggaagccaagcugaaucgggaggagaucgacgggguuaaacuugaaagcacccgcaucuaucaaauucuggcuaucuacucuacaguggccuccagccucguccuggugguuucccugggcgcgauuucuuuuuggaugugcagcaacggaucccuccagugcagaaucuguauuuga

SEQ ID NO: 196817 - RNA, 1701 nt, Artificial Sequence
  derived and/or modified sequence opt5 from hemagglutinin__InfluenzaA__BAJ40053
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacacauacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacgagauuacgaauaaggucaacuccgugaucgagaaaaugaauacacaguuuaccgccguuggaaaggaguucaaccaccuugagaagagaauugaaaaucugaacaaaaagguggaugacggcuuccucgauaucuggaccuacaaugcugagcugcugguccuccuggaaaacgagcggacacuugacuaucaugauagcaaugugaaaaaccuguacgagaagguccgcaaccagcucaaaaauaacgccaaggaaauugggaauggauguuuugaguucuaucacaagugcgacaacaccuguauggaaucugugaaaaauggcacauacgauuauccuaaguacuccgaggaagccaaacugaacagagaggagaucgacgggguuaaacuugaaagcacgcggaucuaucaaauucuggcuaucuacucuaccguggccuccagccucguccuggugguuucccugggcgcgauuucuuuuuggaugugcagcaauggaucccuccagugccgcaucuguauuuga

SEQ ID NO: 196818 - RNA, 1701 nt, Artificial Sequence; identical to SEQ ID NO: 186857
  derived and/or modified sequence opt5 from hemagglutinin__InfluenzaA__BAJ40054

SEQ ID NO: 196819 - RNA, 1701 nt, Artificial Sequence
  derived and/or modified sequence opt5 from hemagglutinin__InfluenzaA__BAJ40055
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucuacagaucaacagagccucuaccagaacgccgacaccuacguguucgugggcacguccagauauagcaagaaauuuaagccugagauugcuauccggccgaaaguccgcgaucaggaggggagaaugaauuacuauuggacacugguugaacccggagacaagauuaccuucgaggccacaggcaaccugguggugccucgguacgcuuuugccauggaacgcaacgcggggucuggaaucauuaucuccgauacccccguccaugacugcaauaccaucugucaaacaccuaaaggcgccauuaacacgagccuccccuuccagaauauccacccgauuaccaucggcaagugcccuaaguaugugaaaucuacaaagcugagacuugcuaccgggcugcggaacguucccagcgugcagucccgcggacucuuuggcgccauugcuggguucaucgagggaggcuggacagggauggucgacggaugguacggcuaucaucaccagaaugaacaaggcucuggguacgccgccgaucugaaaagcacccagaacgcuaucgacgagauuacgaauaaggugaacuccguuaucgagaaaaugaauacacaguuuaccgcggugggaaaggaguucaaccaccuugagaagagaauugaaaaucugaacaaaaaggucgaugacggcuuccucgauaucuggaccuacaaugccgagcugcuggugcuccuggaaaacgagcggacacuugacuaucaugauagcaaugucaaaaaccuguacgagaaggugcgcucucagcucaaaaacaaugcuaaggaaauugggaacggauguuuugaguucuaucacaagugcgacaauaccuguauggaauccguuaaaaacggcacauacgauuauccuaaguacagcgaggaagccaaacugaauagagaggagaucgacggggugaaacuugaaucuacgcggaucuaucaaauucuggccaucuacuccaccgucgcuagcucccucgugcugguugugucucugggcgccauuagcuuuuggaugugcuccaacggaucucuccagugccgcaucuguauuuga

SEQ ID NO: 196820 - RNA, 1701 nt, Artificial Sequence
  derived and/or modified sequence opt5 from hemagglutinin__InfluenzaA__BAJ40056
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaacuccugucuacagccagcuccuggucuuacaucguggagaccagcuccucugacaacggcacgugcuauccgggggauuuuauugacuacgaagaacuucgggagcagcugagcuccgucagcucuuucgaacgcuuugagaucuuccccaagaccuccagcuggccuaaucacgauucuaacaagggagugacagccgcuuguccccaugccggcgcgaaauccuuuuauaagaaucucaucuggcaaguuaaaaagggcaacagcuacccuaaacugucuaaguccuauauuaaugacaaggggaaagaagugcuuguccuguggggaauccaccaccccagcaccuccgccgaucagcagucucucuaccagaacgcugacgccuacguguucgugggcacaagcagauauuccaagaaauuuaagccugagauugcuauccggccgaaaguccgcgaucaagaggggagaaugaauuacuauuggacccugguugaacccggagacaagauuacguucgaggccacaggcaaccugguggugccucggcaugcguuugccauggaacgcaacgcugggagcggaaucauuaucucugauacccccguccacaauugcaacacaaccugucagaccccuaaaggcgccaucaauacaucccuccccuuccagaacauucauccgaucacgauuggcaagugcccuaaguacgugaaaagccccaagcugagacuugcuaccgggcugcggaauguuccuucuauccagagccgcggacucuuuggcgccauugccggguucaucgagggaggcuggacagggaugguggacggaugguauggcuaccaccaccaaaacgaacagggcuccggguaugcugcggaccugaaaucuacccagaaugccaucgauaagauuacaaacaaagucaauagcgugaucgagaagaugaacacccaguuuacggcuguuggaaaggaguucaaucaucuugagaaaagaauugagaaccugaauaagaaaguggacgauggcuuccucgacaucuggacauacaacgccgaacugcugguccuccuggagaaugaacggacccuugauuaccacgacuccuaugugaagaaccuguacgagaaaguccgcagccaacucaagaacaaugccaaggagauugggaacggauguuuugaguucuaucauaaaugcgauaauaccuguauggaaucugugaagaacggcacauacgacuaucccaaauacuccgaagaggcuaagcugaauagagaagagaucgaugggguuaaacuugagagcacccggaucuaucagauucuggccaucuacucuacaguggcguccagccucguccuggugguuucccugggcgcuauuucuuuuuggaugugcagcaacggaucccuccagugccgcaucuguauuuga

SEQ ID NO: 196821 - RNA, 1701 nt, Artificial Sequence
  derived and/or modified sequence opt5 from hemagglutinin__InfluenzaA__BAJ40057
augaaggccauccuggugguccuccuguacaccuucgcuacagccaacgcggacacgcuuugcauuggcuaucacgcuaauaacagcaccgauacaguugacaccgugcuggagagaaaugugacagucacccauuccgugaaccuccuggaagauaaacacaaugggaagcuguguaaacugcggggaguugcgccccuccaucugggcaagugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgcgagcagcuuuccagcgucucuuccuucgaaagauuugagaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaagugcuuguccuguggggaauccaccaccccuccaccucugccgaucaacagagccucuaccagaacgcugacacauacguguucgugggcaccucccgguauagcaaaaaguuuaaaccugagauugccauccgcccgaaggucagagaucaggaggggcggaugaauuacuauuggacgcugguugaacccggagacaaaauuacauucgaggcuaccggcaaccugguggugccucgcuacgccuuugcgauggaaagaaacgccgggucuggaaucauuaucuccgauacacccguccaugacugcaauaccaccugucaaacaccuaagggcgcuaucaacacgagccuccccuuccagaauauucacccgaucaccauuggcaaaugcccuaaguaugugaagucuacaaaacugcggcuugccaccgggcugcgcaacguucccagcauccaguccagaggacucuuuggcgcuauugccggguucaucgagggaggcuggacagggaugguggacggaugguacggcuaucaucaccagaaugaacaaggcucuggguacgccgcugaucuuaagagcacccagaacgcgaucgacgagauuacgaaugaggucaacuccgugaucgaaaagaugaauacacaguuuaccgccguuggaaaggaguucaaccaccuugaaaaacggauugagaaucugaacaagaagguggaugacggcuuccucgauaucuggaccuacaaugcugaacugcugguccuccuggagaacgagcgcacacuugacuaucaugauagcaaugugaaaaaccuguacgaaaaggucagaucucagcucaaaaacaaugccaaggagauugggaacggauguuuugaguucuaucacaaaugcgacaauaccuguauggaguccgugaagaacggcacauacgauuauccuaaguacagcgaagaggccaaacugaaucgggaggaaaucgacgggguuaaacuugagucuacgcgcaucuaucaaauucuggcuaucuacuccaccguggccagcucccucguccuggugguuucucugggcgcgauuagcuuuuggaugugcuccaacggaucucuccagugcagaaucuguauuuga

SEQ ID NO: 196822 - RNA, 1701 nt, Artificial Sequence; identical to SEQ ID NO: 192296
  derived and/or modified sequence opt5 from hemagglutinin__InfluenzaA__BAJ40058

SEQ ID NO: 196823 - RNA, 1701 nt, Artificial Sequence; identical to SEQ ID NO: 196766
  derived and/or modified sequence opt5 from hemagglutinin__InfluenzaA__BAJ40059

SEQ ID NO: 196824 - RNA, 1701 nt, Artificial Sequence; identical to SEQ ID NO: 186857
  derived and/or modified sequence opt5 from hemagglutinin__InfluenzaA__BAJ40060

SEQ ID NO: 196825 - RNA, 1701 nt, Artificial Sequence
  derived and/or modified sequence opt5 from hemagglutinin__InfluenzaA__BAJ40061
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaaggccagcucuuggccuaaucacgauuccaacaagggagugaccgcugccuguccccaugcgggcgccaagagcuuuuauaaaaaucugaucuggcucguuaaaaagggcaacucuuacccuaaacuguccaagagcuauauuaaugacaaggggaaagaagugcuuguccuguggggaauccaccaccccuccacaucugcugaucaacagagccucuaccagaacgccgacgcuuacguguucgugggcaccuccagauauagcaagaaauuuaagccugagauugccauccggccgaaaguccgcgaucaggaggggagaaugaauuacuauuggacacugguugaacccggagacaagauuaccuucgaggcgacgggcaaccugguggugccucgguacgccuuugcuauggaacgcaacgccgggucuggaaucauuaucuccgauacacccguccaugacugcaauaccacaugucaaaccccuaaaggcgcuaucaacaccagccuccccuuccagaauauucacccgaucacaauuggcaagugcccuaaguaugugaaaucuacgaagcugagacuugccaccgggcugcggaacguucccagcauccagucccgcggacucuuuggcgccauugcuggguucaucgagggaggcuggacagggaugguggacggaugguacggcuaucaucaccagaaugaacaaggcucuggguacgcggccgaucugaaaagcacccagaacgcuaucgacaagauuacaaauaaagucaacuccgugaucgagaagaugaauacccaguuuacggccguuggaaaggaguucaaccaccuugagaaaagaauugagaaucugaacaagaaaguggaugacggcuuccucgauaucuggacauacaaugccgaacugcugguccuccuggagaacgaacggacccuugacuaucaugauagcaaugugaagaaccuguacgagaaaguccgcucucagcucaagaacaaugcuaaggagauugggaacggauguuuugaguucuaucacaaaugcgacaauaccuguauggaauccgugaagaacggcacauacgauuauccuaaauacagcgaagaggccaagcugaauagagaagagaucgacgggguuaaacuugagucuacccggaucuaucaaauucuggcgaucuacuccacaguggcuagcucccucguccuggugguuucucugggcgccauuagcuuuuggaugugcuccaacggaucucuccagugccgcaucuguauuuga

SEQ ID NO: 196826 - RNA, 1701 nt, Artificial Sequence
  derived and/or modified sequence opt5 from hemagglutinin__InfluenzaA__BAJ40062
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacacauacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacgagauuacgaauaaggucaacuccgugaucgagaaaaugaauacacaguuuaccgccguuggaaaggaguucaaccaccuugagaagaaaauugaaaaucugaacaagaaaguggaugacggcuuccucgauaucuggaccuacaaugcugagcugcugguccuccuggaaaacgagagaacacuugacuaucaugauagcaaugugaagaaccuguacgagaaaguccggucucagcucaagaacaaugccaaggaaauugggaacggauguuuugaguucuaucacaaaugcgacaauaccuguauggaauccgugaagaacggcacauacgauuauccuaaauacagcgaggaagccaagcugaaucgcgaggagaucgacgggguuaaacuugaaucuacgagaaucuaucaaauucuggcuaucuacuccaccguggccagcucccucguccuggugguuucucugggcgcgauuagcuuuuggaugugcuccaacggaucucuccagugcaagaucuguauuuga

SEQ ID NO: 196827 - RNA, 1701 nt, Artificial Sequence; identical to SEQ ID NO: 196825
  derived and/or modified sequence opt5 from hemagglutinin__InfluenzaA__BAJ40063

SEQ ID NO: 196828 - RNA, 1701 nt, Artificial Sequence; identical to SEQ ID NO: 192296
  derived and/or modified sequence opt5 from hemagglutinin__InfluenzaA__BAJ40064

SEQ ID NO: 196829 - RNA, 1707 nt, Artificial Sequence
  derived and/or modified sequence opt5 from hemagglutinin__InfluenzaA__BAK23398
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugagagauugcagcguugcgggcuggcuccuggggaacccuaugugugacgaguuccugaaugugccggaaugguccuauaucgucgagaagauuaaccccgugaaugaucucugcuacccuggaaacuuuaaugacuaugaggaacugaagcaucuucugucucggaucaaccacuucgagaaaauucagaucuuucccaagagcuccuggucugaucaugaagcuagcuccggcguuagcucugccuguccuuaccaggggcgcuccagcuucuuuagaaauguggucuggcucgugaaaaaggacaacgccuaucccaccauuaaaaagucuuacaauaacacaaaucaagaggaucugcuuauccuguggggcauucaccacccuaacgacgcugccgagcagacccggcucuaucagaacccgacaaccuacaucuccgugggaacgagcacccugaaucagcgccugguccccaagaucgcuacaagaucuaaaguuaacggccaauccgggcggauugaguucuuuuggaccauccucaagagcaaugaugugauuaacuucgaauccaauggaaacuuuaucgccccugaaaaugcguacaaaauugugaagaaaggcgacucuacaaucaugaaaagcgagcuggaauaugggaacugcaauaccaaaugucagacgcccaucggagccauuaacuccagcaugccuuuccauaauauccacccccuuacaauuggcgagugcccgaaguacgucaagucuaaccgccuggugcucgcuaccgggcugagaaauuccccucggggagagcgcagacggaaaaagcgcggccuuuuuggcgccaucgcuggguucauugaaggaggcuggcaggggaugguugacggaugguauggcuaccaucacagcaacgagcaggggucuggauaugccgcggauaaagaaagcacacaaaaggccaucgacggcgugaccaauaaagucaacuccaucauugauaagaugaacacccaguuugaggcugugggcagagaguucaauaaccuggaacggcgcaucgagaaucucaacaagaaaauggaagacggguuccuggauguuuggacauacaaugccgagcugcucgugcugauggaaaacgagagaacgcuugacuuucacgauucuaaugucaagaaccuguaugacaaagugcggcuccagcugagagauaaugcuaaggaacuuggaaacggcuguuucgaguuuuaccaucgcugcgacaaugaguguauggaaagcgucaaaaacgggaccuacgauuauccccaauacuccgaggaagcccggcugaagagagaggagauuagcggagugaagcucgaaucuaucggcacauaucagauucuguccaucuacagcaccguugccucuucccuggcucucgcgauuaugauggccgggcuguuccuuuggaugugcagcaauggcucccugcagugccgcaucuguaucuga

SEQ ID NO: 196830 - RNA, 1707 nt, Artificial Sequence
  derived and/or modified sequence opt5 from hemagglutinin__InfluenzaA__BAK23400
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucugaacggagugaaaccccuuauccugagagacugcagcguugcgggcuggcuccuggggaauccuaugugugaugaguuccugaacgugccggaaugguccuauaucgucgagaagauuaaucccgcuaacgaccucugcuacccuggagauuuuaaugacuaugaggaacugaagcaucuucugucucggaucaaccacuucgagaaaauucagaucauucccaagagcuccuggucugaucaugaagccagcuccggcgugagcucugccuguccuuaccaggggcgcuccagcuuuuucagaaauguuguguggcucaucaaaaaggacaacgcuuaucccaccauuaaacggucuuacaauaacacaaaucaagaggaucugcuuguccuguggggaauccaccacccuaacgacgccgcugagcagacccgccucuaucauaacccgacaaccuacaucuccgugggcacgagcacccugaaucagagacuggugcccaagauugccacacggucuaaggucaacggccaguccgggcgcauggaauuuuucuggaccauccucaaaccuaaugaugcgauuaacuuugagagcaauggaaacuucaucgcccccgaaaaugcuuacaagauuguuaaaaagggcgacuccacaaucaugaaaucugagcuggaauaugggaacugcaauaccaagugucaaacgccuaucggagccauuaacagcuccaugcccuuucacaauauccauccgcuuacaauuggcgagugcccuaaauacgugaaaagcucuagacuggugcucgcuaccgggcugcggaacagcccccagggaaagucccgccggaaaaagagaggccuuuucggcgccaucgcgggguuuauugagggaggcuggcaggggauggucgacggaugguauggcuaccaccacucuaaugaacaggggagcggauaugccgcugauaaagaguccacacaacgcgccaucgacggcgugaccaacaagguuaauucuaucauugauaaaaugaacacccaguucgaagcugugggcagagaguuuaacaaucuggaacggcgcaucgagaaccucaauaagaagauggaggacggguuccuggaugucuggacauacaacgccgaacugcucgugcugauggagaaugaaagaacgcuugacuuccaugauagcaacguuaaaaaucuguaugacaaggugcggcuccagcugagagauaacgccaaagagcuuggaaauggcuguuuugaguucuaccaccgcugcgacaacgaauguauggaguccguccggaaugggaccuacgauuauccucaauacagcgaagaggcuagacugaagcgcgaagagauuucuggagugaaacucgaguccaucggcauuuaucagauccugagcauuuacucuacagucgcguccagccuggcccucgcuaucaugguggccgggcuguuucuuuggaugugcuccaacggcucucugcagugccggaucuguauuuga

SEQ ID NO: 196831 - RNA, 1707 nt, Artificial Sequence
  derived and/or modified sequence opt5 from hemagglutinin__InfluenzaA__BAK23401
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggagaaaacacacaaugggaagcucugugaucuggacggagugaaaccccuuauccugagagauugcagcguugcgggcuggcuccuggggaacccuaugugugacgaguuccugaauguguccgaauggucuuauaucgucgagaagauuaacccggcuaaugaucucugcuaccccggaaacuuuaauaacuaugaggaacugaagcaucuucugagccggaucaaucgcuucgagaaaauucagaucauuccuaaguccucuuggcccgaccacgaagccagccucggcguguccagcgccuguccuuaccaagggggacccucuuuuuauagaaacguuguguggcugaucaaaaagaauaacaccuacccuauuaucaaaaaguccuaucauaauacaaaccaggaggaucuucugguccucuggggcauccaccacccgaacgacgaggaagaacagacccggauuuacaagaaucccacaaccuacaucagcgugggcacgucuacccugaaccagcgccuggugccuaaaauugcuacaagauccaaggucaaugggcagagcggacggguugaguucuuuuggaccauccucaaaucuaacgauacaauuaauuucgaauccaacggcaauuuuaucgcccccgaaaacgcuuauaagaucgugaaaaagggggacagcaccauuaugaaauccgagcuggaguacggaaauugcaacacgaagugucaaacaccuaucggcgccauuaauucuagcaugcccuuccauaacauccacccgcuuaccauuggggaaugcccuaaguaugugaaauccaaucgccugguccucgcgacaggacugagaaacagcccccagggcgagcggcgcagaaagaaacggggccuuuuuggggccaucgcuggauucaucgaaggcggguggcagggaaugguggauggcugguacggguaucaucacucuaaugagcagggauccggcuacgccgcugacaaggaaagcacccaaaaagccauugacggcguuaccaacaaggugaacucuaucauugauaagaugaauauccaguuugaggcggucgggcgcgaguucaacaaucuggaaagacggauugagaaccucaauaaaaagauggaagacggauuucuggauguguggacauauaacgccgagcugcucguucugauggaaaaugagcgcacgcuugacuuccacgauagcaacgugaaaaaucuguacgacaaggucagacuccagcugcgggauaacgcuaaagagcuuggcaauggguguuucgaauuuuaccauagaugcgacaacgaguguauggaauccgugcgcaauggaaccuaugauuacccucaauauucugaggaggcccggcugaagagagaagagaucagcggcgucaagcucgaauccauugggacauaccagauccugagcaucuauucuaccguggcuuccagccuggcccucgccauuaugguugcuggccuguuccuuuggaugugcucuaacggaucccugcagugccgcaucuguauuuga

SEQ ID NO: 196832 - RNA, 1707 nt, Artificial Sequence
  derived and/or modified sequence opt5 from hemagglutinin__InfluenzaA__BAK23402
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucugugaucuggacggagugaaaccccuuauccugagagauugcagcguugcgggcuggcuccuggggaacccuaugugugacgaguuccugaaugugccggaaugguccuauaucgucgagaagauuaaccccgcuaaugaucucugcuacccuggaaacuuuaaugacuaugaggaacugaagcaucuucugucucggaucaaccacuucgagaaaauucagaucauucccaagagcuccuggucuaaucaugaagccagcuccggcgugagcucugccuguccuuaccaggggcgcuccagcuuuuucagaaacguuguguggcucaucaaaaaggauaaugcuuaucccaccauuaaaaucucuuacaacaauacaaaccaagaggaccugcuuguccuguggggaauccaccacccuaacgaugccgcugagcagacccggcucuaucagaauccgacaaccuacauuuccgugggcacgagcacccugaaccagcgccuggugcccaagaucgccacaagaucuaaggucaauggccaauccgggcggauggaauuuuucuggaccauucucaaaagcaacgacgcgaucaauuuugaguccaacggaaauuucauugccccugaaaacgcuuacaagaucguuaaaaagggcgauucuacaaucaugaaaagcgagcuggaauaugggaauugcaacaccaagugucagacgcccauuggagccaucaauuccagcaugccuuuucauaacacacacccccuuaccauuggcgagugcccgaaauacgugaagucuaaucgccuggugcucgcuacagggcugagaaacuccccucauggagagcggcgcagaaagaaacggggccuuuucggcgccaucgcgggguuuauugaaggaggcuggcaggggauggucgacggaugguauggcuaccaccacagcaaugagcaggggucuggauaugccgcugacaaggaaagcacccaaaaagccaucgauggcgugaccaacaagguuaacuccaucauugacaaaaugaauacacaguucgaggcugugggccgcgaauuuaacaaucuggagagacggaucgagaaccucaauaagaagauggaagauggguuccuggacgucuggacguacaacgccgagcugcucgugcugauggaaaaugagcgcacccuugauuuccaugacucuaacguuaaaaaucuguaugauaaggugagacuccagcugcgggacaacgccaaagaacuuggaaauggcuguuuugaguucuaccacagaugcgauaacgaguguauggaaagcguccgcaaugggacauacgacuauccccaauacuccgaggaagcucggcugaagagagaggagauuagcggagugaaacucgaaucuaucggcaccuaucagauucuguccaucuacagcacagucgcgucuucccuggcccucgcuauuaugguggccgggcuguuucuuuggaugugcagcaacggcucccugcagugccgcaucuguaucuga

SEQ ID NO: 196833 - RNA, 1707 nt, Artificial Sequence
  derived and/or modified sequence opt5 from hemagglutinin__InfluenzaA__BAK23403
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucugugaucuggacggagugaaaccccuuauccugagagauugcagcguugcgggcuggcuccuggggaacccuaugugugacgaguuccugaaugugccggaaugguccuauaucgucgagaagauuaaccccgcuaaugaucucugcuacccuggaaacuuuaaugacuaugaggaacugaagcaucuucugucucggaucaaccacuucgagaaaauucagaucauucccaagagcuccuggucuaaucaugaagccagcuccggcgugagcucugccuguccuuaccaggggcgcuccagcuuuuucagaaacguuguguggcucaucaaaaaggauaaugcuuaucccaccauuaaaaucucuuacaacaauacaaaccaagaggaccugcuuguccuguggggaauccaccacccuaacgaugccgcugagcagacccggcucuaucagaauccgacaaccuacauuuccgugggcacgagcacccugaaccagcgccuggugcccaagaucgccacaagaucuaaggucaauggccaauccgggcggauggaauuuuucuggaccauucucaaaagcaacgacgcgaucaauuuugaguccaacggaaauuucauugccccugaaaacgcuuacaagaucguuaaaaagggcgauucuacaaucaugaaaagcgagcuggaauaugggaauugcaacaccaagugucagacgcccauuggagccaucaauuccagcaugccuuuucauaacauucacccccuuacaaucggcgagugcccgaaauacgugaagucuaaucgccuggugcucgcuaccgggcugagaaacuccccucagggagagcggcgcagaaagaaacggggccuuuucggcgccauugcgggguuuaucgaaggaggcuggcaggggauggucgacggaugguauggcuaccaucacagcaaugagcaagggucuggauaugccgcugacaaggaaagcacacagaaagccaucgauggcgugaccaacaagguuaacuccauuaucgacaaaaugaauacccaguucgaggcugugggccgcgaauuuaacaaucuggagagacggauugagaaccucaauaagaagauggaagauggguuccuggacgucuggacauacaacgccgagcugcucgugcugauggaaaaugagcgcacgcuugauuuccacgacucuaacguuaaaaaucuguaugauaaggugagacuccaacugcgggacaacgccaaagaacuuggaaauggcuguuuugaguucuaccauagaugcgauaacgaguguauggaaagcguccgcaaugggaccuacgacuauccccaguacuccgaggaagcucggcugaagagagaggagaucagcggagugaaacucgaaucuauuggcacauaucagauccuguccauuuacagcaccgucgcgucuucccuggcccucgcuaucaugguggccgggcuguuucuuuggaugugcagcaacggcucccugcagugccgcaucuguauuuga

SEQ ID NO: 196834 - RNA, 1707 nt, Artificial Sequence
  derived and/or modified sequence opt5 from hemagglutinin__InfluenzaA__BAK23404
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucugugaucuggacggagugaaaccccuuauccugagagauugcagcguugcgggcuggcuccuggggaacccuaugugugacgaguuccugaaugugccggaaugguccuauaucgucgagaagauuaaccccgcuaaugaucucugcuacccuggaaacuuuaaugacuaugaggaacugaagcaucuucugucucggaucaaccacuucgagaaaauucagaucauucccaagagcuccuggucugaucaugaagccagcuccggcgugagcucugccuguccuuaccaggggcgcuccagcuuuuucagaaauguuguguggcucaucaaaaaggacaacgcuuaucccaccauuaaacggucuuacaauaacacaaaucaagaggaucugcuuguccuguggggaauccaccacccuaacgacgccgcugagcagacccgccucuaucagaacccgacaaccuacaucuccgugggcacgagcacccugaaucagagacuggugcccaagauugccacacggucuaaggucaacggccaauccgggcgcauggaauuuuucuggaccauccucaaaagcaaugaugcgauuaacuuugaguccaauggaaacuucaucgccccugaaaaugcuuacaagauuguuaaaaagggcgacucuacaaucaugaaaagcgagcuggaauaugggaacugcaauaccaagugucagacgcccaucggagccauuaacuccagcaugccuuuucauaauauccacccccuuacaauuggcgagugcccgaaauacgugaagucuaacagacuggugcucgcuaccgggcugcgcaauuccccucagggagagcggagacggaagaaacgcggccuuuucggcgccaucgcgggguuuauugaaggaggcuggcaggggauggucgacggaugguauggcuaccaucacagcaacgagcaagggucuggauaugccgcugauaaggaaagcacacagaaagccaucgacggcgugaccaauaagguuaacuccaucauugauaaaaugaacacccaguucgaggcugugggcagagaauuuaauaaccuggagcggcgcaucgagaaucucaacaagaagauggaagacggguuccuggaugucuggacauacaaugccgagcugcucgugcugauggaaaacgagagaacgcuugacuuccacgauucuaauguuaaaaaccuguaugacaaggugcggcuccaacugagagauaaugccaaagaacuuggaaacggcuguuuugaguucuaccaucgcugcgacaaugaguguauggaaagcguccggaacgggaccuacgauuauccccaguacuccgaggaagcuagacugaagcgcgaggagauuagcggagugaaacucgaaucuaucggcacauaucagauucuguccaucuacagcaccgucgcgucuucccuggcccucgcuauuaugguggccgggcuguuucuuuggaugugcagcaauggcucccugcagugccggaucuguaucuga

SEQ ID NO: 196835 - RNA, 1707 nt, Artificial Sequence; identical to SEQ ID NO: 196834
  derived and/or modified sequence opt5 from hemagglutinin__InfluenzaA__BAK23405

SEQ ID NO: 196836 - RNA, 1707 nt, Artificial Sequence
  derived and/or modified sequence opt5 from hemagglutinin__InfluenzaA__BAK23406
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugagagauugcagcguugcgggcuggcuccuggggaacccuaugugugacgaguuccugaaugugccggaaugguccuauaucgucgagaagauuaaccccgugaaugaucucugcuacccuggaaacuuuaaugacuaugaggaacugaagcaucuucugucucggaucaaccacuucgagaaaauucagaucuuucccaagagcuccuggucugaucaugaagcuagcuccggcguuagcucugccuguccuuaccaggggcgcuccagcuucuuuagaaauguggucuggcucgugaaaaaggacaacgccuaucccaccauuaaaaagucuuacaauaacacaaaucaagaggaucugcuuauccuguggggcauucaccacccuaacgacgcugccgagcagacccggcucuaucagaacccgacaaccuacaucuccgugggaacgagcacccugaaucagcgccugguccccaagaucgcuacaagaucuaaaguuaacggccaauccgggcggauugaguucuuuuggaccauccucaagagcaaugaugugauuaacuucgaauccaauggaaacuuuaucgccccugaaaaugcguacaaaauugugaagaaaggcgacucuacaaucaugaaaagcgagcuggaauaugggaacugcaauaccaaaugucagacgcccaucggagccauuaacuccagcaugccuuuccauaauauccacccccuuacaauuggcgagugcccgaaguacgucaagucuaaccgccuggugcucgcuaccgggcugagaaauuccccucagggagagcggcgccggaaaaagagaggccuuuuuggcgccaucgcuggguucauugaaggaggcuggcaggggaugguugacggaugguauggcuaccaucacagcaacgagcaagggucuggauaugccgcggauaaagaaagcacacagaaggccaucgacggcgugaccaauaaagucaacuccaucauugauaagaugaacacccaguuugaggcugugggccgcgaguucaauaaccuggaaagacggaucgagaaucucaacaagaaaauggaagacggguuccuggauguuuggacauacaaugccgagcugcucgugcugauggaaaacgagcgcacgcuugacuuucacgauucuaaugucaagaaccuguaugacaaagugagacuccaacugcgggauaaugcuaaggaacuuggaaacggcuguuucgaguuuuaccauagaugcgacaaugaguguauggaaagcgucaaaaacgggaccuacgauuauccccaguacuccgaggaagcccgccugaagcgggaggagauuagcggagugaagcucgaaucuaucggcacauaucagauucuguccaucuacagcaccguugccucuucccuggcucucgcgauuaugauggccgggcuguuccuuuggaugugcagcaauggcucccugcagugcagaaucuguaucuga

SEQ ID NO: 196837 - RNA, 1707 nt, Artificial Sequence
  derived and/or modified sequence opt5 from hemagglutinin__InfluenzaA__BAK23407
auggagaagaucgugcugcuccuggccauugucagccuuguuaaauccggccagaucugcauuggguaccacgcuaacaauucuaccgaacaaguggacacaaucauggagaagaacgugacggucacccaugcccaggauauucuggaaaagacacacaauggaaagcucugugaccuggauggcgugaaaccccuuauccugagagacugcagcguugcgggguggcuccugggaaacccuaugugugaugaguuccugaauguguccgaauggucuuauaucgucgagaagauuaacccggcuaaugaccucugcuaccccggcaacuuuaauaacuaugaggaacugaagcaucuucugagccggaucaaucgcuucgagaaaauucagaucauuccuaaguccucuuggcccgaucacgaagccagccucgggguguccgccgcuuguccuuaccagggaggccccagcuuuuauagaaacguuguguggcugaucaaaaagaauaacaccuacccuacaauugagaaaucuuaucauaauaccaaccaagaggaccuucugguccucuggggcauccaccacccgaacgaugaagccgagcagacacggaucuacaagaaucccaccacguacauuuccguggggaccagcacacugaaccagcgccuggugccuaagaucgcuaccagaucuaaagucaauggacaguccggccggguugaguucuuuuggacaauucucaagagcaacgacaccaucaauuucgaaucuaacgggaauuuuauugcccccgaaaacgcguauaaaaucgugaagaaaggagauuccacgaucaugaaguccgagcuggaguacggcaauugcaacacacgcugucaaaccccuauuggggccaucaauuccucuaugcccuuccauaacauucacccgcuuacaaucggagaaugcccuaaauaugugaaaagcaauagacugguccucgcuaccggccugcggaacagcccccagggcgagcgcagacggaagaaacgcgggcuuuuuggagccauugcuggcuucaucgaagggggauggcagggcaugguggacgggugguacggauaucaucacagcaaugagcagggcucuggcuacgccgcggauaaggaauccacccaaaaagccaucgacgggguuacaaacaaggugaacagcauuaucgacaaaaugaauacgcaguuugaggcugucggaagagaguucaacaaucuggaacggcgcauugagaaccucaauaagaagauggaagauggcuuucuggacguguggaccuauaacgccgagcugcucguucugauggaaaaugagagaacacuugauuuccacgacucuaacgugaaaaaucuguacgauaagguccggcuccagcugagagacaacgcuaaagagcuugggaauggauguuucgaauuuuaccaucgcugcgauaacgaguguauggaaagcgugcggaauggcaccuaugacuacccucaauauuccgaggaggccagacugaagcgcgaagagaucucuggggucaaacucgaaagcauuggcacauaccagauccuguccauuuauagcaccguggccucuucccuggcucucgcgaucaugguugccggacuguuccuuuggaugugcagcaacggcucucugcagugccggaucuguauuuga

SEQ ID NO: 196838 - RNA, 1707 nt, Artificial Sequence
  derived and/or modified sequence opt5 from hemagglutinin__InfluenzaA__BAK23408
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggagaaaacacacaaugggaagcucugugaucuggacggagugaaaccccuuauccugagagauugcagcguugcgggcuggcuccuggggaacccuaugugugacgaguucccgaauguguccgaauggucuuauaucgucgagaagauuaaccccgcuaaugaucugugcuacccuggaaacuuuaauaacuaugaggaacucaagcaucugcuuagccggaucaaucgcuucgagaaaauucagaucauucccaaguccucuuggccugaccacgaagccagccugggcguguccagcgccugucaguaccaagggggacccucuuuuuauagaaacguuguguggcucaucaaaaaggauaaugcuuacccuaccauuaaaaaguccuaucauaacacaaauaaggaggaccugcuuguccuguggggcauccaccacccgaacaacgaggaagaacagaccaaacucuaccagaaucccacaaccuacaucagcgugggcacgucuacccugaaccagcggcuggugccuaagauugccacacgcuccaaagucaaugggcaaagcggaagaguugaguucuuuuggaccauccucaagucuaacgaugcuauuaauuucgaauccaacggcaauuuuaucgcccccgaaaacgcguauaaaauugugaagaaaggggacagcacaaucaugaaguccgagcuggaguacggaaauuauaacaccaagugccagacgccuaucggcgccauuaauucuagcaugcccuuccauaacauccacccgcuuacaauuggggaauguccuaaauacgugaaguccaaucggcugguccucgcuaccggacugcgcaacagcccccagggcgagagacggcgcaaaaagagaggccuuuuuggggccaucgcuggauucauugaaggcggguggcagggaaugguggauggcugguauggguaccaucacucuaaugagcaaggauccggcuaugccgcggacaaagaaagcacacagaaggccaucgacggcguuaccaacaaggugaacucuaucauugauaaaaugaauacccaguuugaggcugucgggaaggaguucaacaaucuggaacggcgcaucgagaaccucaauaaaaagauggaagacggauuucuggauguguggacauacaacgccgagcugcucguucugauggaaaaugagagaacgcuugacuuccacgauagcaacgugaaaaaucuguacgacaagguccggcuccaacugcgcgauaacgcuaaggagcuuggcaaugggugcuucgaauuuuaucauagaugugacaacgagugcauggaauccgugcggaauggaaccuacgauuauccucaguacucugaggaggccagacugaaacgcgaagagauuagcggcgucaagcucgaauccaucgggacauaucagauucugagcaucuacucuaccguggccuccagccuggcucucgcgauuaugguugccggccuguuccuuuggauguguucuaacggaucccugcagugccggaucugcaucuga

SEQ ID NO: 196839 - RNA, 1707 nt, Artificial Sequence
  derived and/or modified sequence opt5 from hemagglutinin__InfluenzaA__BAK23411
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggagaaaacacacaaugggaagcucugugaucuggacggagugaaaccccuuauccugagagauugcagcguugcgggcuggcuccuggggaacccuaugugugacgaguuccugaauguguccgaauggucuuauaucgucgagaagauuaacccggcuaaugaucucugcuaccccggaaacuuuaauaacuaugaggaacugaagcaucuucugagccggaucaaucgcuucgagaaaauucagaucauuccuaaguccucuuggcccgaccacgaagccagccucggcguguccagcgccugucaguaccaagggggaccuucuuuuuauagaaacguuguguggcugaucaaaaaggauaaugcuuaccccaccauuaaaaaguccuaucauaacacaaauaaggaggaccuucugguccucuggggcauccaccacccuaacaacgaggaagaacagaccaaacuguaccagaauccgacaaccuacaucagcgugggcacgucuacccugaaccagcggcucgugcccaagauugccacacgcuccaaagucaaugggcaaagcggaagaguugaguucuuuuggaccauccugaagucuaacgaugcuauuaauuucgaauccaacggcaauuuuaucgccccugaaaacgcguauaaaauugugaagaaaggggacagcacaaucaugaaguccgagcuugaguacggaaauugcaacaccaagugucagacgcccaucggcgccauuaauucuagcaugccuuuccauaacauccacccccugacaauuggggaaugcccgaaauaugugaaguccaaucggcucguccuggcuaccggacuucgcaacagcccucagggcgagagacggcgcaaaaagagaggccuguuuggggccaucgcuggauucauugaaggcggguggcagggaaugguggauggcugguacggguaucaucacucuaaugagcaaggauccggcuacgccgcggacaaagaaagcacacagaaggccaucgacggcguuaccaacaaggugaacucuaucauugauaaaaugaauacccaguuugaggcugucgggaaggaguucaacaaucucgaacggcgcaucgagaaccugaauaaaaagauggaagacggauuucuggauguguggacauauaacgccgagcuccugguucuuauggaaaaugagagaacgcuggacuuccacgauagcaacgugaaaaaucucuacgacaagguccggcugcaacuucgcgauaacgcuaaggagcugggcaauggguguuucgaauuuuaccauagaugcgacaacgaguguauggaauccgugcggaauggaaccuaugauuacccccaguauucugaggaggccagacucaaacgcgaagagauuagcggcgucaagcuggaauccaucgggacauaccagauucugagcaucuauucuaccguggccuccagccucgcucuggcgauuaugguugccggccuuuuccuguggaugugcucuaacggaucccuccagugccggaucuguaucuga

SEQ ID NO: 196840 - RNA, 1707 nt, Artificial Sequence
  derived and/or modified sequence opt5 from hemagglutinin__InfluenzaA__BAK23412
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggagaaaacacacaaggggaaacucugugaucuggacggagugaagccccuuauccugagagauugcagcguugcgggcuggcuccuggggaauccuaugugugacgaguuccugaacguguccgaauggucuuauaucgucgagaagauuaauccggcuaacgaucucugcuaccccggaaauuuuaacaauuaugaggaacugaaacaucuucugagccggaucaaccgcuucgagaagauucagaucauuccuaaauccucuuggcccgaccacgaagccagccucggcguguccagcgccugucaguaccaagggggaccuucuuuuuauagaaauguuguguggcugaucaagaaagauaacaccuaccccacaauuaagaaguccuaucauaauaccaacaaagaggaccuucugguccucuggggcauccaccacccuaauaacgaggaagaacagacaaagcuguaccagaacccgaccacguacaucagcgugggcaccucuacacugaaucagcggcucgugcccaaaauugcuacccgcuccaaggucaacgggcaaagcggaagaguugaguucuuuuggacaauccugaaaucuaaugaugccauuaacuucgaauccaauggcaacuuuaucgcuccugaaaaugccuauaagauugugaaaaagggggacagcaccaucaugaaguccgagcuugaguacggaaacugcaauacgaaaugucagacacccaucggcgcgauuaacucuagcaugccuuuccauaauauccacccccugaccauuggggaaugcccgaaguaugugaaauccaaccggcucguccuggccacaggacuucgcaauagcccucagggcgagagacggcgcaagaaaagaggccuguuuggggcuaucgccggauucauugaaggcggguggcagggaaugguggauggcugguacggguaucaucacucuaacgagcaaggauccggcuacgcugccgacaaggaaagcacccagaaggcgaucgacggcguuaccaauaaagugaacucuaucauugauaagaugaacacacaguuugaggccgucgggaaagaguucaauaaccucgaacggcgcaucgagaaucugaacaagaaaauggaagacggauuucuggauguguggacguauaaugcugagcuccugguucuuauggaaaacgagagaacccuggacuuccacgauagcaaugugaagaaccucuacgacaagguccggcugcaacuucgcgauaaugccaaagagcugggcaacggguguuucgaauuuuaccauagaugcgacaaugaguguauggaauccgugcggaacggaacauaugauuacccccaguauucugaggaggcuagacucaagcgcgaagagauuagcggcgucaaacuggaauccaccgggacauaccagauccugagcauuuauucuaccguggccuccagccucgcccuggcuaucaugguugcgggccuuuuccuguggaugugcucuaauggaucccuccagugccggauuuguaucuga

SEQ ID NO: 196841 - RNA, 1707 nt, Artificial Sequence
  derived and/or modified sequence opt5 from hemagglutinin__InfluenzaA__BAK23413
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggagaaaacacacaaugggaagcucugugaucuggacggagugaaaccccuuauccugagagauugcagcguugcgggcuggcuccuggggaacccuaugugugacgaguuccugaauguguccgaauggucuuauaucgucgagaagauuaacccggcuaaugaucucugcuaccccggaaacuuuaauaacuaugaggaacugaagcaucuucugagccggaucaaucgcuucgagaaaauucagaucauuccuaaguccucuuggcccgaccacgaagccagccucggcguguccagcgccugucaguaccaagggggaccuucuuuuuauagaaacguuguguggcugaucaaaaaggauaauaccuaccccacaauuaaaaaguccuaucauaacaccaauaaggaggaccuucugguccucuggggcauccaccacccuaacaacgaggaagaacagacaaaacuguaccagaauccgaccacguacaucagcgugggcaccucuacacugaaccagcggcucgugcccaagauugcuacccgcuccaaagucaaugggcaaagcggaagaguugaguucuuuuggacaauccugaagucuaacgaugccauuaauuucgaauccaacggcaauuuuaucgcuccugaaaacgccuauaaaauugugaagaaaggggacagcaccaucaugaaguccgagcuugaguacggaaauugcaacacgaagugucagacacccaucggcgcgauuaauucuagcaugccuuuccauaacauccacccccugaccauuggggaaugcccgaaauaugugaaguccaaucggcucguccuggccacaggacuucgcaacagcccucagggcgagagacggcgcaaaaagagaggccuguuuggggcuaucgccggauucauugaaggcggguggcagggaaugguggauggcugguacggguaucaucacucuaaugagcaaggauccggcuacgcugccgacaaagaaagcacccagaaggcgaucgacggcguuaccaacaaggugaacucuaucauugauaaaaugaauacacaguuugaggccgucgggaaggaguucaacaaucucgaacggcgcaucgagaaccugaauaaaaagauggaagacggauuucuggauguguggacguauaacgcugagcuccugguucuuauggaaaaugagagaacccuggacuuccacgauagcaacgugaaaaaucucuacgacaagguccggcugcaacuucgcgauaacgccaaggagcugggcaauggguguuucgaauuuuaccauagaugcgacaacgaguguauggaauccgugcggaauggaacauaugauuacccccaguauucugaggaggcuagacucaaacgcgaagagauuagcggcgucaagcuggaauccaucgggaccuaccagauucugagcaucuauucuacaguggccuccagccucgcccuggcuauuaugguugcgggccuuuuccuguggaugugcucuaacggaucccuccagugccggaucuguaucuga

SEQ ID NO: 196842 - RNA, 1707 nt, Artificial Sequence; identical to SEQ ID NO: 196839
  derived and/or modified sequence opt5 from hemagglutinin__InfluenzaA__BAK23414

SEQ ID NO: 196843 - RNA, 1698 nt, Artificial Sequence
  derived and/or modified sequence opt5 from hemagglutinin__InfluenzaA__BAM65746
auggaggugaagcugcucguccugcuuugcaccuucacagccacguacgcugacaccaucuguauuggcuaucacgccaacaauagcacagauaccguugacacacugcccgaaaagaacgugaccgugacacauuccgucaaucuccuggaggauacccacaacgggaaacuuugccugcucaaaggaaucgcgccucugcagcugggcaauuguucuguggcuggguggauucucggaaacccggaaugcgagcugcuuaucagcagagaauccuggucuuacauuguugagaagcccaauccugagaacggcaucuguuaucccgggcauuuugccgacuacgaagaacugcgggaacaacucagcuccgugucuagcuucgagcgcuuugagaucuucccuaaagaauccagcuggcccaaucacacggccaccggagucucugcuuccugcagccauaacggcaagucuuccuuuuauaagaaucugcuuuggcugacagugaaaaacggccucuacccuaaucugagcaagucuuaugccaacaauaaagagaaggaaguucuggugcucuggggaguccaccacccgaccaacauuggggaucagagagcucuguaccauacagagaacgccuacguguccguggucagcucccacuauucucggcgcuucacccccgaaaucgcgaaaagaccuaagguucgggaccaggagggccgcauuaauuacuauuggacgcuucuggagcccggggauacaaucauuuuugaagccaacggaaaucucaucgcuccuagauacgccuucgcucugagccggggcuuuggguccggaauuaucaagagcaacgcccccauggacgaguguaaugcgaaaugccagaccccgcaaggcgccaucaacucuucccuuccuuuccagaaugugcaucccgugacaauuggcgaauguccuaaguauguccgcagcaccaaacugagaauggugaccgggcuccggaacacacccucuauccagagccgcggacuguuuggcgcuauugccggguucaucgagggaggcuggacggggaugguugauggaugguacggcuaucaccaccagaaugaacaaggcuccggguacgcugccgaccagaagucuacccagaacgccauuaauggaaucacaaacaaagugaauagcgucaucgagaagaugaacacccaguuuacagcuguggauaaagaguucaauaagcuggaaagacggauggagaacuucaacaagaaaguugacgauggcuuuauugacaucuggaccuacaaugcggaacuccugauucuucuggagaacgaacgcacgcucgacuuccaugauuccaaugugaagaaccuguaugagaaagucaagagccaacuuaaaaauaacgccaaggagaucgggaauggaugcuuugaguucuaccacaaguguaacgacgagugcauggaaucugugaaaaauggcacauaugauuaccccaaguauuccgaggagagcaaacugaacagagaaaagauugacggggucaaacucgagucuaugggcguguaccagauccuggcuaucuauuccaccguugccagcuccauggugcugcucgucucucugggagccauuagcuuuuggaugugcuccaauggcucucuucagugucggaucugcauuuga

SEQ ID NO: 196844 - RNA, 1701 nt, Artificial Sequence; identical to SEQ ID NO: 195590
  derived and/or modified sequence opt5 from hemagglutinin__InfluenzaA__BAO79716

SEQ ID NO: 196845 - RNA, 1683 nt, Artificial Sequence
  derived and/or modified sequence opt5 from Hemagglutinin__InfluenzaA__CAB95856
auggagaccaucagccugauuacaauccuccugguggucacggccuccaacgcugacaagauuugcaucggccaccagucuaccaauagcacagaaaccguugauacacuuaccgagacaaacgugcccgugacccaugccaaagaacugcuccacacggagcauaaugggaugcugugugcgaccucccuuggacacccucugauucucgacacaugcaccaucgaaggccuggucuacgggaacccgucuugugaucugcuccugggaggcagagaguggagcuauaucguggagcgguccucugcuguuaaugggacaugcuaccccggaaacguggaaaaucuugaggaacugcgcacccucuucagcuccgccagcucuuaucaacggauucagaucuuuccugacacgacauggaacgucaccuacacaggcaccuccagagccuguagcggcucuuucuaucgcuccaugagauggcugacccagaagucuggguuuuaccccgugcaggaugcucaauauacaaauaaccggggaaaaucuauucuuuucguuuggggcauccaucacccucccacguacaccgagcagacaaaucuguacauucgcaacgacaccacaaccuccgugacgacagaggaucucaauagaaccuuuaagccugucaucgggccgcggccccuggugaacggacugcagggccgcauugacuauuacuggagcgugcucaaaccugggcagacccugagaguccgguccaauggaaaccuuaucgcccccugguauggccacguucugucuggcgggagccauggacgcauccucaagacagaucugaagggcgggaacugcguggugcaaugucagaccgaaaaaggaggccuuaauuccacacugccuuuccacaacauuagcaaguacgcuuuugggacgugccccaaauaugucagagugaauagccucaagcuggccguuggacugcggaacgugccggcgcgcuccagcagaggccucuucggcgccaucgcuggguuuauugagggaggcuggccugggcuggucgccggaugguacggcuuccagcauucuaaugaccagggggugggcauggcugccgaucgggacagcacccaaaaagcgaucgauaagauuacauccaagguuaacaauaucguggacaaaaugaacaagcaguaugaaaucauugaccacgaguuuucugaagucgagaccagacuuaauaugaucaacaauaaaauugaugaccagauccaagaugugugggccuacaacgcugagcugcucguccugcuugaaaaucagaagacacuggacgagcacgaugccaacgugaauaaccucuacaacaaaguuaagcgcgcucugggaagcaaugccauggaagacggcaaaggguguuucgagcuguaucauaagugcgaugaccaguguauggaaaccauucggaacggaacguacaauagacgcaaguaucgggaggaguccagacucgaacgccagaaaaucgagggcgugaagcuggaaagcgaggggaccuacaaaauccuuacaauuuauucuaccgucgccuccagccuggugcucgcuaugggauuugcggccuuccuguucugggcuaugucuaacggcuccugccggugcaauaucuguauuuga

SEQ ID NO: 196846 - RNA, 1683 nt, Artificial Sequence
  derived and/or modified sequence opt5 from Hemagglutinin__InfluenzaA__CAB95857
auggagaccaucagccugauuacaauccuccugguggucacggccuccaacgcugacaagauuugcaucggccaccagucuaccaauagcacagaaaccguugauacacuuaccgagacaaacgugcccgugacccaugccaaagaacugcuccacacggagcauaaugggaugcugugugcgaccucccuuggacacccucugauucucgacacaugcaccaucgaaggccuggucuacgggaacccgucuugugaucugcuccuggagggaagagaguggagcuauaucguggaacgguccucugcuguuaauggcacaugcuaccccgggaacguggagaaucuugaggaacugcgcacccucuucagcuccgccagcucuuaucaacggauucagaucuuuccugacacgacauggaacgucaccuacacaggaaccuccagagccuguagcggcucuuucuaucgcuccaugagauggcugacccagaaguccggcuuuuaccccgugcaggaugcucaauauacaaauaaccgggggaaaucuauucuuuucguuuggggaauccaucacccucccacguacaccgagcagacaaaucuguacauucgcaacgacaccacaaccuccgugacgacagaagaucucaauagaaccuuuaagccugucaucggcccgcggccccuggugaacgggcugcagggacgcauugacuauuacuggagcgugcucaaaccuggccagacccugagaguccgguccaaugggaaccuuaucgcccccugguauggacacguucugucuggcggcagccaugggcgcauccucaagacagaucugaaguccggaaacugcguggugcaaugucagaccgagaaaggcgggcuuaauagcacacugccuuuccacaacauuucuaaguacgcuuuuggaacgugccccaaauaugucagagugaauagccucaagcuggccguuggccugcggaacgugccggcgcgcagcucuagaggacucuucggggccaucgcuggcuuuauugaaggcggguggccuggacuggucgccggcugguacggguuccagcauagcaaugaccagggagugggcauggcugccgaucgggacuccacccaaaaagcgaucgauaagauuacaucuaagguuaacaauaucguggacaaaaugaacaagcaguaugagaucauugaccacgaauuuagcgaggucgagaccagacuuaauaugaucaacaauaaaauugaugaccagauccaagaugugugggccuacaacgcugaacugcucguccugcuugagaaucagaagacacuggacgaacacgaugccaacgugaauaaccucuacaacaaaguuaagcgcgcucugggguccaaugccauggaggacggcaaaggauguuucgaacuguaucauaagugcgaugaccaguguauggagaccauucggaacggcacguacaauagacgcaaguaucgggaggaaagcagacucgagcgccagaaaaucgaaggggugaagcuggagucugaaggagccuacaaaauccuuaccauuuauuccacagucgcuagcucucuggugcucgcgaugggcuuugccgcuuuccuguucugggccauguccaacgggagcugccggugcaauaucuguauuuga

SEQ ID NO: 196847 - RNA, 1707 nt, Artificial Sequence
  derived and/or modified sequence opt5 from hemagglutinin__InfluenzaA__CBW54815
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugagagauugcagcguugcgggcuggcuccuggggaacccuaugugugacgaguucccgaauguguccgaauggucuuauaucgucgagaagaccaaccccgcuaaugaucugugcuacccuggaaacuuugacaauuaugaggaacucaagcaucugcuuagccggauuaaccgcuucgagaaaauccagauuauccccaaguccucuuggccugaucacgaagccagccugggcguguccagcgccugucccuaccaagggggaccuucuuuuuauagaaauguuguguggcucauuaaaaagaacaauacauacccgaccaucaaagaguccuaucauaacacaaaucaggaggaccugcuuguccuguggggcauucaccaccccaacgaugaagaggaacagacccggaucuacaagaacccuacgaccuacaucagcgugggcacaucuacccucaaucagcgccuggugcccaagauugcuacaagauccaaagucaacgggcagagcggacggguugaguucuuuuggaccauccugaagucuaaugacacgauuaacuucgaauccaauggcaacuuuaucgccccugagaaugcuuauaaaauugugaagaaaggggauagcacaaucaugaaguccgagcucgaauacggaaacugcucuaccaaaugucaaacacccaucggcgccauuaauagcuccaugccguuccauaacauccacccucugaccauuggggagugccccaaguaugugaaaagcaaucgccuuguccuggcgaccggacucagaaacucuccucagggcgaaggccggcgcaaaaagagagggcuguuuggagccaucgcuggcuucauugaagggggauggcagggcaugguggacgggugguacggauaucaucacuccaaugaacagggcagcggcuacgccgcugacaaagagucuacacaaaaggccaucgaugggguuacgaacaaagugaauagcaucauugacaagaugaacacccaguuugaggcggucggacgggaguucaacaaucuugagaagcgcaucgaaaaccugaauaaaaagauggaggauggcuuucucgacguguggacauauaacgccgaacugcugguucucauggagaaugagagaacccuggauuuccacgacuccaacgugaaaaaucuuuacgauaagguccggcugcagcuccgcgacaacgcuaaagaacuggggaauggauguuucgaguuuuaccauagaugcgauaacgaauguauggagucugugcggaauggcacauaugacuacccccaauauagcgaggaagccagacuuaagcgcgaggaaauuuccggggucaagcuggagagcaucggcaccuaccagauucucucuaucuauuccacgguggcuagcucucuggcccuggccauuaugguugcuggacucuuccuguggaugugcuccaacggcagccuucagugccggaucuguaucuga

SEQ ID NO: 196848 - RNA, 1707 nt, Artificial Sequence
  derived and/or modified sequence opt5 from hemagglutinin__InfluenzaA__CBW54817
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucugugaucuggacggagugaaaccccuuauccugagagauugcagcguugcgggcuggcuccuggggaacccuaugugugacgaguucccgaauguguccgaauggucuuauaucgucgagaagauuaaccccgcuaaugaucugugcuacccuggaaacuuuaauaacuaugaggaacucaagcaucugcuuagccggaucaaucgcuucgagaaaauucagaucauucccaaguccucuuggccugaccacgaagccagccugggcguguccagcgccugucccuaccagagagggccuucuuuuuaucggaacguuguguggcucaucaaaaagaaugauaccuacccgacaauuaaagaguccuaucauaacaccaaucaagaggaccugcuuguccuguggggaauccaccaccccaacgaugaagaggaacagaagcgcaucuacaagaacccuacaaccuacauuagcgugggcacgucuacccucaaucagagacuggugcccaaaaucgcuacacgguccaaggucaacggccagagcgggcgcguugaguucuuuuggaccauucugaaaucuaaugacacaaucaacuucgaauccaauggaaacuuuauugccccugagaaugcuuauaagaucgugaaaaagggcgauagcaccaucaugaaauccgagcucgaauacgggaacugcucuacgaagugucaaacacccauuggagccaucaauaccagcaugccguuccauaacauucacccucugacaaucggcgagugccccaaguaugugaaauccaauagacuuguccuggcgaccgggcuccggaacagcccucagggagaaggccgcagaaagaaacggggccuguuuggggccauugcuggauucaucgagggcggguggcagggaaugguggacggcugguacggguaucaucacucuaaugaacagggauccggcuacgccgcugacaaggagagcacccaaaaagccaucgauggcguuacaaacaaggucaauucuauuaucgacaagaugaacacgcaguuugaggcgguggggcgcgaauuuaacaaucuugagaaaagaauugaaaaccugaauaagaaaauggaggauggauuccucgacguguggaccuauaacgccgaacugcugguucucauggagaaugagcggacacuggauuuccacgacagcaacgugcgcaaucuuuacgauaaggucagacugcagcuccgggacaacgcuaaagaacugggcaauggguguuucgaguuuuaccauagaugcgauaacgaauguauggaguccgugcgcaauggaaccuaugacuacccccaauauucugaggaagcccggcuuaagagagaggaaaucagcggcgucaagcuggaguccauugggacauaccagauccucagcauuuauucuaccguggcuuccagccuggcccuggccaucaugguugcuggccucuuccuguggaugugcucuaacggaucccuucagugccgcaucuguauuuga

SEQ ID NO: 196849 - RNA, 1707 nt, Artificial Sequence
  derived and/or modified sequence opt5 from hemagglutinin__InfluenzaA__CBW54818
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggagaaaacacacaaugggaagcucugugaucuggacggagugaaaccccuuauccugagagauugcagcguugcgggcuggcuccuggggaacccuaugugugacgaguucccgaauguguccgaauggucuuauaucgucgagaagaccaaccccgcuaaugaucugugcuacccuggaaacuuuaauaacuaugaggaacucaagcaucugcuuagccggauuaaucgcuucgagaaaaucaagauuauccccaaauccucuuggccugaccacgaagccagccugggcguguccagcgccugucccuaccaagggggaccuucuuuuuauagaaacguuguguggcucauuaagaaaaauaacacauacccgaccaucaaggaguccuaucauaauacaaaccaggaggaucugcuuguccuguggggcauucaccaccccaacgacgaagaggaacagacccggaucuacaagaauccuacgaccuacaucagcgugggcacaucuacccucaaccagcgccuggugcccaaaauugcuacaagauccaaggucaaugggcagagcggacggguugaguucuuuuggaccauccugaaaucuaacgauacgauuaauuucgaauccaacggcaauuuuaucgccccugagaacgcuuauaagauugugaaaaagggggacagcacaaucaugaaauccgagcucgaauacggaaauugcucuaccaagugucagacacccgugggcgccaucaacagcuccaugccguuccauaauauucacccucugaccaucggggagugccccaaguaugucaaaagcaaccgccuugugcuggcgaccggacucagaaauucuccucaaggcgaaggccggcgcaagaaaagagggcuguuuggagccauugcuggcuucaucgaagggggauggcagggcaugguugaugggugguacggauaucaucacuccaacgaacagggcagcggcuacgccgcugaccgggagucuacacagaaggccauugacggggugacgaauaaagucaacagcaucaucgauaagaugaacacccaauuugaggcggugggacgcgaguucaauaaccuugaaaagagaauugaaaaucugaacaaaaagauggaggacggcuuucucgauguuuggacauauaaugccgaacugcuggugcucauggagaacgagcggacccuggacuuccacgauuccaaugucaaaaaccuuuacgacaaggugcgccugcagcucagagauaaugcuaaagaacuggggaacggauguuucgaguuuuaccaucggugcgacaaugaauguauggagucugucagaaacggcacauaugauuacccccaguauagcgaggaagcccgccuuaagcgggaggaaaucuccggggugaagcuggagagcauuggcaccuaccaaauccucucuauuuauuccacgguugcuagcucucuggcccuggccaucauuguggcuggacuccugcuuuggaugugcuccaauggcagccugcagugcagaaucuguaucuga

SEQ ID NO: 196850 - RNA, 1701 nt, Artificial Sequence
  derived and/or modified sequence opt5 from hemagglutinin__InfluenzaA__CCG47908
augaagaccgugaucgcccugagcuacgucuucugccucggcuuugggcagggacugcccggcaaagggaacaauacagcuacgcuuugucugggacaccaugccguuccuaacggcacccucgugaagacaauuaccgacgaucaaaucgaggugacaaaugcgaccgaacugguccagaacuucuccauggggaaaauuugcaagaauccgcacagaauccuugacggagcuaacuguacacugauugauucucuccugggcgacccccauugcgauggcuuucaggacgagaaaugggaucuguucaucgaacggagcaaggccuuuuccaauuguuauccuuacgacgugcccgaguauaccucucuccgcagcaucauugccuccucugggacgcuggaguucaccaacgaagauuuuaauuggacaggaguuacccagaacggcgggagcuccgcuugcaagagaggaccuaauaacagcuucuuuucucggcuuaauuggcuguacaaauccggcaacacauaucccaugcucaaugugaccaugccuaacagcgacgauuucgacaagcuguacaucuggggaguccaccauccgucuacggaucgcgagcaaacaaaccuuuauauucaggccuccgggaaaaucauugugagcaccaagagaucucagcagacaaucauucccaauaucggcucccggccuuggguucgcggccugagcuccagaaucucuauuuacuggaccaucgugaaacccggggacauucucaucauuaacagcaauggaaaccugaucgcuccucggggcuacuuuaagauccaaaccgggaaguccagcgucaugcgcucugacgcccccauugauacauguaauuccgaaugcaucacgccgaacggaagcauuccuaaugacaaacccuuccagaacgugaauagaaucaccuauggcgcguguccuaaguacauuaaacagaacacacugaagcucgccaccgggaugcggaauauccccgagcgccagacaagaggaaucuuuggcgcuauugccggcuucaucgaaaacgggugggagggaauggugaauggcugguauggguuccggcaccaaaacucugagggaauuggccaggcugccgaucugaaaagcacccaggcggccaucaaucaaauuaacgggaaacuuaaccgcgucaucgaaaagacgaaugagaaguuucaccagauugaaaaggaguucuccgaaguugagggcagaauccaggaccuggagcgguacguggaagauacaaaaaucgaccucuggucuuauaacgcugagcugcuuguggcccuggaaaaucagcauaccauugaucucaccgacagcgagaugaacaagcuguuugagaaaacaagaaagcaacugcgcgaaaaugcugaggauaugggaaacggcugcuucaaaaucuaccacaagugugacaauuccugcauggaaagcauucggaacgggaccuaugaucauaaugaguacagagacgaagccgucaacaaucgcuuucagaucaagucuguggagcucaaauccggauacaaggacuggauucuguggaucagcuucgccaucucuugcuuucuucugugugcuguuuggcucggcuucauuaucugggcgugccagaaagggaacauucgguguaauaucugcauuuga

SEQ ID NO: 196851 - RNA, 1701 nt, Artificial Sequence
  derived and/or modified sequence opt5 from hemagglutinin_precursor_(high_yield_phenotype)__InfluenzaA_ _AAB39851
augaaggccauccugcucgugcugcuuugcaccuucgcugccacaaacgcggacacgcuguguauuggcuaccacgcuaauaacagcaccgauacagucgacaccguucucgagaaaaaugugacagugacccauuccgucaaccugcuugaagauagacacaaugggaagcugugcaaacucggaggcaucgcuccccugcaucuggggaaguguaacauugccggacggcuccugggcaauccugagugcgaacuucugcucacagugucuagcugguccuauaucguugagaccucuaaaagcgacaacgggacguguuacccgggagauuuuauuaauuaugaagaacugcgcgagcagcuuuccucugugagcuccuucgaaagauuugagaucuuccccaagaccagcucuuggccuaaccacgaaacaaaucggggcgucaccgccgccugccccuacgcuggcgccaacuccuuuuaucgcaaucugaucuggcucgugaagaaagagaacagcuacccuaagcugucuaaauccuauguuaauaacaaggggaaagaggugcugguccucuggggcauucaucaucccccuacaagcaccgaccaacagucucuguaccagaacgcggaugccuacguguucgugggauccagcaaguauaauagaaaguuuaaaccggaaaucgcugcccggcccaagguccgcgggcaggcuggaagaauguccuacuauuggacgcuuauugagccuggcgacacaaucaccuucgaagccacagggaaccugguugugccccgguacgcguuugccaugaaucgcggaucuggcagcggcauuaucauuugggaugcuccugugcacgacuguaacaccaaaugccaaacccccaagggggccaucaauacaucccucccguuccagaacauccacccugucacgauuggagagugucccaaauauguuaagagcaccaaacugagaauggcuacaggccuucggaaugugccuucuauccagucccgcgggcuguuuggagccauugccggcuucaucgaagggggauggaccggcaugauugauggcugguacggguaucaccaucagaacgagcaaggaagcggcuacgcugcggaccagagaucuacacagaaugccaucgaugggaucaccaacaaggugaauagcgucauugagaagaugaacacgcaguuuacagcugugggaaaagaguucaaucaccucgagaagcggaucgaaaaccugaauaaaaagguugacgacggcuuccuggauauuuggaccuacaacgccgagcuccuggugcuucuggaaaacgagcgcacccucgacuuucacgauuccaaugucaaaaaccuguaugagaaggugagaucucaacuucggaauaacgccaaggaaaucgggaauggcugcuucgaguuuuaccauaaaugugacgauacaugcauggaaagcgucaagaacggaaccuaugacuaccccaaauauuccgaggaaagcaagcugaauagagaggagauugauggcgugaaacucgaaucuacacgcaucuaccagauccuggcuauuuauuccacgguugccagcucucuggugcuccuggucucccuuggggcgaucagcuucuggaugugcuccaacggaucucugcagugucggauuugcaucuga

SEQ ID NO: 196852 - RNA, 1701 nt, Artificial Sequence
  derived and/or modified sequence opt5 from hemagglutinin_precursor__InfluenzaA__AAA43178
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucgauuguacccucauugacgcccugcugggcgauccccauugcgacguguuucagaacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaccccguccuuaaugugaccaugccuaacaaugacaacuucgauaagcuguauauuuggggcauccaccauccguccacaaaucaagagcagaccagccucuacguucaggccucugggcgcgugaccgucuccacaagacggagccagcaaacgauuauccccaacauuggaucccgcccuugggugagaggccugucuagccggaucuccaucuauuggaccauugugaagcccggcgacguccugguuaucaacagcaaugggaaccucauugcgccucgcggauacuuuaaaaugagaacaggcaagucuuccaucaugcggagcgacgcccccauugauaccuguaucucugagugcaucacaccgaaugggagcauuccuaacgacaaacccuuccagaaugugaacaagaucaccuacggagcuuguccuaaauaugugaagcagaauacgcugaaacuugccacaggcaugcgcaacguccccgaaaagcagaccagagggcuguuuggagcuauugccggcuucaucgagaauggcugggaagggaugauugauggaugguacggcuuucggcaccaaaacuccgaggggaccggacaggcggccgaccucaagucuacacaggcugccaucgaucaaaucaauggcaaacugaaccgcgugauugagaagaccaaugaaaaauuccaccagaucgagaaggaguucagcgaaguugaagggcggauucaggaccuugagaaauauguggaggauacaaagaucgaccugugguccuacaacgcugaacuccuggucgcccuggagaaucagcauacgauugaucucaccgacagcgaaaugaacaagcuguuugagaaaacaagaagacaacuucgcgaaaacgccgaggagaugggcaauggaugcuucaagaucuaucacaaaugugauaacgcuugcauugaaucuauccggaauggcaccuacgaccaugacguguauagagaugaggcgcugaacaaucgcuuucagaucaaggggguugaacucaaauccggauacaaggacuggauucuguggaucagcuucgccauuucuugcuuucuucugugugugguccuccugggcuucaucaugugggcuugccagcgggggaacauuagauguaauaucugcaucuga

SEQ ID NO: 196853 - RNA, 1689 nt, Artificial Sequence
  derived and/or modified sequence opt5 from hemagglutinin_precursor__InfluenzaA__AAA43185
auggccaucauuuaccugauccuccuguucaccgcugugagaggcgaccagauuugcaucggguaucacgccaacaauagcacagagaaggucgauacgaaccuugaacggaauguuaccgugacacaugcgaaagacauucuggagaagacccacaacggaaaacucuguaagcugaauggcauucccccucuugaacugggggauugcuccaucgcuggauggcuccugggcaacccggagugugaccgccugcucucugugcccgaauggagcuacaucauggagaaagagaauccuagagaugggcugugcuaucccggauccuuuaacgacuacgaggaacuuaagcaucugcucucuagcgucaagcacuucgaaaaagugaagauccugccuaaagaucgguggacacaacauaccacaaccggcggcucccgcgccugugccguuucugggaaucccagcuuuuucagaaacaugguguggcuuacgaaggagggauccgacuauccugucgcuaaaggcagcuacaauaacaccucuggggagcagaugcugauuaucuggggagugcaccacccgauugaugaaacagagcagcggacccucuaucagaauguuggcacauacguguccgucgggaccagcacgcugaacaagcgcucuacacccgaaaucgccaccagaccuaaggugaauggacaaggcggccggauggaguuuuccuggacacugcucgacaugugggauaccauuaacuucgaaagcaccgggaaccugaucgcucccgaguacggauuuaaaaucucuaagcgcggcuccagcgggauuaugaaaacagagggaacgcuugaaaauugcgagaccaagugucagacaccucugggcgccaucaacaccacacuccccuuccauaaugugcacccgcugaccauuggggaaugcccuaaauaugucaaguccgagaaacuuguucuggcgacgggacucagaaacgugccccagaucgaaucucggggccuguuuggcgccauugcuggguucaucgagggaggcuggcaggggaugguggacggaugguacggcuaucaucacagcaaugaucaaggguccggcuacgccgcugacaaggagagcacacagaaggccuuugacggaaucaccaacaaagucaauucugugauugaaaagaugaacacccaguucgaggcgguuggcaaagaauuugggaaucuggagcgcagacucgaaaaccugaauaagcggauggaggauggauuccuugacguguggacauauaacgccgagcugcucguccugauggaaaaugagcgcacccuugauuuccacgacuccaacgugaaaaaucuguacgauaagguuagaaugcagcuccgggacaacgugaaggaacugggcaacggguguuuugaguucuaucauaaaugcgaugacgaguguaugaauagcgucaagaacggaacauacgauuacccuaaauaugaagaggaaucuaagcugaauagaaacgagaucaaaggcgugaagcucagcuccaugggggucuaccaaauucuggcuaucuaugccacgguggcuggcucucuuagccuggccauuaugauggccggaaucuccuuuuggaugugcagcaauggcucucuccagugccgcaucuguauuuga

SEQ ID NO: 196854 - RNA, 1701 nt, Artificial Sequence
  derived and/or modified sequence opt5 from hemagglutinin_precursor__InfluenzaA__AAA43187
augaagaccaucauugcccugagccacaucuucugccucgugcugggccaguaccuucccgggaacgacaauuccacagcuacgcugugucucggacaucacgccgucccuaacggcacccugguuaaaacaauuaccaaugaucaaaucgaggugacaaacgcgaccgaacuugugcagucuagcuccacagggaagauuugcaauaacccgcauagaauccuggacggaaucgauuguacccucauugacgcucugcugggcgauccccacugcgacggguuucagaaugagacgugggaucucuucgucgaacggucuaaagccuuuagcaacuguuauccuuacgacgugcccgauuaugccucccugcgcucucuuguugcuagcuccggaacccuggaguucaucacagaaggcuuuaccuggacaggcgugacccagaaugggggaagcaacgccugcaagagaggcccugggucuggauucuuuucccggcucaauuggcugacgaaaagcgagucuacauaccccguccuuaacgugaccaugccuaauaacgacaauuucgauaagcuguauauuuggggcguucaucacccguccacaaaccaagagcagaccagccucuacgugcaggcuucugggcgcgucaccguguccacaagacggagccagcaaacgaucauucccaacaucggaucccgcccuugggugagaggccugucuagccggauuuccaucuauuggaccaucgucaagcccggcgacguucuggugauuaauagcaacgccaaucucaucgcgccucgcggguacuuuaaaaugagaacaggaaagucuuccauuaugcggagcgaugcccccaucgacaccuguauuucugaaugcaucacaccgaacggcagcaucccuaaugacaaacccuuccagaacgugaauaagauuaccuacggggcuuguccuaaauaugucaagcagaacacgcugaaacuugccacacgcaugagaaaugugcccgagaaacagacccggggacuguuuggcgcuaucgccggguucauugaaaacggaugggagggcaugaucgauggcugguacggguuucgccaccaaaauuccgagggaaccggccaggcggccgaccucaagucuacacaggcugccauugaucaaaucaacgggaaacugaauagaguuaucgaaaagaccaacgagaaauuccaucagauugaaaaggaguucagcgaaguggagggacggauccaggaccuugagaaauaugucgaagauacaaagauugaccugugguccuacaaugcugagcuccugguggcccuggaaaaccagcacacgaucgaucucaccgacagcgagaugaacaagcuguuugaaaagacaagacgccaacuucgggagaaugccgaggauaugggcaacgggugcuucaagauuuaugacaaaugugauaaugcuugcaucgaaucuauuagaaacggcaccuacgaccaugacguuuaucgcgaugaggcgcugaauaaccgguuucagaucaagggaguggaacucaaauccggcuacaaggacuggauccuguggauuagcuucgccaucucuugcuuucuucugugugucgugcuccugggguucauuaugugggcuugccagagaggaaauauccgcuguaacauuugcaucuga

SEQ ID NO: 196855 - RNA, 1698 nt, Artificial Sequence
  derived and/or modified sequence opt5 from hemagglutinin_precursor__InfluenzaA__AAA43209
augaaggccaaacugcucgugcugcuuuacgcuuucgucgccaccgacgcggauacaaucugcauuggcuaucacgcuaacaauagcacggacaccguugauacaaucuuugagaagaacguggccgugacccauuccgucaaucugcucgaagacagacacaacgggaaacuguguaaacuuaagggaauugcuccccugcagcucggcaagugcaauaucacaggguggcugcugggaaacccugagugugauucucuccugccggcccggagcugguccuacauuguggaaacccccaauucugagaacggcgccugcuauccuggggacuucaucgauuacgaagaacuucgcgagcaacugagcuccguuucuagccucgaaagauuugagaucuuccccaaggaauccagcuggccuaaucauacauuuaacggagugaccgucucuuguucccaccggggcaaaagcucuuucuaucgcaaucugcuuuggcugacgaagaaaggcgacuccuaccccaagcucaccaacagcuaugugaauaacaaagggaaggagguucuggugcuguggggaguccaucacccuucuuccagcgaugagcagcagucccucuacucuaauggcaacgcuuacgugagcguggccuccagcaacuauaauagacgguuuacaccggaaauugcggcccgccccaaggucaaagaccagcacgggagaaugaacuacuauuggacccugcuugagccuggagauacaaucauuuucgaagcuaccggcaaucugaucgcccccugguacgcuuuugcccucucucggggguucgaguccggaauuaucacgagcaacgcgucuaugcaugaaugcaauacaaagugucaaaccccucagggcagcauuaacuccaaucugcccuuucagaacauccacccgguuacaaucggcgagugcccuaaauaugugcgcucuaccaagcugagaauggugaccgggcuucggaauauucccagcauccaguaccgcggacucuucggcgccauugcuggguuuaucgagggaggcuggacagggaugauugacggaugguauggcuaccaucaccaaaacgaacagggcuccggguacgccgcugaucagaaaagcacgcagaaugccaucaacggaaucaccaauaaggucaacucugugauugagaaaaugaauacacaauucaccgccguuggcaaggaguucaacaaccuggagaagagaauggaaaaucugaacaaaaagguggacgacggguuucucgauaucuggacauauaaugcugagcugcuuguccugcucgagaacgaacggacccuggacuuccacgaucuuaaugugaaaaaccuguacgagaagguuaaaucccagcucaagaauaacgcgaaggaaauuggaaauggcuguuuugaguucuaucauaaaugcgacaacgaauguauggagagcgugcgcaaugggacguacgauuauccuaaguacucugaggaauccaaacugaacagagagaagaucgacggcgucaaacuggaaagcaugggaguguaucagauucucgccaucuacuccacagucgcuucuagccuggugcuucugguuucccucggcgccaucucuuuuuggaugugcagcaaugggucccugcaaugccggauuuguaucuga

SEQ ID NO: 196856 - RNA, 1683 nt, Artificial Sequence
  derived and/or modified sequence opt5 from hemagglutinin_precursor__InfluenzaA__AAC40998
augaacacccagauccugauucucgcccugguggcuaucauucccacaaaugccgacaagaucugccuuggccaccaugcggucagcaacggggcuaaaguuaauacgcugaccgagagaggaguggaaguggucaacgccacagagaccguggaacggacaaauguuccucgcauuuguuccaagggcaaaagaaccguggaucucgggcaaugcggacugcuuggcacaaucaccgggccgccccagugugaccaguuccuggaguuuucugccgaucucaucauugaacggcgcgagggaaacgacgucugcuacccuggcaaguucgugaaugaggaagcucugagacagauccugcggaaaagcggcgggauugauaaggagacgaugggauuuaccuauuccggcauccgcacaaacggggccaccucugcuuguagacggagcggauccucuuucuacgccgaaaugaaguggcuccugagcaauacagacaacgcggccuuuccccaaaugaccaaauccuauaagaauauucgcaaagauccugcucuuaucauuuggggcauccaccauagcgggucuacggccgagcagacaaagcuguacggauccggcaacaaacucaucaccguuggcagcucuaauuaucagcaguccuucgugcccagcccuggggcuagaccgcaagucaacggacagucuggccggauugacuuucacuggcugaugcuuaaucccaacgauacagugaccuucuccuuuaacggggccuucaucgcgccugaccgcgccagcuuucugagaggaaaguccaugggcauucagucugaggugcaggucgaugcuaauugcgaaggggacuguuaccauagcggaggcaccauccucuccagccugcccuuccaaaacauuaauucucggacaguuggcgagugcccucgcuaugugaagcaggaaucccugcuccuggccacggggaugaaaaacgugcccgagaucccgaagggaagaggccuuuuuggggcuaucgccggauucauugaaaauggcugggaggggcuggucgauggcugguacggauuccggcaccagaacgcccaaggcgaggggaccgcugcggacuacaaaagcacacagucugccaucgaccagauuaccggaaagcucaauagacugaucgagaaaacaaaccagcaauuugaacuuauugauaaugaguucaccgaaguggaaaagcagaucggcaacguuaucaauuggacgcgcgacagccugacagagaugugguccuauaacgcugagcuccugguggccauggaaaaucagcacaccauugaucuggccgacucugagaugaacaaacucuacgaacgggucagacgccagcugcgggagaaugcugaagaggaugggaccggauguuuugagaucuuccauaagugcgacgaugacuguauggccagcauuagaaacaacacauaugaucacuccaaguaccgcgaagaggcgauccaaaaucggauucagaucgacccugugaaacuuagcucuggcuauaaggauguuauucugugguuuuccuucggggcuagcugcuuuauccuccuggccaucgccaugggccuuguguucauuugcgucaaaaacggaaauaugagauguaccaucugcauuuga

SEQ ID NO: 196857 - RNA, 1683 nt, Artificial Sequence
  derived and/or modified sequence opt5 from hemagglutinin_precursor__InfluenzaA__AAC40999
augaacacccagauccugauucucgcccugguggcuaucauucccacaaaugccgacaagaucugccuuggccaccaugcggucagcaacgggacgaaaguuaauacccugacagagagaggaguggaaguggucaacgcuaccgagacaguggaacggaccaauguuccucgcauuuguuccaagggcaaaagaacaguggaucucgggcaaugcggacugcuuggcaccaucacggggccgccccagugugaccaguuccuggaguuuucugccgaucucaucauugaacggcgcgagggagacgaugucugcuacccuggcaaguucgugaacgaggaagcccugagacagauccugcgggagagcggcgggauugacaaagaaaccaugggauuuacauauuccggcauccgcaccaauggggcuacaucugccuguagacggagcggauccucuuucuacgcugagaugaaguggcuccugagcaacaccgauaaugccgcguuuccccaaaugacgaaguccuauaaaaacauucgcaaggacccugcccuuaucauuuggggcauccaccauagcgggucuacagcugagcagaccaaacuguacggauccggcaauaagcucaucacaguuggcagcucuaacuaucagcaguccuucgugcccauuccuggggccagaccgcaagucaauggacagagcggccggaucgauuuucacuggcugaugcuuaaccccaaugacaccgugaccuucucuuuuaacggggcuuucauugccccugaucgcgcguccuuucugagaggaaaaagcaugggcauccaguccgaagugcaggucgacgccaacugcgagggggauuguuaccauucuggaggcacaauucucaauaaccugcccuuccaaaauaucaacggccgggcuguugggaagugcccucgcuaugugaagcaggaaagccugcuccuggccacgggaaugaaaaaugugcccgagaucccgaagggcagagggcuuuuuggagcuauugccggcuucaucgaaaacgggugggagggccuggucgacggaugguacggcuuccggcaccagaaugcccaaggggagggaaccgcugcggacuacaaauccacacagagcgccauugaucagaucaccggcaagcucaacagacugauugagaaaacaaaucagcaauuugaacuuaucgacaacgaguucaccgaaguggaaaagcagaucgggaauguuauuaacuggacgcgcgauucuaugacagaggugugguccuauaaugcugagcugcucgucgccauggaaaaccagcacaccaucgaccuggccgauagcgagaugaauaaacuguacgaacgggugagacgccagcuccgggagaacgcugaagaggacggaaccggcuguuuugagauuuuccauaagugcgaugacgauuguauggccucuaucagaaacaauacauaugaccacagcaaguaccgcgaagaggcgauucaaaaccggauccagauugauccuguuaaacuguccucuggguauaaggacgugauccuuugguuuagcuucggcgcuuccugcuuuauccugcucgccauugccaugggacuggucuucaucugcgugaaaaauggcaacaugagauguaccauuugcaucuga

SEQ ID NO: 196858 - RNA, 1698 nt, Artificial Sequence; identical to SEQ ID NO: 185512
  derived and/or modified sequence opt5 from hemagglutinin__InfluenzaA__ACA28844

SEQ ID NO: 196859 - RNA, 1698 nt, Artificial Sequence; identical to SEQ ID NO: 190817
  derived and/or modified sequence opt5 from hemagglutinin__InfluenzaA__ACA28844/m1

SEQ ID NO: 196860 - RNA, 1701 nt, Artificial Sequence; identical to SEQ ID NO: 192174
  derived and/or modified sequence opt5 from hemagglutinin__InfluenzaA__ACV82259

SEQ ID NO: 196861 - RNA, 1701 nt, Artificial Sequence; identical to SEQ ID NO: 192174
  derived and/or modified sequence opt5 from hemagglutinin__InfluenzaA__ACV82259/m1

SEQ ID NO: 196862 - RNA, 1701 nt, Artificial Sequence; identical to SEQ ID NO: 192174
  derived and/or modified sequence opt5 from hemagglutinin__InfluenzaA__ACV82259/m2

SEQ ID NO: 196863 - RNA, 1701 nt, Artificial Sequence; identical to SEQ ID NO: 185691
  derived and/or modified sequence opt5 from hemagglutinin__InfluenzaA__ACP41953

SEQ ID NO: 196864 - RNA, 1701 nt, Artificial Sequence; identical to SEQ ID NO: 195265
  derived and/or modified sequence opt5 from hemagglutinin__InfluenzaA__AFM72832

SEQ ID NO: 196865 - RNA, 1701 nt, Artificial Sequence
  derived and/or modified sequence opt5 from hemagglutinin__InfluenzaA__EPI516528
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccccguccucugacaacggcacgugcuaucccggggauuuuauugacuacgaagaacugcgggagcagcuuagcuccgucagcucuuucgaacgcuuugagaucuucccuaagaccuccagcuggcccaaucacgauucuaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcagcuccagauauagcaagaaauuuaagccggagauugcuauccggcccaaaguccgcgaucaggaggggagaaugaauuacuauuggacacugguugaaccuggagacaagauuaccuucgaggccacgggcaaccugguggugccccgguacgcguuugccauggaacgcaacgcugggucuggaaucauuaucuccgauacaccuguccaugacugcaauaccacaugucaaacccccaaaggcgccaucaacaccagccucccguuccagaauauucacccuaucacaauuggcaagugccccaaguaugugaaaucuacgaagcugagacuugcuaccgggcugcggaacaucccuagcauucagucccgcggacucuuuggcgccaucgccggguucaucgagggaggcuggacagggaugguugacggaugguacggcuaucaucaccagaaugaacaaggcucuggguacgcugcggaucugaaaagcacccagaacgccauugacgagaucacaaauaaggugaacuccgucauugagaaaaugaauacccaguuuacggcugugggaaaggaguucaaccaccuugagaagagaaucgaaaaucugaacaaaaagguugaugacggcuuccucgauauuuggacauacaaugccgagcugcuggugcuccuggaaaacgagcggacccuugacuaucaugauagcaaugucaaaaaccuguacgagaaggugcgcucucagcucaaaaacaaugccaaggaaaucgggaacggauguuuugaguucuaucacaagugcgacaauaccuguauggaauccgucaaaaacggcacauacgauuaucccaaguacagcgaggaagcuaaacugaauagagaggagaucgacggggugaaacuugaaucuacccggauuuaucaaauccuggccauuuacuccacaguugcgagcucccucgugcuggucgugucucugggcgcuaucagcuuuuggaugugcuccaacggaucucuccauugccgcauuuguguuuga

SEQ ID NO: 196866 - RNA, 1701 nt, Artificial Sequence
  derived and/or modified sequence opt5 from hemagglutinin__InfluenzaA__AGM53850
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccccguccucugacaacggcacgugcuaucccggggauuuuauugacuacgaagaacugcgggagcagcuuagcuccgucagcucuuucgaacgcuuugagaucuucccuaagaccuccagcuggcccaaucacgauucuaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuccgaccagcgccgaucaacagucccucuaccagaacgcugacgccuacguguucgugggcucuagcagauauuccaagaaauuuaagcccgagauugcuauccggccuaaaguccgcgaucaggaggggagaaugaauuacuauuggacacugguugaacccggagacaagauuaccuucgaggccacgggcaaccugguggugccucgguacgcguuugccauggaacgcaacgcugggagcggaaucauuaucucugauacacccguccaugacugcaauaccacaugucaaaccccgaaaggcgccaucaacaccucccucccuuuccagaauauucaccccaucacaauuggcaagugcccuaaguaugugaaaagcacgaagcugagacuugcuaccgggcugcggaacauccccucuauucagagccgcggacucuuuggcgccaucgccggguucaucgagggaggcuggacagggaugguugacggaugguacggcuaucaucaccagaaugaacaaggcuccggguacgcugcggaucugaaaucuacccagaacgccauugacgagaucacaaauaaggugaacagcgucauugagaaaaugaauacccaguuuacggcugugggaaaggaguucaaccaccuugagaagagaaucgaaaaucugaacaaaaagguugaugacggcuuccucgauauuuggacauacaaugccgagcugcuggugcuccuggaaaacgagcggacccuugacuaucaugauuccaaugucaaaaaccuguacgagaaggugcgcagccagcucaaaaacaaugccaaggaaaucgggaacggauguuuugaguucuaucacaagugcgacaauaccuguauggaaucugucaaaaacggcacauacgauuaucccaaguacuccgaggaagcuaaacugaauagagaggagaucgacggggugaaacuugaaagcacccggauuuaucaaauccuggccauuuacucuacaguugcguccagccucgugcuggucgugucccugggcgcuaucucuuuuuggaugugcagcaacggaucccuccagugccgcauuuguaucuga

SEQ ID NO: 196867 - RNA, 1701 nt, Artificial Sequence
  derived and/or modified sequence opt5 from hemagglutinin__InfluenzaA__EPI731463
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccccguccucugacaacggcacgugcuaucccggggauuuuauugacuacgaagaacugcgggagcagcuuagcuccgucagcucuuucgaacgcuuugagaucuucccuaauaccuccagcuggcccaaccacgauucuaauaagggagugacagccgcuuguccucaugccggcgcgaaguccuuuuauaaaaaccugaucuggcucguuaagaaaggcaauagcuaccccaagcugucuaaauccuauauuaacgacaaggggaaggaagugcuuguccuguggggaauccaccacccuagcaccuccgccgaucaacagucucucuaccagaaugcugacgccuacguguucgugggcagcuccagauauagcaaaaaguuuaaaccggagauugcuauccggcccaagguccgcgggcaggagggaagaaugaacuacuauuggacacugguugaaccuggcgauaaaauuaccuucgaggccacggggaaccugguggugccccgguacgcguuugccauggaacgcaaugcuggaucuggcaucauuaucuccgacacaccuguccaugauugcaacaccacaugucaaacccccaagggcgccaucaauaccagccucccguuccagaacauucacccuaucacaauugggaaaugccccaaguaugugaagucuacgaaacugagacuugcuaccggacugcggaauaucccuagcauucagucccgcggccucuuuggggccaucgccggauucaucgagggcggguggacaggaaugguugacggcugguacggcuaucaucaccagaacgaacaagggucuggauacgcugcggaccugaaguccacccagaaugccauugaugagaucacaaacaaagugaauagcgucauugagaagaugaacacccaguuuacggcugugggcaaagaguucaaucaccuugagaagagaaucgaaaaccugaauaagaaaguugacgauggguuccucgacauuuggacauacaacgccgagcugcuggugcuccuggaaaaugagcggacccuugauuaucaugacagcaacgucaagaaccuguacgagaaagugcgcucucagcucaagaauaacgccaaagaaaucggaaauggcuguuuugaguucuaucacaagugcgauaacaccuguauggaauccgucaagaaugggacauacgacuaucccaaauacagcgaggaagcuaagcugaacagagaggagaucgauggcgugaaacuugaaucuacccggauuuaucaaauccuggccauuuacuccacaguugcgagcucccucgugcuggucgugucucugggagcuaucagcuuuuggaugugcuccaauggcucucuccagugccgcauuuguaucuga

SEQ ID NO: 196868 - RNA, 1701 nt, Artificial Sequence; identical to SEQ ID NO: 187522
  derived and/or modified sequence opt5 from hemagglutinin__InfluenzaA__EPI696972

SEQ ID NO: 196869 - RNA, 1701 nt, Artificial Sequence; identical to SEQ ID NO: 196710
  derived and/or modified sequence opt5 from hemagglutinin__InfluenzaA__EPI662594

SEQ ID NO: 196870 - RNA, 1701 nt, Artificial Sequence
  derived and/or modified sequence opt5 from hemagglutinin__InfluenzaA__EPI685579
augaaggccauccuggugguccuccuguacaccuucacaacggcuaacgccgacacccuuugcauuggcuaucacgcgaauaacagcacagauaccguugacacagugcuggagaagaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccaacucugacaaugggaccugcuauccgggcgauuuuauuaacuacgaagaacugcgggagcagcuuagcuccgucagcucuuucgaacgcuuugagaucuuccccaagacauccagcuggccuaaucacgacucuaacaagggagugaccgcugccuguccccaugcuggcgccaaauccuuuuauaagaaucugaucuggcucguuaaaaagggcaacagcuacccuaaacugaaucaaucuuauauuaacgauaaggggaaggaagugcuuguccuguggggaauccaccaccccuccacaaccgcggaccagcagagccucuaccagaacgccgaugcuuacguguucgugggcacguccagauauucuaaaaaguuuaaaccugagauugccacacggccgaagguccgcgacagagaggggcggaugaauuacuauuggacccugguugaacccggagauaaaaucacauucgaggcuaccggcaaccugguggugccucgcuacgccuuuaccauggaaagaaaugcggggagcggaauuaucauuuccgacacacccguccaugauugcaacacgaccugucaaacaccugagggcgccaucaauaccagccuccccuuccagaacauccacccgauuacaaucggcaagugcccuaaauaugugaagucuaccaagcugcggcuugcuacggggcugcgcaauguucccuccauucagagcagaggacucuuuggcgccaucgcuggguucauugaaggaggcuggacagggaugguggacggaugguacggcuaucaucaccagaacgagcaaggcucuggguacgccgccgaccugaaaagcacccagaaugcuaucgauaagaucaccaacaaagucaauuccgugauugagaagaugaacacacaguuuaccgcgguuggaaaagaguucaaucaccuugagaagcggaucgaaaaccugaauaagaaaguggacgauggcuuccucgacauuuggacauacaacgccgagcugcugguccuccuggaaaacgagcgcacgcuugauuaucaugacucuaaugugaagaaccuguacgagaaagucagaaaucagcucaagaacaaugcuaaagaaaucgggaacggauguuuugaguucuaucacaagugcgauaauaccuguauggaaagcgugaagaacggcacauacgacuauccuaaauacuccgaggaagccaagcugaaucgggagaaaauugaugggguuaaacuugagagcacccgcaucuaucaaauccuggccauuuacucuacaguggcuuccagccucguccuggugguuucucugggcgccaucuccuuuuggaugugcagcaacggaucccuccagugcagaauuuguaucuga

SEQ ID NO: 196871 - RNA, 1701 nt, Artificial Sequence
  derived and/or modified sequence opt5 from hemagglutinin__InfluenzaA__EPI830230
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccaacucugacaaugggaccugcuauccgggcgauuuuauuaacuacgaagaacugcgggagcagcuuagcuccgucagcucuuucgaacgcuuugagaucuuccccaagacauccagcuggccuaaucacgacucuaacaagggagugaccgcugccuguccccaugcuggcgccaaauccuuuuauaagaaucugaucuggcucguuaaaaagggcaacagcuacccuaaacugaaucaaucuuauauuaacgauaaggggaaggaagugcuuguccuguggggaauccaccaccccuccacaaccgcggaccagcagagccucuaccagaacgccgaugcuuacguguucgugggcacguccagauauucuaaaauguuuaagccugagauugccacacggccgaaaguccgcgacagagaggggcggaugaauuacuauuggacccugguugaacccggagauaagaucacauucgaggcuaccggcaaccugguggugccucgcuacgccuuuaccauggaaagaaaugcggggagcggaauuaucauuuccgacacacccguccaugauugcaacacgaccugucaaacaccugagggcgccaucaauaccagccuccccuuccagaacauccacccgauuacaaucggcaaaugcccuaaguaugugaaaucuaccaagcugcggcuugcuacggggcugcgcaauguucccuccauucagagcagaggacucuuuggcgccaucgcuggguucauugaaggaggcuggacagggaugguggacggaugguacggcuaucaucaccagaacgagcaaggcucuggguacgccgccgaccuuaagagcacccagaaugcuaucgauaaaaucaccaacaaggucaauuccgugauugagaaaaugaacacacaguuuaccgcgguuggaaaggaguucaaucaccuggagaaacggaucgaaaaccugaauaagaagguggacgauggcuuccucgacauuuggacauacaacgccgagcugcugguccuccuggaaaacgagcgcacgcuugauuaucaugacucuaaugugaaaaaccuguacgagaaggucagaaaucagcucaaaaacaaugcuaaggaaaucgggaacggauguuuugaguucuaucacaaaugcgauaauaccuguauggaaagcgugaagaacggcacauacgacuauccuaaguacuccgaggaagccaaacugaaucgggagaagauugaugggguuaaacuugagagcacccgcaucuaucaaauccuggccauuuacucuacaguggcuuccagccucguccuggugguuucucugggcgccaucuccuuuuggaugugcagcaacggaucccuccagugcagaauuuguaucuga

SEQ ID NO: 196872 - RNA, 1701 nt, Artificial Sequence; identical to SEQ ID NO: 185680
  derived and/or modified sequence opt5 from hemagglutinin__InfluenzaA__ACQ45338

SEQ ID NO: 196873 - RNA, 1701 nt, Artificial Sequence; identical to SEQ ID NO: 185680
  derived and/or modified sequence opt5 from hemagglutinin__InfluenzaA__ACQ45338/m1

SEQ ID NO: 196874 - RNA, 1701 nt, Artificial Sequence; identical to SEQ ID NO: 185680
  derived and/or modified sequence opt5 from hemagglutinin__InfluenzaA__ACQ45338/m2

SEQ ID NO: 196875 - RNA, 1701 nt, Artificial Sequence; identical to SEQ ID NO: 185342
  derived and/or modified sequence opt5 from hemagglutinin__InfluenzaA__ACU79871

SEQ ID NO: 196876 - RNA, 1701 nt, Artificial Sequence
  derived and/or modified sequence opt5 from hemagglutinin__InfluenzaA__ACU79871/m1
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucgauuguacccucauugacgcccugcugggcgauccccauugcgacguguuucagaacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaccccguccuuaaugugaccaugccuaacaaugacaacuucgauaagcuguauauuuggggcguucaccauccguccacaaaucaagagcagaccagccucuacgugcaggccucugggcgcgucaccguguccacaagacggagccagcaaacgaucauucccaacaucgagucccgcccuugggugagaggacagucuagccggauuuccaucuauuggaccaucgucaagcccggcgacguucuggugauuaacagcaauggcaaccugaucgcgccucgcggguacuuuaaaaugagaacaggaaagucuuccauuaugcggagcgacgcccccaucgauaccuguauuucugaaugcaucacaccgaauggcagcaucccuaacgacaaacccuuccagaaugugaacaagauuaccuacggggcuuguccuaaauaugucaagcagaauacgcucaagcuggccacaggaaugcgcaacgugcccgagaaacaaaccagaggccuuuuuggggcuaucgccggauucauugaaaauggcugggagggcaugaucgaugggugguacggauuucggcaccagaacuccgagggcaccgggcaggcggccgaccugaagucuacacaagcugccauugaucagaucaauggaaaaguuaaccgcaucauugaaaagaccaaugagaaauuccaccagaucgaaaaggaguucagcgaaguggagggccggauucaggaccucgagaaauaugucgaagauacaaagaucgaccugugguccuacaacgcugagcuucugguggcccucgaaaaucaacauacgauugaucugaccgacagcgagaugaacaagcuguuugagaaaacaagaagacagcuccgcgaaaacgccgaggauauggggaauggcugcuucaagaucuaucacaaaugugacaacgcuugcauugaaucuauccgguccggaaccuacgaccaugauguuuauagagacgaggcgcugaauaaccgcuuucagaucaagggcguggaacuuaaaagcggguacaaggauuggauucuguggaucucuuucgccauuuccugcuuucuccugugugucgugcuucugggauucaucaugugggcuugccagcggggcaauauuagauguaacaucugcaucuga

SEQ ID NO: 196877 - RNA, 1701 nt, Artificial Sequence
  derived and/or modified sequence opt5 from hemagglutinin__InfluenzaA__EPI643118
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauaaguacccugcccugaaugucacaaugcccaacaacgagcaguuugacaaacuuuauauuuggggcgugcaccauccugggaccgauaaggaccagaucuucccguacgcgcaguccagcggaagaauuaucguuuccacgaagcggucucaacaggccgugauccccaauauuggcagccgcccuagaauccgggauauucccucccgcaucagcauuuacuggacaaucgucaaaccuggggacauccugcucauuaacucuaccggaaaucugaucgcucccagaggcuauuuuaagcugcgguccgggaaaagcucuauuaugcgcagcgacgccccgaucggaaaguguaaguccgaaugcauuacaccuaacggcucuauccccaaugauaaaccuuuccagaacgugaauagaaucaccuacggcgcuuguccccgguaugugaagcacagcacccucaaacuggccacagggaugcgcaacguccccgagaagcagacgagaggaauuuuuggcgcgaucgccggguucauugaaaauggaugggagggcaugguugacgggugguacggauuucggcaccaaaacuccgagggcagaggccaggcugccgaucuuaaaagcacccaggcugccaucgaccaaauuaaugggaagcugaaccgccucaucggaaaaacaaaugaaaaguuccaucagauugagaaggaguucucugaaguggaaggccggauccaggaucuggagaaauauguggaggacaccaagaucgaucuuugguccuacaacgccgaacugcucgucgcucuggagaaucagcacacaauugaccugaccgauagcgaaaugaacaaacucuuugagaagacgaaaaagcaacugagagaaaacgcggaggacauggggaauggaugcuucaagaucuaucauaaaugugauaacgccugcauuggcucuauccgcaaugggacauacgaccacaacguguaccgggacgaggcucuuaauaacagauuucagauuaagggcguugaacugaaauccggauauaaggauuggauccucuggaucagcuucgccauuuccugcuuucugcuuuguguggcccugcucggcuucaucaugugggcuugccagaaagggaauauucgcuguaacaucugcauuuga

SEQ ID NO: 196878 - RNA, 1701 nt, Artificial Sequence; identical to SEQ ID NO: 195465
  derived and/or modified sequence opt5 from hemagglutinin__InfluenzaA__EPI675798

SEQ ID NO: 196879 - RNA, 1701 nt, Artificial Sequence
  derived and/or modified sequence opt5 from hemagglutinin__InfluenzaA__EPI578430
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcuccuguuacccuuaugacgugcccgauuacgcuucucugcgcagccucguugccuccagcgggacccuggaauuuaacaaugagucuuucaacuggacgggagugacccaaaauggcacauccagcgcuugcaucagacggucuuccagcucuuucuucucccgccuuaacuggcugacccaucucaauuauaaguacccugcccugaacgucacaaugcccaauaacgagcaguuugacaaacuuuauauuuggggcgugcaccauccugggaccgauaaagaccagaucuucccguacgcgcagagcuccggaagaauuacgguuucuacaaagcggagccaacaggccgugauccccaacaucggcucccgcccucggauuagagauauccccagccgcauuucuaucuacuggaccauugucaaaccuggggacauccugcucaucaauuccacaggaaaccugauugcucccagaggcuauuuuaagauccggagcgggaaaucuagcauuaugcgcuccgacgccccgaucggaaaguguaagucugaaugcauuaccccuaauggcagcauccccaacgauaaaccuuuccagaaugugaacagaaucaccuacggcgcuuguccccgguaugugaagcacuccacacugaaacucgccacggggaugcgcaauguccccgagaagcagaccagaggaauuuuuggcgcgaucgccggguucauugaaaacggaugggagggcaugguugacgggugguacggauuucggcaccaaaauagcgagggcagaggccaggcugccgaucugaaaucuacacaggcugccaucgaccaaauuaacgggaaacuuaaucgccugaucggaaagaccaacgaaaaguuccaucagauugagaaggaauuuuccgagguggaaggccggauccaggaucucgagaaauauguggaggacacaaagaucgaucuguggagcuacaaugccgaacuucuggucgcucucgagaaccagcacaccauugaccugacggauucugaaaugaauaaacuguuugagaagacaaagaagcaacucagagaaaacgcggaggacauggggaacggaugcuucaagaucuaucauaaaugugauaaugccugcauuggcuccauccgcaacgggaccuacgaccacaauguguaccgggacgaggcucugaacaauagauuucagauuaagggcguugaacuuaaaagcggauauaaggauuggauccuguggaucuccuucgccauuucuugcuuucuccuguguguggcccuucugggcuucaucaugugggcuugccagaaagggaacauucgcuguaauaucugcauuuga

SEQ ID NO: 196880 - RNA, 1701 nt, Artificial Sequence
  derived and/or modified sequence opt5 from hemagglutinin__InfluenzaA__EPI614406
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcuccuguuacccuuaugacgugcccgauuacgcuucucugcgcagccucguugccuccagcgggacccuggaauuuaacaaugagucuuucaacuggacgggagugacccaaaauggcacauccagcgcuugcaucagacggucuuccagcucuuucuucucccgccuuaacuggcugacccaucucaauuauaaguacccugcccugaacgucacaaugcccaauaacgagcaguuugacaaacuuuauauuuggggcgugcaccauccugggaccgauaaagaccagaucuucccguacgcgcagagcuccggaagaauuacgguuucuacaaagcggagccaacaggccgugauccccaacaucggcucccgcccucggauuagaaauauccccagccgcauuucuaucuacuggaccauugucaaaccuggggauauccugcucaucaacuccacaggaaaucugauugcucccagaggcuauuuuaagauccggagcgggaaaucuagcauuaugcgcuccgacgccccgaucggaaaguguaagucugaaugcauuaccccuaacggcagcauccccaaugacaaaccuuuccagaacgugaauagaaucaccuacggcgcuuguccccgguaugugaagcacuccacacugaaacucgccacggggaugcgcaacguccccgagaagcagaccagaggaauuuuuggcgcgaucgccggguucauugaaaauggaugggagggcaugguugaugggugguacggauuucggcaccaaaacagcgagggcagaggccaggcugccgaccugaaaucuacacaggcugccaucgaucaaauuaaugggaaacuuaaccgccugaucggaaagaccaaugaaaaguuccaucagauugagaaggaauuuuccgagguggaaggccggauccaggaccucgagaaauauguggaggauacaaagaucgaccuguggagcuacaacgccgaacuucuggucgcucucgagaaucagcacaccauugaucugacggacucugaaaugaacaaacuguuugagaagacaaagaagcaacucagagaaaacgcggaggauauggggaauggaugcuucaagaucuaucauaaaugugacaacgccugcauuggcuccauccgcaaugggaccuacgaucacaacguguaccgggacgaggcucugaauaacagauuucagauuaagggcguugaacuuaaaagcggauauaaggacuggauccuguggaucuccuucgccauuucuugcuuucuccuguguguggcccuucugggcuucaucaugugggcuugccagaaagggaauauucgcuguaacaucugcauuuga

SEQ ID NO: 196881 - RNA, 1695 nt, Artificial Sequence
  derived and/or modified sequence opt5 from hemagglutinin__InfluenzaA__ACU65077/m1
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugaaaagacacacaaugggaagcugugugaucucgacggagugaaaccccugauccuuagagauugcagcguugcgggcuggcugcucgggaacccuaugugugacgaguuuaucaaugugccggaaugguccuauauugucgagaaggcuaaccccgugaaugaucugugcuacccuggagacuucaacgauuaugaggaacugaagcaucuccugucucggaucaaucacuuugagaaaauucagaucauucccaagagcuccuggucuagccaugaagccucccuuggcguuagcucugccuguccuuaccaggggaaauccagcuucuuucgcaacguggucuggcugaucaagaaaaauucuaccuaucccacaauuaagagauccuacaacaauaccaaccaagaggaccuccuggugcuuuggggaauccaccacccuaaugaugcugccgagcagacaaagcuguaucagaacccgaccacguacaucagcgugggcaccucuacacucaaccagcggcuggucccccgcauugcuaccagauccaaaguuaauggccaaagcgggcggauggaguucuuuuggacaauccugaagccuaacgacgccauuaauuucgaauccaacggaaauuuuaucgcgcccgaauacgccuauaaaauugugaagaaaggcgauucuaccaucaugaaaagcgagcucgaauacgggaacugcaauacgaaaugucagacaccuaugggagcuaucaacuccagcaugcccuuccauaauauucacccgcugaccaucggcgagugcccuaaguaugugaagucuaaccgccuuguccuggccacagggcucagaaauagcccccagcgggagacccgcggacuguuuggcgcuauugccggcuucaucgaagggggauggcagggcaugguggacgggugguacggauaucaucacuccaacgagcaaggcucuggguacgcggccgacaaagaaagcacccagaaggcuauugauggaguuacaaauaaagugaacuccaucaucgacaagaugaauacgcaguuugaggccgucggcagagaguucaacaaccuugaacggcgcauugagaaucugaacaaaaagauggaagauggcuuccucgacguguggaccuauaaugcugagcugcugguucucauggaaaacgagagaacacuggauuuucacgacucuaaugugaagaaccuuuacgauaaaguccggcugcaacuccgcgacaaugccaaggaacuggggaacggauguuucgaguuuuaccauaaaugcgauaaugaguguauggaaagcgugagaaacggcaccuaugacuacccucaguauuccgaggaagcccggcuuaagagagaggagaucagcggggucaaacuggaaucuauuggaaucuaccagauucucuccaucuauagcacaguggcuucuucccuggcgcuggccauuaugguugcuggccucagccuguggaugugcuccaaugggucucuucagugccgcaucuguaucuga

SEQ ID NO: 196882 - RNA, 1695 nt, Artificial Sequence; identical to SEQ ID NO: 196881
  derived and/or modified sequence opt5 from hemagglutinin__InfluenzaA__ACU65077/m2

SEQ ID NO: 196883 - RNA, 1707 nt, Artificial Sequence; identical to SEQ ID NO: 183052
  derived and/or modified sequence opt5 from hemagglutinin__InfluenzaA__ABP51976

SEQ ID NO: 196884 - RNA, 1707 nt, Artificial Sequence; identical to SEQ ID NO: 183052
  derived and/or modified sequence opt5 from hemagglutinin__InfluenzaA__ABP51976/m1

SEQ ID NO: 196885 - RNA, 1695 nt, Artificial Sequence
  derived and/or modified sequence opt5 from hemagglutinin__InfluenzaA__ABW90125
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugagaaaaagcacaaugggaaacugugugaucucgacggagugaagccccugauccuuagagauugcagcguugcgggcuggcugcucgggaacccuaugugugacgaauuuaucaaugugccggaaugguccuauauugucgagaaggcuaaccccgugaaugaucugugcuacccuggagacuucaacgauuaugaggaacugaaacaucuccugucucggaucaaucacuuugagaagauucagaucauucccaaaagcuacugguccucucaugaagccagccuuggcguuuccagcgccuguccuuaucaggggaagucuuccuucuuucgcaacguggucuggcugaccaaaaagaauagcacauaccccacaaucaagagaucuuauaacaauaccaaccaagaggaccuccuggugcuuuggggcauucaccacccuaaugaugcugccgagcagacaaaacuguaccagaacccgaccacguacaucuccgugggaaccagcacacucaaccagcggcuggucccccgcaucgcuaccagaucuaagguuaauggccaauccgggcggauggaguucuuuuggacaauucugaaaccuaacgacgccaucaauuucgaaagcaacggaaauuuuauugcgcccgaauaugccuacaagaucgugaaaaagggcgauuccaccauuaugaaaucugagcucgaauaugggaacugcaauacgaagugucagacaccuaugggagcuaucaacagcuccaugcccuuccauaauauccacccgcugaccauuggcgagugcccuaaguacgugaaaagcaaccgccuuguccuggccacagggcucagaaauucuccccagcgggagacccgcggacuguuuggcgcuaucgccggcuucauugaagggggauggcagggcaugguggacgggugguauggauaccaucacuccaacgagcaaggcagcggguaugcggccgacaaggaaucuacccagaaagcuaucgauggaguuacaaauaaggugaacagcauuaucgacaaaaugaauacgcaguuugaggccgucggcagagaguucaacaaccuugaacggcgcaucgagaaucugaacaagaagauggaagauggcuuccucgacguguggaccuacaaugcugagcugcugguucucauggaaaacgagagaacacuggauuuucacgacuccaaugugaaaaaccuuuacgauaagguccggcugcaacuccgcgacaaugccaaagaacuggggaacggauguuucgaguuuuaucauaagugcgauaaugaguguauggaaucugugagaaacggcaccuacgacuauccucaguacagcgaggaagcccggcuuaaaagagaggagauuuccggggucaagcuggaaagcaucggaauuuaucagauccucucuauuuacuccacaguggcuagcucucuggcgcuggccaucaugguugcuggccucucccuguggaugugcagcaaugggucccuucagugccgcauuuguaucuga

SEQ ID NO: 196886 - RNA, 1695 nt, Artificial Sequence
  derived and/or modified sequence opt5 from hemagglutinin__InfluenzaA__ABW90126
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugagaaaaagcacaaugggaaacugugugaucucgacggagugaagccccugauccuuagagauugcagcguugcgggcuggcugcucgggaacccuaugugugacgaauuuaucaaugugccggaaugguccuauauugucgagaaggcuaaccccgugaaugaucugugcuacccuggagacuucaacgauuaugaggaacugaaacaucuccugucucggaucaaucacuuugagaagauucagaucauucccaaaagcuccuggucuagccaugaagccucccuuggcguuagcucugccuguccuuaccaggggaaguccagcuucuuucgcaacguggucuggcugaucaaaaagaacucuacauaucccaccauuaagggauccuacaauaauacaaaccaagaggaccuccuggugcuuuggggcauccaccacccuaaugaugcugccgagcagaccaaacuguaucagaacccgacaaccuacaucagcgugggcacgucuacccucaaccagagacuggucccccggauugcuacacgcuccaagguuaaugggcaaagcggaagaauggaguucuuuuggaccauccugaaaccuaacgacgccauuaauuucgaauccaacggcaauuuuaucgcgcccgaauacgccuauaagauugugaaaaagggggauucuacaaucaugaaaagcgagcucgaauacggaaacugcaauaccaagugucagacgccuaugggcgcuaucaacuccagcaugcccuuccauaauauucacccgcugacaaucggggagugcccuaaguaugugaaaucuaaccggcuuguccuggccaccggacuccgcaauagcccccagagagagacacggggccuguuuggcgcuauugccggguucaucgaaggaggcuggcaggggaugguggacggaugguacggcuaucaucacuccaacgagcaagggucuggauacgcggccgacaaggaaagcacccagaaagcuauugauggcguuaccaauaaggugaacuccaucaucgacaaaaugaauacacaguuugaggccgucggccgcgaguucaacaaccuugaaagacggauugagaaucugaacaagaagauggaagauggguuccucgacguguggacguauaaugcugagcugcugguucucauggaaaacgagcgcacccuggauuuucacgacucuaaugugaaaaaccuuuacgauaaggucagacugcaacuccgggacaaugccaaagaacugggaaacggcuguuucgaguuuuaccauaagugcgauaaugaguguauggaaagcgugcgcaacgggacauaugacuacccucaguauuccgaggaagccagacuuaaacgggaggagaucagcggagucaagcuggaaucuauuggcaucuaccagauucucuccaucuauagcaccguggcuucuucccuggcgcuggccauuaugguugcugggcucagccuguggaugugcuccaauggcucucuucagugcagaaucuguaucuga

SEQ ID NO: 196887 - RNA, 1695 nt, Artificial Sequence
  derived and/or modified sequence opt5 from hemagglutinin__InfluenzaA__ABW90127
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugagaaaaagcacaaugggaaacugugugaucucgacggagugaagccccugauccuuagagauugcagcguugcgggcuggcugcucgggaacccuaugugugacgaguuuaucaaugugccggaaugguccuauauugucgagaaggcuaaccccgugaaugaucugugcuacccuggagacuucaacgauuaugaggaacugaaacaucuccugucucggaucaaucacuuugagaagauucagaucauucccaaaagcuccuggucuagccaugaagccucccuuggcguuagcucugccuguccuuaccagggggaguccagcuucuuucgcaacguggucuggcugaucaagaaaaauucuacauaucccaccauuaagagauccuacaacaauacaaaccaagaggaccuccuggugcuuuggggaauccaccacccuaaugaugcugccgaacagaccaagcuguaucagaacccgacaaccuacaucagcgugggcacgucuacccucaaccagcggcuggucccccgcauugcuacaagauccaaaguuaauggccaaagcgggcggauggaguucuuuuggaccauccugaagccuaacgacgccauuaauuucgaauccaacggaaauuuuaucgcgcccgaguacgccuauaaaauugugaagaaaggcgauucuacaaucaugaaguccgaacucgaguacgggaacugcaauaccaaaugucagacgccuaugggagcuaucaacuccagcaugcccuuccauaauauucacccgcugacaaucggcgagugcccuaaguaugugaagucuaaccgccuuguccuggccaccgggcucagaaauagcccccagcgggaaacacgcggacuguuuggcgcuauugccggcuucaucgaagggggauggcagggcaugguggacgggugguacggauaucaucacagcaacgaacaaggcucuggguacgcggccgacaaagagagcacccagaaggcuauugauggaguuaccaauaaagugaacuccaucaucgacaagaugaauacacaguuugaagccgucggcagagaguucaacaaccuugagcggcgcauugaaaaucugaacaaaaagauggaggauggcuuccucgacguguggacguauaaugcugaacugcugguucucauggagaacgaaagaacccuggauuuucacgacucuaaugugaagaaccuuuacgauaaaguccggcugcaacuccgcgacaaugccaaggagcuggggaacggauguuucgaguuuuaccauaaaugcgauaaugaauguauggagagcgugagaaacggcacauaugacuacccucaguauuccgaagaggcccggcuuaagagagaggaaaucagcggggucaaacuggagucuauuggaaucuaccagauucucuccaucuauagcaccguggcuucuucccuggcgcuggccauuaugguugcuggccucagccuguggaugugcuccaaugggucucuucagugccgcaucuguaucuga

SEQ ID NO: 196888 - RNA, 1695 nt, Artificial Sequence
  derived and/or modified sequence opt5 from hemagglutinin__InfluenzaA__ABW90128
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugagaaaaagcacaaugggaaacugugugaucucgacggagugaagccccugauccuuagagauugcagcguugcgggcuggcugcucgggaacccuaugugugacgaguuuaucaaugugccggaaugguccuauauugucgagaaggcuaaccccgugaaugaucugugcuacccuggagacuucaacgauuaugaggaacugaaacaucuccugucucggaucaaucacuuugagaagauucagaucauucccaaaagcuccuggucuagccaugaagccucccuuggcguuagcucugccuguccuuaccaggggaaguccagcuucuuucgcaacguggucuggcugaucgagaaaaauucuacauaucccaccauuaagagauccuacaacaauacaaaccaagaggaccuccuggugcuuuggggaauccaccacccuaaugaugcugccgaacagaccaagcuguaucagaacccgacaaccuacaucagcgugggcacgucuacccucaaccagcggcuggucccccgcauugcuacaagauccaaaguuaauggccaaagcgggcggauggaguucuuuuggaccauccugaagccuaacgacgccauuaauuucgaauccaacggaaauuuuaucgcgcccgaguacgccuauaaaauugugaagaaaggcgauucuacaaucaugaaguccgaacucgaguacgggaacugcaauaccaaaugucagacgccuaugggagcuaucaacuccagcaugcccuuccauaauauucacccgcugacaaucggcgagugcccuaaguaugugaagucuaaccgccuuguccuggccaccgggcucagaaauagcccccagcgggaaacacgcggacuguuuggcgcuauugccggcuucaucgaagggggauggcagggcaugguggacgggugguacggauaucaucacagcaacgaacaaggcucuggguacgcggccgacaaagagagcacccagaaggcuauugauggaguuaccaauaaagugaacuccaucaucgacaagaugaauacacaguuugaagccgucggcagagaguucaacaaccuugagcggcgcauugaaaaucugaacaaaaagauggaggauggcuuccucgacguguggacguauaaugcugaacugcugguucucauggagaacgaaagaacccuggauuuucacgacucuaaugugaagaaccuuuacgauaaaguccggcugcaacuccgcgacaaugccaaggagcuggggaacggauguuucgaguuuuaccauaaaugcgauaaugaauguauggagagcgugagaaacggcacauaugacuacccucaguauuccgaagaggcccggcuuaagagagaggaaaucagcggggucaaacuggagucuauuggaaucuaccagauucucuccaucuauagcaccguggcuucuucccuggcgcuggccauuaugguugcuggccucagccuguggaugugcuccaaugggucucuucagugccgcaucuguaucuga

SEQ ID NO: 196889 - RNA, 1695 nt, Artificial Sequence
  derived and/or modified sequence opt5 from hemagglutinin__InfluenzaA__ABW90129
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugagaaaaagcacaaugggaaacugugugaucucgacggagugaagccccugauccuuagagauugcagcguugcgggcuggcugcucgggaacccuaugugugacgaguuuaucaaugugccggaaugguccuauauugucgagaaggcuaaccccgugaaugaucugugcuacccuggagacuucaacgauuaugaggaacugaaacaucuccugucucggaucaaucacuuugagaagauucagaucauucccaaaagcuccuggucuagccaugaagccucccuuggcguuagcucugccuguccuuaccaggggaaguccagcuucuuucgcaacguggucuggcugaucaaaaagaacucugcuuaucccacaauuaagagauccuacaauaauaccaaccaagaggaccuccuggugcuuuggggaauccaccacccuaaugaugccgcugagcagacagaacuguaucagaacccgaccacauacaucagcgugggcaccucuacgcucaaccagcggcuggucccccgcauugccaccagauccaaaguuaauggccaaagcgggcggauggaguucuuuuggacaauccugaagccuaacgacgcgauuaauuucgaauccaacggaaauuuuaucgcccccgaguacgcuuauaaaauugugaagaaaggcgauucuaccaucaugaaguccgaacucgaguacgggaacugcaauacaaaaugucagaccccuaugggagccaucaacuccagcaugcccuuccauaauauucacccgcugacgaucggcgagugcccuaaguaugugaagucuaaccgccuuguccuggcuacagggcucagaaauagcccccagcgggaaacccgcggacuguuuggcgccauugcgggcuucaucgaagggggauggcagggcaugguggacgggugguacggauaucaucacagcaacgaacaaggcucuggguacgccgcugacaaagagagcacacagaaggccauugauggaguuaccaauaaagugaacuccaucaucgacaagaugaauacccaguuugaagcugucggcagagaguucaacaaccuugagcggcgcauugaaaaucugaacaaaaagauggaggauggcuuccucgacguguggacauauaaugccgaacugcugguucucauggagaacgaaagaacgcuggauuuucacgacucuaaugugaagaaccuuuacgauaaaguccggcugcaacuccgcgacaaugccaaggagcuggggaacggauguuucgaguuuuaccauaaaugcgauaaugaauguauggagagcgugagaaacggcaccuaugacuacccucaguauuccgaagaggcucggcuuaagagagaggaaaucagcggggucaaacuggagucuauuggaaucuaccagauucucuccaucuauagcacaguggcgucuucccuggcccuggcuauuaugguugccggccucagccuguggaugugcuccaaugggucucuucagugccgcaucuguaucuga

SEQ ID NO: 196890 - RNA, 1695 nt, Artificial Sequence
  derived and/or modified sequence opt5 from hemagglutinin__InfluenzaA__ABW90130
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugagaaaaagcacaaugggaaacugugugaucucgacggagugaagccccugauccuuagagauugcagcguugcgggcuggcugcucgggaacccuaugugugacgaauuuaucaaugugccggaaugguccuauauugucgagaaggcuaaccccgugaaugaucugugcuacccuggagacuucaacgauuaugaggaacugaaacaucuccugucucggaucaaucacuuugagaagauucagaucauucccaaaagcuccuggucuagccaugaagccucccuuggcguuagcucugccuguccuuaccaggggaaguucuccuuuuuccgcaacguggucuggcugaucaaaaagaauagcacauaucccaccauuaagagaucuuacaacaauacaaaccaagaggaccuccuggugcuuuggggaauccaccacccuaaugaugcugccgagcagaccaaacuguaucagaacccgacaaccuacaucuccgugggcacgagcacccucaaccagcggcuggucccccgcauugcuacaagaucuaagguuaauggccaauccgggcggauggaauuuuucuggaccauccugaaaccuaacgacgccauuaauuuugagagcaacggaaauuucaucgcgcccgaauacgccuauaagauugugaaaaagggcgauuccacaaucaugaaaucugagcucgaauacgggaacugcaauaccaagugucagacgccuaugggagcuaucaacagcuccaugcccuuucauaauauucacccgcugacaaucggcgagugcccuaaguaugugaaaagcaaccgccuuguccuggccaccgggcucagaaauucuccccagcgggagacacgcggacuguucggcgcuauugccggcuuuaucgaagggggauggcagggcaugguggacgggugguacggauaucaucacuccaacgagcaaggcagcggguacgcggccgacaaggaaucuacccagaaagcuauugauggaguuaccaauaaggugaacagcaucaucgacaaaaugaauacacaguucgaggccgucggcagagaguucaacaaccuugaacggcgcauugagaaucugaacaagaagauggaagauggcuuucucgacguguggacguauaaugcugagcugcugguucucauggaaaacgagagaacccuggauuuccacgacuccaaugugaaaaaccuuuacgauaagguccggcugcaacuccgcgacaaugccaaagaacuggggaacggauguuuugaguucuaccauaagugcgauaaugaguguauggaaucugugagaaacggcacauaugacuacccucaguauagcgaggaagcccggcuuaaaagagaggagaucuccggggucaagcuggaaagcauuggaaucuaccagauucucucuaucuauuccaccguggcuagcucucuggcgcuggccauuaugguugcuggccucucccuguggaugugcagcaaugggucccuucagugccgcaucuguaucuga

SEQ ID NO: 196891 - RNA, 1695 nt, Artificial Sequence
  derived and/or modified sequence opt5 from hemagglutinin__InfluenzaA__ABW90132
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugagaaaaagcacaaugggaaacugugugaucucgacggagugaagccccugauccuuagagauugcagcguugcgggcuggcugcucgggaacccuaugugugacgaguuuaucaaugugccggaaugguccuauauugucgagaaggcuaaccccgugaaugaucugugcuacccuggagacuucaacgauuaugaggaacugaaacaucuccugucucggaucaaucacuuugagaagauucagaucauucccaaaagcuccuggucuagccaugaagccucccuuggcguuagcucugccuguccuuaccaggggaaguccagcuucuuucgcaacguggucuggcugaucaaaaagaacucuacauaucccaccauuaagagauccuacaauaauacaaaccaagaggaccuccuggugcuuuggggaauccaccacccuaauaacgcugccgagcagaccgaacuguaucagaacccgacaaccuacaucagcgugggcacgucuacccucaaucagcggcuggucccccgcauugcuacaagauccaaaguuaacggccaaagcgggcggauggaguucuuuuggaccauccugaagccuaaugaugccauuaacuucgaauccaauggaaacuuuaucgcgcccgaguacgccuauaaaauugugaagaaaggcgacucuacaaucaugaaguccgaacucgaguacgggaauugcaacaccaaaugucagacgccuaugggagcuaucaauuccagcaugcccuuccauaacauucacccgcugacaaucggcgagugcccuaaguaugugaagucuaaucgccuuguccuggccaccgggcucagaaacagcccccagcgggaaacacgcggacuguuuggcgcuauugccggcuucaucgaagggggauggcagggcaugguggaugggugguacggauaucaucacagcaaugaacaaggcucuggguacgcggccgacaaagagagcacccagaaggcuauugacggaguuaccaacaaagucaauuccaucaucgauaagaugaacacacaguuugaagccgugggcagagaguucaacaaucuugagcggcgcauugaaaaccugaauaaaaagauggaggacggcuuccucgauguguggacguauaacgcugaacugcugguucucauggagaaugaaagaacccuggacuuucacgauucuaacgugaagaaucuuuacgacaaaguccggcugcaacuccgcgauaacgccaaggagcuggggaauggauguuucgaguuuuaccauaaaugcgacaacgaauguauggagagcgugagaaauggcacauaugauuacccucaguauuccgaagaggcccggcuuaagagagaggaaaucagcggggucaaacuggagucuauuggaaucuaccagauucucuccaucuauagcaccguggcuucuucccuggcgcuggccauuaugguugcuggccucagccuguggaugugcuccaacgggucucuucagugccgcaucuguaucuga

SEQ ID NO: 196892 - RNA, 1695 nt, Artificial Sequence
  derived and/or modified sequence opt5 from hemagglutinin__InfluenzaA__ABW90133
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugagaaaaagcacaaugggaaacugugugaucucgacggagugaagccccugauccuuagagauugcagcguugcgggcuggcugcucgggaacccuaugugugacgaauuuaucaaugugccggaaugguccuauauugucgagaaggcuaaccccgugaaugaucugugcuacccuggagacuucaacgauuaugaggaacugaaacaucuccugucucggaucaaucacuuugagaagauucagaucauucccaaaagcuccuggucuagccaugaagccucccuuggcguuagcucugccuguccuuaccaggggaagcccuccuucuuucgcaacguggucuggcugaucaaaaagaauagcacauauccuaccauuaagagaucuuacaacaauacaaaccaagaggaccuccuggugcuuuggggaauccaccacccgaaugaugcugccgagcagaccaaacuguaucagaaccccacaaccuacaucuccgugggcacgagcacccucaaccagcggcuggucccucgcauugcuacaagaucuaagguuaauggccaauccgggcggauggaguucuuuuggaccauccugaaacccaacgacgccauuaauuucgaaagcaacggaaauuuuaucgcgccugaauacgccuauaagauugugaaaaagggcgauuccacaaucaugaaaucugagcucgaauacgggaacugcaauaccaagugucagacgcccaugggagcuaucaacagcuccaugccguuccauaauauucacccucugacaaucggcgagugccccaaguaugugaaaagcaaccgccuuguccuggccaccgggcucagaaauucuccucagcgggagacacgcggacuguuuggcgcuauugccggcuucaucgaagggggauggcagggcaugguggacgggugguacggauaucaucacuccaacgagcaaggcagcggguacgcggccgacaaggaaucuacccagaaagcuauugauggaguuaccaauaaggugaacagcaucaucgacaaaaugaauacacaguuugaggccgucggcagagaguucaacaaccuugaacggcgcauugagaaucugaacaagaagauggaagauggcuuccucgacguguggacguauaaugcugagcugcugguucucauggaaaacgagagaacccuggauuuucacgacuccaaugugaaaaaccuuuacgauaagguccggcugcaacuccgcgacaaugccaaagaacuggggaacggauguuucgaguuuuaccauaagugcgauaaugaguguauggaaucugugagaaacggcacauaugacuacccccaguauagcgaggaagcccggcuuaaaagagaggagaucuccggggucaagcuggaaagcauuggaaucuaccagauucucucuaucuauuccaccguggcuagcucucuggcgcuggccauuaugguugcuggccucucccuguggaugugcagcaaugggucccuucagugccgcaucuguaucuga

SEQ ID NO: 196893 - RNA, 1695 nt, Artificial Sequence
  derived and/or modified sequence opt5 from hemagglutinin__InfluenzaA__ABW90134
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugagaaaaagcacaaugggaaacugugugaucucgacggagugaagccccugauccuuagagauugcagcguugcgggcuggcugcucgggaacccuaugugugacgaauuuaucaaugugccggaaugguccuauauugucgagaaggcuaaccccgugaaugaucugugcuacccuggagacuucaacgauuaugaggaacugaaacaucuccugucucggaucaaucacuuugagaagauucagaucauucccaaaagcuccuggucuagccaugaagccucccuuggcguuagcucugccuguccuuaccaggagaaguccagcuucuuucgcaacguggucuggcugaucaaaaagaacucuacauaucccaccauuaagagauccuacaauaauacaaaccaagaggaccuccuggugcuuugggggauccaccacccuaaugaugcugccgaacagaccaaacuguaucagaacccgacaaccuacaucagcgugggaacgucuacccucaaccagcggcuggucccccgcauugcuacaagauccaagguuaauggccaaagcggccggauggaguucuuuuggaccauccugaaaccuaacgacgccauuaauuucgaauccaacgggaauuuuaucgcgcccgaguacgccuauaagauugugaaaaagggagauucuacaaucaugaaaagcgaacucgaguacggcaacugcaauaccaagugucagacgccuaugggggcuaucaacuccagcaugcccuuccauaauauucacccgcugacaaucggagagugcccuaaguaugugaaaucuaaccgccuuguccuggccaccggccucagaaauagcccccagcgggaaacacgcgggcuguuuggagcuauugccggcuucaucgagggcggguggcagggaaugguggacggcugguacggguaucaucacuccaacgaacaaggaucuggcuacgcggccgacaaggagagcacccagaaagcuauugaugggguuaccaauaaggugaacuccaucaucgacaaaaugaauacacaguuugaagccgucggaagagaguucaacaaccuugagcggcgcauugaaaaucugaacaagaagauggaggauggcuuccucgacguguggacguauaaugcugaacugcugguucucauggagaacgaaagaacccuggauuuucacgacucuaaugugaaaaaccuuuacgauaagguccggcugcaacuccgcgacaaugccaaagagcugggcaacggguguuucgaguuuuaccauaagugcgauaaugaauguauggagagcgugagaaacggaacauaugacuacccucaguauuccgaagaggcccggcuuaaaagagaggaaaucagcggcgucaagcuggagucuauugggaucuaccagauucucuccaucuauagcaccguggcuucuucccuggcgcuggccauuaugguugcuggacucagccuguggaugugcuccaauggcucucuucagugccgcaucuguaucuga

SEQ ID NO: 196894 - RNA, 1695 nt, Artificial Sequence
  derived and/or modified sequence opt5 from hemagglutinin__InfluenzaA__ABW90135
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugaaaagaagcacaaugggaaacugugugaucucgacggagugaagccccugauccuuagagauugcagcguugcgggcuggcugcucgggaacccuaugugugacgaguuuaucaaugugccggaaugguccuauauugucgagaaggcuaaccccgugaaugaucugugcuacccuggagacuucaacgauuaugaggaacugaaacaucuccugucucggaucaaucacuuugagaagauucagaucauucccaaaagcuccuggucuagccaugaagccucccuuggcguuagcucugccuguccuuaccaggggaaguccagcuucuuucgcaacguggucuggcugaucaauaaaaacucuacauaucccaccauuaagagauccuacaauaacacaaaucaagaggaccuccuggugcuuuggggaauccaccacccuaacgaugcugccgagcagaccaagcuguaucagaacccgacaaccuacaucagcgugggcacgucuacccucaaucagcggcuggucccccgcauugcuacaagauccaaaguuaacggccaaagcgggcggauggaguucuuuuggaccauccugaagccuaaugacgccauuaacuucgaauccaauggaaacuuuaucgcgcccgaauacgccuauaaaauugugaagaaaggcgauucuacaaucaugaaaagcgagcucgaauacgggaauugcaacaccaaaugucagacgccuaugggagcuaucaauuccagcaugcccuuccauaacauucacccgcugacaaucggcgagugcccuaaguaugugaagucuaaucgccuuguccuggccaccgggcucagaaacagcccccagcgggagacacgcggacuguuuggcgcuauugccggcuucaucgaagggggauggcagggcaugguggacgggugguacggauaucaucacuccaaugagcaaggcucuggguacgcggccgacaaagaaagcacccagaaggcuauugauggaguuaccaacaaagucaauuccaucaucgacaagaugaacacacaguuugaggccgugggcagagaguucaacaaucuugaacggcgcauugagaaccugaauaaaaagauggaagauggcuuccucgacguguggacguauaacgcugagcugcugguucucauggaaaaugagagaacccuggauuuucacgacucuaacgugaagaaucuuuacgauaaaguccggcugcaacuccgcgacaacgccaaggaacuggggaauggauguuucgaguuuuaccauaaaugcgauaacgaguguauggaaagcgugagaaauggcacauaugacuacccucaguauuccgaggaagcccggcuuaagagagaggagaucagcggggucaaacuggaaucuauuggaaucuaccagauucucuccaucuauagcaccguggcuucuucccuggcgcuggccauuaugguugcuggccucagccuguggaugugcuccaacgggucucuucagugccgcaucuguaucuga

SEQ ID NO: 196895 - RNA, 1695 nt, Artificial Sequence
  derived and/or modified sequence opt5 from hemagglutinin__InfluenzaA__HB649491
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugagaaaaagcacaaugggaaacugugugaucucgacggagugaagccccugauccuuagagauugcagcguugcgggcuggcugcucgggaacccuaugugugacgaauuuaucaaugugccggaaugguccuauauugucgagaaggcuaaccccgugaaugaucugugcuacccuggagacuucaacgauuaugaggaacugaaacaucuccugucucggaucaaucacuuugagaagauucagaucauucccaaaagcuccuggucuagccaugaagccucccuuggcguuagcucugccuguccuuaccaggggaaguccagcuucuuucgcaacguggucuggcugaucaaaaagaacucuacauaucccaccauuaagagauccuacaauaauacaaaccaagaggaccuccuggugcuuuggggaauccaccacccuaaugaugcugccgagcagaccaaacuguaucagaacccgacaaccuacaucagcgugggcacgucuacccucaaccagcggcuggucccccgcauugcuacaagauccaagguuaauggccaaagcgggcggauggaguucuuuuggaccauccugaaaccuaacgacgccauuaauuucgaauccaacggaaauuuuaucgcgcccgaauacgccuauaagauugugaaaaagggcgauucuacaaucaugaaaagcgagcucgaauacgggaacugcaauaccaagugucagacgccuaugggagcuaucaacuccagcaugcccuuccauaauauucacccgcugacaaucggcgagugcccuaaguaugugaaaucuaaccgccuuguccuggccaccgggcucagaaauagcccccagcgggagacacgcggacuguuuggcgcuauugccggcuucaucgaagggggauggcagggcaugguggacgggugguacggauaucaucacuccaacgagcaaggcucuggguacgcggccgacaaggaaagcacccagaaagcuauugauggaguuaccaauaaggugaacuccaucaucgacaaaaugaauacacaguuugaggccgucggcagagaguucaacaaccuugaacggcgcauugagaaucugaacaagaagauggaagauggcuuccucgacguguggacguauaaugcugagcugcugguucucauggaaaacgagagaacccuggauuuucacgacucuaaugugaaaaaccuuuacgauaagguccggcugcaacuccgcgacaaugccaaagaacuggggaacggauguuucgaguuuuaccauaagugcgauaaugaguguauggaaagcgugagaaacggcacauaugacuacccucaguauuccgaggaagcccggcuuaaaagagaggagaucagcggggucaagcuggaaucuauuggaaucuaccagauucucuccaucuauagcaccguggcuucuucccuggcgcuggccauuaugguugcuggccucagccuguggaugugcuccaaugggucucuucagugccgcaucuguaucuga

SEQ ID NO: 196896 - RNA, 1683 nt, Artificial Sequence; identical to SEQ ID NO: 193012
  derived and/or modified sequence opt5 from hemagglutinin__InfluenzaA__EPI439507

SEQ ID NO: 196897 - RNA, 1701 nt, Artificial Sequence
  derived and/or modified sequence opt5 from hemagglutinin__InfluenzaA__EPI482777
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaaaauagacacaacgggaaacuuuguaagcugcggggaguugcuccccuccaucugggcaagugcaauaucgccggguggcugcucggaaacccugagugugaaucucugagcaccgccuccucuuggagcuacauuguggagacguccaauucugauaacgggaccugcuauccgggcgacuuuaucaauuacgaagaacuucgcgagcagcugagcuccgucagcucuuucgaaagauuugagauuuuccccaaaacauccagcuggccuaaccacgauaccaaucggggagugacagcugccuguccccaugcuggcgccaacucuuuuuaucgcaaucucguuuggcuggugaagaagggcaacuccuacccuaaaaucaacaagagcuauaucaauaacaaagaaaaggagguccuugugcugugggcgauucaccaccccucuaccuccgccgaccaacagagccucuaccagaaugcugaugccuacguguucgucggguccucuagauauagccggaaauuugagccugaaaucgcuacgcgcccgaagguuagagaccaggccggacggaugaacuacuauuggacacugguggagcccggcgauaagauuaccuucgaagcgacagggaaucugguggccccucgcuacgcuuuugcccucaaaagaaacuccggaagcggcaucauuaucucugacaccuccguccaugauugcgacaccacaugucaaacgcccaauggggcuauuaacaccagccugccuuuccagaauauccaccccgugacaaucggagagugcccgaaguauguuaaaucuaccaagcugcggauggccacaggccuucgcaacauuccuagcauccaguccagaggccucuuuggggccauugcuggauucaucgaaggcggguggaccggaaugauugauggcugguacggguaucaucaccagaaugagcaaggaucuggcuacgcggccgaccugaaaagcacgcagaacgcuaucgacggcaucacaaauaaggugaacuccgucauugagaaaaugaauacccaguuuaccgccguggggaaggaguucagccaccuugagcggcgcaucgaaaaccugaacaagaaaguugaugacggauuccucgauauuuggacauacaaugccgagcugcuggugcuccuggaaaacgagagaacccuugacuaucaugauucuaaugucaagaaccuguacgagaaagugcggucccagcucaagaauaacgcuaaagaaaucggcaauggguguuuugaguucuaucacaagugcgacgauauguguauggaaagcgucaagaacggaacauacgacuaucccaaauacucugaggaagccaagcugaauagagaggagauugauggcgugaaacuugaauccacgcgcaucuaucaaauccuggcgauuuacagcaccguugcuuccucucucgugcuggucgugagccugggggccaucuccuuuuggaugugcucuaacggcagccuccagugccggauuuguaucuga

SEQ ID NO: 196898 - RNA, 1701 nt, Artificial Sequence; identical to SEQ ID NO: 188608
  derived and/or modified sequence opt5 from hemagglutinin__InfluenzaA__EPI745532

SEQ ID NO: 196899 - RNA, 1701 nt, Artificial Sequence
  derived and/or modified sequence opt5 from hemagglutinin__InfluenzaA__EPI278594
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccugaucacgaauccaauaagggagugacagccgcuuguccccaugccggcgcgaaaucuuuuuauaagaaccugaucuggcucguuaaaaagggcaauagcuacccuaaacuguccaagagcuauauuaacgacaaggggaaagaggugcuuguccuguggggaauccaccaccccuccaccucugccgaucaacagagccucuaccagaaugcugacgccuacguguucgugggcacauccagauauagcaagaaauuuaagccugagauugcuauccggccgaaaguccgcgaucaggaagggagaaugaacuacuauuggacccugguugagcccggagacaagauuacguucgaagccacaggcaaucugguggugccucgguacgcguuugccauggagcgcaacgcugggucuggaaucauuaucuccgauacccccguccaugacugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgaaggaggcuggaccgggaugguggacggaugguacggcuaucaucaccagaacgagcaaggcucuggguacgcugcggaucugaaaagcacacagaaugccaucgacaagauuaccaacaaagucaauuccgugaucgagaagaugaacacgcaguuuacagcuguuggaaaggaguucaaucaccuugagaaaagaauugaaaaccugaauaagaaaguggaugacggcuuccucgauaucuggaccuacaacgccgagcugcugguccuccuggaaaaugagcggacccuugacuaucaugauagcaacgugaagaaucuguacgagaaaguccgcucucagcucaagaacaacgccaaggaaauugggaauggauguuuugaguucuaucacaaaugcgacaacacauguauggaauccgugaagaauggcaccuacgauuauccuaaauacagcgaggaagcuaagcugaacagagaggagaucgacgggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 196900 - RNA, 1701 nt, Artificial Sequence
  derived and/or modified sequence opt5 from hemagglutinin__InfluenzaA__AEE69009
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccccguccucugacaacggcacgugcuaucccggggauuuuauugacuacgaagaacugcgggagcagcuuagcuccgucagcucuuucgaacgcuuugagaucuucccuaagaccuccagcuggcccaaucacgauucuaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuccgaccagcgccgaucaacagucccucuaccagaacgcugacacauacguguucgugggcucuagcagauauuccaagaaauuuaagcccgagauugccauccggccuaaaguccgcgaucaggaggggagaaugaauuacuauuggacccugguugaacccggagacaagauuacguucgaggcuacaggcaaccugguggugccucgguacgccuuugcgauggaacgcaacgccgggagcggaaucauuaucucugauacccccguccaugacugcaauacaaccugucaaaccccgaaaggcgcuaucaacacaucccucccuuuccagaauauucaccccaucacgauuggcaagugcccuaaguaugugaaaagcaccaagcugagacuugccacagggcugcggaacauccccucuauucagagccgcggacucuuuggcgcuaucgccggguucaucgagggaggcuggaccgggaugguugacggaugguacggcuaucaucaccagaaugaacaaggcuccggguacgccgcugaucugaaaucuacacagaacgcgauugacgagaucaccaauaaggugaacagcgucauugagaaaaugaauacgcaguuuacagccgugggaaaggaguucaaccaccuugagaagagaaucgaaaaucugaacaaaaagguugaugacggcuuccucgauauuuggaccuacaaugcugagcugcuggugcuccuggaaaacgagcggacccuugacuaucaugauuccaaugucaaaaaccuguacgagaaggugcgcagccagcucaaaaacaaugccaaggaaaucgggaacggauguuuugaguucuaucacaagugcgacaauacauguauggaaucugucaaaaacggcaccuacgauuaucccaaguacuccgaggaagccaaacugaauagagaggagaucgacggggugaaacuugaaagcacacggauuuaucaaauccuggcuauuuacucuacgguugccuccagccucgugcuggucgugucccugggcgcgaucucuuuuuggaugugcagcaacggaucccuccagugccgcauuuguaucuga

SEQ ID NO: 196901 - RNA, 1701 nt, Artificial Sequence; identical to SEQ ID NO: 185975
  derived and/or modified sequence opt5 from hemagglutinin__InfluenzaA__GQ280797

SEQ ID NO: 196902 - RNA, 1701 nt, Artificial Sequence; identical to SEQ ID NO: 185708
  derived and/or modified sequence opt5 from hemagglutinin__InfluenzaA__EPI178457

SEQ ID NO: 196903 - RNA, 1701 nt, Artificial Sequence; identical to SEQ ID NO: 185708
  derived and/or modified sequence opt5 from hemagglutinin__InfluenzaA__EPI176470

SEQ ID NO: 196904 - RNA, 1701 nt, Artificial Sequence
  derived and/or modified sequence opt5 from hemagglutinin__InfluenzaA__EPI280341
augaaggccauccuggugguccuccugcacaccuucgcuacagccaacgcggacacgcuuugcauuggcuaccaugcuaauaacagcaccgauacaguugacaccgugcuggagaaaaaugugacagucacccacuccgugaaccuccuggaagauaagcauaaugggaaacuuuguaagcugagaggaguugcuccccuccaccugggcaaaugcaacaucgccggguggauucugggaaauccugagugugaaucucucagcacagccuccucuuggagcuauaucguggagaccuccucuagcgacaacggcacgugcuacccggggaauuuuauugauuaugaagaacugcgggagcagcuuuccagcgucucuuccuucgaacgcuuugagaucuuccccaagaccagcucuuggccugaccaugauuccaacaagggagugacagccgcuuguccccacgccggcgcgaaauccuuuuacaagaaucugaucuggcucguuaaaaagggcaacucuuauccuacccuguccaaaagcuacauuaaugacaaggggaaggaagugcuuguccuguggggaauccaccaucccuccacaucugccgaucaacagagccucuaucagaacgcugacgccuacguguucgugggcaccuccagauacagcaaaaaguuuaaaccugagauugcuauccggccgaagguccgcaaucaggaggggagaaugaacuauuacuggacgcugguugaacccggagauaaaauuacauucgaggccaccggcaaccugguggcgccucgguaugccuuugcuauggaacgcaaugccgggucuggaaucauuaucuccgacacacccgugcacgauugcaacaccaccugucaaacaccuaagggcgcuaucaauacgagccuccccuuccagaacauucauccgaucaccauuggcaaaugcccuaaguacgucaagucuacaaaacugagacuugccaccgggcugcggaaugugcccagcauccagucccgcggacucuuuggcgccauugcuggguucaucgagggaggcuggacagggaugguugacggaugguauggcuaccaccaccagaacgaacaaggcucuggguaugcggccgaccuuaagagcacccagaaugcuaucgauaaaauuacgaacaaggugaauagcgucaucgagaaaaugaacacacaguuuaccgccgugggaaaggaguucaaucaucuugaaaagagaauugagaaccugaauaaaaagguugacgauggcuuccucgacaucuggaccuacaacgccgaacugcuggugcuccuggagaaugaacggacacuugauuaccacgacagcaacgucaaaaaccuguaugagaaggugcgcucucagcucaaaaauaacgcuaaggagauugggaauggauguuuugaguucuaccauaagugcgauaacaccuguauggaguccgucaaaaauggcacauaugacuacccuaaguauagcgaagaggccaaacugaacagagaagagaucgauggggugaagcuggagucuacgcggaucuaccaaauucuggcgaucuauuccaccguugcuagcucccucgugcuggucgugucucugggcgccauuagcuuuuggaugugcuccaauggaucucuccagugccgcaucuguauuuga

SEQ ID NO: 196905 - RNA, 1701 nt, Artificial Sequence
  derived and/or modified sequence opt5 from hemagglutinin__InfluenzaA__EPI240319
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggauccagcagauauucuaagaaauuuaagccugagaucgcuauucggccgaaaguccgcgauagagaggggcggaugaauuacuauuggacacucguugaacccggagacaagaucaccuucgaggccacgggcaaccugguggugccucgcuacgcguuugccauggaaagaaacgcuggguccggaauuaucaucagcgauacacccguccaugacugcaauaccacaugucagaccccuaaaggcgccauuaacaccucucugcccuuccaaaauauccacccgauuacaaucggcaagugcccuaaguaugugaaaagcacgaagcuccggcuggcuaccgggcuucgcaacguucccuccauucagucuagaggacuguuuggcgccaucgccggguucaucgagggaggcuggacagggaugguggacggaugguacggcuaucaucaccagaaugaacagggcagcggguacgcugcggaucucaaauccacccaaaacgccauugacgagaucacaaauaaggucaacagcgugauugagaaaaugaauacccaguuuacggcuguuggaaaggaguucaaccaccuggagaagcggaucgaaaaucuuaacaaaaagguggaugacggcuuccuggauauuuggacauacaaugccgagcuccugguccugcucgaaaacgagcgcacccuggacuaucaugauucuaaugugaaaaaccuuuacgagaaggucagaucccagcugaaaaacaaugccaaggaaaucgggaacggauguuuugaguucuaucacaagugcgacaauaccuguauggaaagcgugaaaaacggcacauacgauuauccuaaguacucugaggaagcuaaacucaaucgggaggagaucgacgggguuaagcuggaauccacccgcauuuaucagauccuugccauuuacagcacaguggcguccucucugguccucgugguuagccugggcgcuaucuccuuuuggaugugcucuaacggaagccugcaaugcagaauuuguaucuga

SEQ ID NO: 196906 - RNA, 1701 nt, Artificial Sequence; identical to SEQ ID NO: 185873
  derived and/or modified sequence opt5 from hemagglutinin__InfluenzaA__EPI183134

SEQ ID NO: 196907 - RNA, 1701 nt, Artificial Sequence
  derived and/or modified sequence opt5 from hemagglutinin__InfluenzaA__EPI368693
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccagcuguccccaugcuggcgccaaaucuuuuuauaagaaucuuauuuggcugguuaaaaagggcaacuccuacccuaaacucagcaaguccuauaucaaugacaaggggaaagaagugcugguccuuuggggcauucaccaccccucuaccagcgcggaucaacagucccuguaccagaacgccgacgcuuacguguucgugggaagcucuagauauuccaagaaauuuaagccugagaucgccauucggccgaaaguccgcgggcaggagggaagaaugaauuacuauuggacacucguugaacccggcgauaagaucaccuucgaggcuacggggaaccugguggugccucgguacgccuuugcgauggaacgcaacgccggaagcggcauuaucaucucugacacacccguccaugauugcaauaccacaugucaaaccccuaaaggcgcuauuaacaccagccugcccuuccagaauauccacccgauuacaaucgggaagugcccuaaguaugugaaauccacgaagcucagacuggccaccggacuucggaacguucccucuauucagagccgcggccuguuuggggcuaucgccggauucaucgagggcggguggacaggaaugguggacggcugguacggcuaucaucaccagaaugaacaaggguccggauacgccgcugaccucaaaagcacccagaacgcgauugaugagaucacaaauaaggucaacucugugauugagaaaaugaauacccaguuuacggccguuggcaaggaguucaaccaccuggagaagagaaucgaaaaucuuaacaaaaagguggacgauggguuccuggacauuuggacauacaaugcugagcuccugguccugcucgaaaacgagcggacccuggauuaucaugacuccaaugugaaaaaccuuuacgagaagguccgcagccagcugaaaaacaaugccaaggaaaucggaaacggcuguuuugaguucuaucacaagugcgauaauaccuguauggaaucugugaaaaacgggacauacgacuauccuaaguacuccgaggaagccaaacucaauagagaggagaucgauggcguuaagcuggaaagcacccggauuuaucaaauccuugcuauuuacuccacaguggccucuagccugguccucgugguuucccugggagcgaucucuuuuuggaugugcagcaacggcucccugcagugccgcauuuguaucuga

SEQ ID NO: 196908 - RNA, 1701 nt, Artificial Sequence
  derived and/or modified sequence opt5 from hemagglutinin__InfluenzaA__EPI291788
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaaaauagacacaacgggaaacuuuguaagcugcggggaguugcuccccuccaucugggcaagugcaauaucgccggguggcugcucggaaacccugagugugaaucucugagcaccgccuccucuuggagcuacauuguggagacguccaauucugauaacgggaccugcuauccgggcgacuuuaucaauuacgaagaacuucgcgagcagcugagcuccgucagcucuuucgaaagauuugagauuuuccccaaaacauccagcuggccuaaccacgauaccaaucggggagugacagcugccuguccccaugcuggcaccaacucuuuuuaucgcaaucucaucuggcugguuaagaagggcaacuccuacccuaaaaucaacaagagcuauauuaauaacaaagaaaaggaggugcuuguccugugggccauccaccaccccucuacguccgcggaccaacagagccucuaccagaaugccgaugcuuacguguucgugggguccucuagauauagccggaaauuugagccugaaauugccacacgcccgaaggucagagaccaggcuggacggaugaacuacuauuggacccugguugagcccggcgauaagaucacauucgaagccaccgggaaucugguggugccucgcuacgcguuugcccucaaaagaaacuccggaagcggcauuaucauuucugacaccuccguccaugauugcgacacaacgugucaaacccccaauggggcuaucaacacaagccugccuuuccagaauauccaccccgugaccauuggagagugcccgaaguauguuaaaucuacaaagcugcggauggccaccggccuucgcaacaucccuagcauucaguccagaggccucuuuggggcuaucgccggauucauugaaggcggguggacgggaaugaucgauggcugguacggguaucaucaccagaaugagcaaggaucuggcuacgccgcugaccugaaaagcacacagaacgcgaucgacggcauuaccaauaaggugaacuccgucaucgagaaaaugaauacccaguuuacagccguggggaaggaguucagccaccuugagcggcgcauugaaaaccugaacaagaaaguugaugacggauuccucgauaucuggaccuacaaugcugagcugcuggugcuccuggaaaacgagagaacacuugacuaucaugauucuaaugucaagaaccuguacgagaaagugcggucccagcucaagaauaacgccaaagaaauuggcaauggguguuuugaguucuaucacaagugcgacgauacguguauggaaagcgucaagaacggaaccuacgacuaucccaaauacucugaggaagccaagcugaauagagaggagaucgauggcgugaaacuugaauccacacgcaucuaucaaauucuggcuaucuacagcaccguugccuccucucucgugcuggucgugagccugggggcgauuuccuuuuggaugugcucuaacggcagccuccagugccggaucuguauuuga

SEQ ID NO: 196909 - RNA, 1701 nt, Artificial Sequence
  derived and/or modified sequence opt5 from hemagglutinin__InfluenzaA__EPI482788
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaaaauagacacaacgggaaacuuuguaagcugcggggaguugcuccccuccaucugggcaagugcaauaucgccggguggcugcucggaaacccugagugugaaucucugagcaccgccuccucuuggagcuacauuguggagacguccaauucugauaacgggaccugcuauccgggcgacuuuaucaauuacgaagaacuucgcgagcagcugagcuccgucagcucuuucgaaagauuugagauuuuccccaaaacauccagcuggccuaaccacgauaccaaucggggagugacagcugccuguccccaugcuggcaccaacucuuuuuaucgcaaucucaucuggcugguuaagaagggcaacuccuacccuaaaaucaacaagagcuauauuaauaacaaagaaaaggaggugcuuguccugugggccauccaccaccccucuacguccgcggaccaacagagcauuuaccagaaugccgaugcuuacguguucgugggguccucuagauauagccggaaauuugagccugaaaucgccacacgcccgaaggucagagaccaggcuggacggaugaacuacuauuggacccucguugagcccggcgauaagauuacauucgaagccaccgggaaucugguggugccucgcuacgcguuugcccugaaaagaaacuccggaagcggcaucauuaucucugacaccuccguccaugauugcgacacaacgugucaaacccccaauggggcuaucaacacaagccucccuuuccagaauauucaccccgugaccaucggagagugcccgaaguauguuaaaucuacaaagcugcggauggccaccggccuucgcaacauuccuagcauccaguccagaggccuguuuggggcuauugccggauucaucgaaggcggguggacgggaaugaucgauggcugguacggguaucaucaccagaaugagcaaggaucuggcuacgccgcugaccucaaaagcacacagaacgcgauugacggcaucaccaauaaggugaacuccgucauugagaaaaugaauacccaguuuacagccguggggaaggaguucagccaccuggagcggcgcaucgaaaaccuuaacaagaaaguugaugacggauuccuggauauuuggaccuacaaugcugagcuccuggugcugcucgaaaacgagagaacacuggacuaucaugauucuaaugucaagaaccuuuacgagaaagugcggucccagcugaagaauaacgccaaagaaaucggcaauggguguuuugaguucuaucacaagugcgacgauacguguauggaaagcgucaagaacggaaccuacgacuaucccaaauacucugaggaagccaagcucaauagagaggagaucgauggcgugaaacuggaauccacacgcauuuaucaaauccuugcuauuuacagcaccguugccuccucucuggugcucgucgugagccugggggcgaucuccuuuuggaugugcucuaacggcagccugcagugccggauuuguaucuga

SEQ ID NO: 196910 - RNA, 1701 nt, Artificial Sequence
  derived and/or modified sequence opt5 from hemagglutinin__InfluenzaA__EPI178946/m1
augaaggccaucauugugguccugcucuacaccuucgcuacagccgacgcggauacgcugugcaucggcuaucacgcuaacaauagcaccgacacaguugauaccgugcuugagaaaaacgugacagucacccauuccgugaaucugcucgaaaacaagcacgacgggaaacuguguaaacuuagaggaguugcuccccugcaucucggcaaaugcaauauugccggguggcugcugggaaacccugagugugaaucucucuuuacagccagcuccuggucuuacaucguggagaccccgaauagcgauaacggcacgugcuaucccggggacuucauuaauuacgaggaacugcgggagcaccuuuccucugucagcuccuuugaacgcuucgagaucuuuccuaaggccaacagcuggcccaaucaugauaccaacaagggagugacagcugccuguccuuaugcgggcgccaauucuuucuacagaaaccugaucuggcucguuaaaaagggcaauuccuaucccaaacugagcaagucuuacauuaacaacaaaaagaaggaagugcuugucaucugggggauucaccacccuccgaccuccacagaccagcaaacccuguaccagaaugcugaugccuauguguuugugggaagcucuaaauacuccaagcgguucaaacccgagaucgcugcccgcccuaaggucagaaaccaggcgggccggaugaauuauuacuggacgcucauugagcccggggacacaaucaccuuugaagccacaggaaaccugguugugccucgcuaugcuuucgccaugaaaagaggcagcggguccggaauuaucgugucugaugcucccguccaugacugcaauaccaccugucagacaccgaagggcgccaucaacacgagccugccuuuucaaaauauucaccccgugaccaucggcgagugcccuaaauacguuaaguccacaaagcuccggauggccaccgggcugcgcaacauucccagcauccagucuagaggacuuuucggcgcuauugcgggguuucuggaaggaggcuggacagggaugaucgauggaugguauggcuaccaucaccagaaugagcagggcuccggguacgccgcugaccaaaagagcacccagaacgccaucgacggaauuacgaauaaggugaacucuaucauugaaaagaugaauacacaguucaccgccgucggcaaggaguucaaccagcucgagaaacggaucgaaagccugaauaacaagguggaugacggguuucuugauauuuggaccuauaacgcugagaugcugguucuccuggaaaaugagcgcacacuggacuaccacgauuccaacgugaagaaucucuaugaaaaagucagaucucaacugaagaacaaugccaaagagaucggaaacggcuguuucgaguuuuaccauaagugcgacaauaccuguauggaaagcgugaaaaacgggacauaugauuaccccaaguauuccgaggaagcgaaacuuaaucgggaggaaaucgacggcgucaaacuggagagcgcucgcauuuaccagauccucgccauuuacucuacgguggccuccagccugguucuucuggugucucucggagcugucuccuucuggaugugcagcaacggcucccugcagugcagaaucuguauuuga

SEQ ID NO: 196911 - RNA, 1701 nt, Artificial Sequence
  derived and/or modified sequence opt5 from hemagglutinin__InfluenzaA__EPI482791/m2
augaaggccaucauugugguccugcucuacaccuucgcuacagccgacgcggauacgcugugcaucggcuaucacgcuaacaauagcaccgacacaguugauaccgugcuugagaaaaacgugacagucacccauuccgugaaucugcucgaaaacaagcacgacgggaaacuguguaaacuuagaggaguugcuccccugcaucucggcaaaugcaauauugccggguggcugcugggaaacccugagugugaaucucucuuuacagccagcuccuggucuuacaucguggagaccccgaauagcgauaacggcacgugcuaucccggggacuucauuaauuacgaggaacugcgggagcaccuuuccucugucagcuccuuugaacgcuucgagaucuuuccuaaggccaacagcuggcccaaucaugaaaccaacaagggagugacagcugccuguccuuaugcgggcgccaauucuuucuacagaaaccugaucuggcucguuaaaaagggcaauuccuaucccaaacugagcaagucuuacauuaacaacaaaaagaaggaggugcuugucaucugggggauucaccacccuccgaccuccacagaucagcaaacccuguaccagaaugcugacgccuauguguuugugggaagcucuaaauacuccaagcgguucaaacccgagaucgcugcccgcccuaaggucagaaaccaggcgggccggaugaauuauuacuggacgcucauugaacccggggauacaaucaccuuugaggccacaggaaaccugguugugccucgcuaugcuuucgccaugaaaagaggcagcggguccggaauuaucgugucugacgcucccguccaugauugcaauaccaccugucagacaccgaagggcgccaucaacacgagccugccuuuucaaaauauucaccccgugaccaucggcgaaugcccuaaauacguuaaguccacaaagcuccggauggccaccgggcugcgcaacauucccagcauccagucuagaggacuuuucggcgcuauugcgggguuucuggagggaggcuggacagggaugaucgacggaugguauggcuaccaucaccagaaugaacagggcuccggguacgccgcugaucaaaagagcacccagaacgccaucgacggaauuacgaauaaggugaacucuaucauugagaaaaugaauacacaguucaccgccgucggcaaggaguucaaccagcucgaaaaacggaucgagagccugaauaacaagguggacgauggguuucuugacauuuggaccuauaacgcugaaaugcugguucuccuggagaaugaacgcacacuggauuaccacgacuccaacgugaagaaucucuaugagaaagucagaucucaacugaagaacaaugccaaagagaucggaaacggcuguuucgaauuuuaccauaagugcgauaauaccuguauggagagcgugaaaaacgggacauaugacuaccccaaguauuccgaagaggcgaaacuuaaucgggaagagaucgauggcgucaagcuggagagcgcucgcauuuaccagauccucgccauuuacucuacgguggccuccagccugguucuucuggugucucucggagcugucuccuucuggaugugcagcaacggcucccugcagugcagaaucuguauuuga

SEQ ID NO: 196912 - RNA, 1701 nt, Artificial Sequence
  derived and/or modified sequence opt5 from hemagglutinin__InfluenzaA__EPI291799
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaaaauagacacaacgggaaacuuuguaagcugcggggaguugcuccccuccaucugggcaagugcaauaucgccggguggcugcucggaaacccugagugugaaucucugagcaccgccuccucuuggagcuacauuguggagacguccaauucugauaacgggaccugcuauccgggcgacuuuaucaauuacgaagaacuucgcgagcagcugagcuccgucagcucuuucgaaagauuugagauuuuccccaaaacauccagcuggccuaaccacgauaccaaucggggagugacagcugccuguccccaugcuggcaccaacucuuuuuaucgcaaucucaucuggcugguuaagaagggcaacuccuacccuaaaaucaacaagagcuauauuaauaacaaagaaaaggaggugcuuguccugugggccauccaccaccccucuacguccgcggaccaacagagccucuaccagaaugccgaugcuuacguguucgugggguccucuagauauagccggaaauuugagccugaaauugccacacgcccgaaggucagagaccaggcuggacggaugaacuacuauuggacccugguugagcccggcgauaagaucacauucgaagccaccgggaaucugguggugccucgcuacgcguuugcccucaaaagaaccuccggaagcggcauuaucauuucugacacauccguccaugauugcgacacgaccugucaaacacccaacggggcuaucaauaccagccugccuuuccagaacauccaccccgugacaauuggagagugcccgaaguauguuaaaucuaccaagcugcggauggccacgggccuucgcaauaucccuagcauucaguccagaggccucuuuggggcuaucgccggauucauugaaggcggguggacaggaaugaucgauggcugguacggguaucaucaccagaacgagcaaggaucuggcuacgccgcugaccugaaaagcacccagaaugcgaucgacggcauuaccaacaaggucaauuccgugaucgagaaaaugaacacacaguuuaccgccguggggaaggaguucagccaccuugagcggcgcauugaaaaucugaacaagaaaguugaugacggauuccucgauaucuggacauacaacgcugagcugcuggugcuccuggaaaaugagagaacgcuugacuaucaugauucuaacgucaagaaucuguacgagaaagugcggucccagcucaagaacaaugccaaagaaauuggcaacggguguuuugaguucuaucacaagugcgacgauaccuguauggaaagcgucaagaauggaacauacgacuaucccaaauacucugaggaagccaagcugaacagagaggagaucgauggcgugaaacuugaauccacccgcaucuaucaaauucuggcuaucuacagcacaguugccuccucucucgugcuggucgugagccugggggcgauuuccuuuuggaugugcucuaauggcagccuccagugccggaucuguauuuga

SEQ ID NO: 196913 - RNA, 1701 nt, Artificial Sequence
  derived and/or modified sequence opt5 from hemagglutinin__InfluenzaA__EPI482799
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaaaauagacacaacgggaagcuguguaaacuucggggaguugcuccccuccaucugggcaagugcaauaucgccggguggcugcucggaaacccugagugugaaucucugagcaccgccuccucuuggagcuacauuguggagacguccaauucugauaacgggaccugcuauccgggcgacuuuaucaauuacgaagaacuucgcgagcagcugagcuccgucagcucuuucgaaagauuugagauuuuccccaaaacauccagcuggccuaaccacgaaaccaaucggggagugacagcugccuguccccaugcuggcaccaacucuuuuuaucgcaaucucaucuggcugguuaagaagggcaacuccuacccuaaaaucaacaagagcuauauuaauaacaaagagaaggaggugcuuguccugugggccauccaccaccccucuacguccgcggaucaacagagccucuaccagaaugccgacgcuuacguguucgugggguccucuagauauagccggaaauuugaaccugagauugccacacgcccgaaggucagagaucaggcuggacggaugaacuacuauuggacccugguugaacccggcgacaagaucacauucgaggccaccgggaaucugguggugccucgcuacgcguuugcccucaaaagaaccuccggaagcggcauuaucauuucugauacauccguccaugacugcgauacgaccugucaaacacccaacggggcuaucaauaccagccugccuuuccagaacauccaccccgugacaauuggagaaugcccgaaguauguuaaaucuaccaaacuucggauggccacgggccugcgcaauaucccuagcauucaguccagaggccucuuuggggcuaucgccggauucauugagggcggguggacaggaaugaucgacggcugguacggguaucaucaccagaacgagcaaggaucuggcuacgccgcugaucugaaaagcacccagaaugcgaucgacggcauuaccaacaaggucaauuccgugaucgaaaagaugaacacacaguuuaccgccguggggaaggaguucagccaccuugaacggcgcauugagaaucugaacaagaaaguugacgauggauuccucgacaucuggacauacaacgcugaacugcuggugcuccuggagaaugagagaacgcuugauuaucaugacucuaacgucaagaaucuguacgaaaaagugcggucccagcucaagaacaaugccaaagagauuggcaacggguguuuugaguucuaucacaagugcgaugacaccuguauggagagcgucaagaauggaacauacgauuaucccaaauacucugaagaggccaagcugaacagagaggaaaucgacggcgugaaacuugaguccacccgcaucuaucaaauucuggcuaucuacagcacaguugccuccucucucgugcuggucgugagccugggggcgauuuccuuuuggaugugcucuaauggcagccuccagugccggaucuguauuuga

SEQ ID NO: 196914 - RNA, 1701 nt, Artificial Sequence
  derived and/or modified sequence opt5 from hemagglutinin__InfluenzaA__EPI291807
augaaggccaucauugugguccugcucuacaccuucgcuacagccgacgcggauacgcugugcaucggcuaucacgcuaacaauagcaccgacacaguugauaccgugcuugagaaaaacgugacagucacccauuccgugaaucugcucgaaaacaagcacgacgggaaacuguguaaacuuagaggaguugcuccccugcaucucggcaaaugcaauauugccggguggcugcugggaaacccugagugugaaucucucuuugccgccagcuccuggucuuacaucguggagacaccgaauagcgauaacgggaccugcuaucccggcgacuucauuaauuacgaggaacugcgggagcaccuuuccucugucagcuccuuugaacgcuucgagaucuuuccuaaggcuaacagcuggcccaaucaugauacgaacaagggagugaccgccgcguguccuuaugccggcgcuaauucuuucuacagaaaccugaucuggcucguuaaaaagggcaauuccuaucccaaacugagcaagucuuacauuaacaacaaaaagaaggaagugcuugucaucugggggauucaccacccuccgacauccaccgaccagcaaacacuguaccagaaugccgaugcuuauguguuugugggaagcucuaaauacuccaagcgguucaaacccgagaucgccgcgcgcccuaaggucagagaccaggccggccggauggauuauuacuggacccucauugagcccggggacacgaucacauuugaagcuaccggaaaccugguugugccucgcuaugccuucgcuaugaaaagaggcagcggguccggaauuaucgugucugaugcccccguccaugacugcaauacaaccugucagaccccgaagggcgccaucaacacaagccugccuuuucaaaauauucaccccgugacgaucggcgagugcccuaaauacguuaaguccaccaagcuccggauggcuacagggcugcgcaacauucccagcauccagucuagaggacuuuucggcgcgauugccggguuuaucgaaggaggcuggaccgggaugaucgacggaugguauggcuaccaucaccagaaugagcagggcuccggguacgcugccgaucaaaagagcacacagaacgccauugacggaaucaccaauaaggugaacucuauuaucgaaaagaugaauacgcaguucacagcugucggcaaggaguucagccagcuggagaaacggauugaaucccucaacaauaagguggaugacggguuucuggauaucuggaccuauaacgccgagcuucugguucuccuggaaaaugagcgcacccuggacuaccacgauucuaacgugaagaaccucuaugaaaaagucagaagccaacugaagaauaacgcgaaagagaucggaaauggcuguuucgaguuuuaccauaagugcgacaacacauguauggaauccgugaaaaaugggaccuaugauuaccccaaguauagcgaggaagcuaaacuuaaccgggaggaaauugacggcgucaaacuggagucugcccgcaucuaccagauucucgccaucuacuccacaguggcuagcucucugguucuucuggugucccucggagccgucagcuucuggaugugcuccaauggcucucugcagugcagaauuuguaucuga

SEQ ID NO: 196915 - RNA, 1701 nt, Artificial Sequence
  derived and/or modified sequence opt5 from hemagglutinin__InfluenzaA__EPI638970
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaaaauagacacaacgggaaacuuuguaaacugcggggaguugcuccccuccaucugggcaagugcaauaucgccggguggauucugggaaacccugagugugaaucucucagcaccgccuccucuuggagcuacaucguggagacguccaauucugaaaacgggaccugcuauccgggcgauuuuauuaauuacgaggagcugcgcgaacagcuuagcuccgucagcucuuucgagagauuugaaaucuuccccaaaacauccagcuggccuaaccacgacaccaauaagggagugacagcugccuguccccauucuggcaccaacuccuuuuaucggaaucugguuuggcucgugcaaaagggcaacagcuacccuaaaaucaacaagucuuauauuaauaacaaagagaaugagguccuggugcuuugggcuauccaccaccccuccacgagcgccgaucagcagucccuguacaagaacgcggacgccuacguguucgucgggucuagccgcuauuccagaaaauuugaaccugagauugcuacacggccgaagguucgcgaucaggccggaagaaugaauuacuauuggacccucguggaacccggcgacaagaucacauucgaggcuaccgggaaccugguggccccucgguacgcguuuacccugaaacgcaauagcggaucuggcauuaucauuuccgauacaagcguccaugacugcgauacgaccugucaaacacccaacggggccaucaauaccucucucccuuuccagaacauccaccccgugacaauuggagaaugcccgaaguauguuaaaagcaccaagcugagaauggcuacgggccuucggaauaucccuuccauucagucucgcggccuguuuggggccaucgcuggauucauugagggcggguggacaggaaugaucgacggcugguacggguaucaucaccagaacgagcaaggaagcggcuacgccgccgaucucaaauccacccagaaugcuaucgacggcauuaccaacaaggugaauagcgucaucgaaaagaugaacacacaguuuaccgcgguggggaaggaguucucucaccuggaaagacggauugagaaccuuaauaagaaaguugacgauggauuccuggacaucuggacauacaacgccgaacuccuggugcugcucgagaaugagcgcacgcuggauuaucaugacuccaacgucaagaaucuuuacgaaaaagugagaagccagcugaagaacaaugcuaaagagauuggcaacggguguuuugaguucuaucacaagugcgaugacauguguauggaaucugucaagaauggaaccuacgauuaucccaaauacuccgaagaggccaagcucaaccgggaggaaaucgacggcgugaaacuggagagcacaaagaucuaucaaauucuugccaucuacuccaccguugcuucuagccuggugcucgucgugucccugggggccauuucuuuuuggaugugcagcaauggcucccugcagugcagaaucuguauuuga

SEQ ID NO: 196916 - RNA, 1701 nt, Artificial Sequence
  derived and/or modified sequence opt5 from hemagglutinin__InfluenzaA__ABI19015
augaaggccaucauugugguccugcucuacaccuucgcuacagccgacgcggauacgcugugcaucggcuaucacgcuaacaauagcaccgacacaguugauaccgugcuugagaaaaacgugacagucacccauuccgugaaucugcucgaaaacaagcacgacgggaaacuguguaaacuuagaggaauugcuccccugcaucucggcaaaugcaauaucgccggguggauucugggaaacccugagugugaaucucuguuuacaaccagcuccuggucuuacaucguugagacgccgaauagcgauaacgggaccugcuaucccggcgacuucaucaauuacgaagaacuccgggagcaccuguccucugugagcuccuuugaacgcuucgagauuuuuccuaaggccaacagcuggcccuaucaugauacaaauaagggagucaccgccgcuuguccuuacgccggcgcgaacucuuucuauagaaaucuuaucuggcuggugaaaaagggcaacuccuaccccaaacucagcaagucuuacauuaauaacaaaaagaaggaaguucuggugaucugggggauucaccacccuccgacauccaccgaccagcaaacgcuuuaucagaacgccgaugcuuacgucuuugugggaagcucuaaauauuccaagcgguucaaacccgagaucgccgcucgcccuaaggugagagaccaggccggccggauggauuacuauuggacacugauugagcccggggacaccaucacauuugaagcgaccggaaaucucgucguuccucgcuacgccuucaccaugaaaagaggcagcggguccggaaucauugugucugaugcucccgugcaugacugcaacacaacgugucagaccccgaagggcgccaucaauacaagccugccuuuucaaaacauucaccccgucaccaucggcgagugcccuaaauaugugaaguccacaaagcugcggauggcuaccgggcuccgcaauauucccagcauccagucuagaggacuguucggcgccaucgccggguuuauugaaggaggcuggacggggaugaucgacggaugguacggcuaccaucaccagaacgagcagggcuccggguaugcugcggaucaaaagagcacacagaaugccauugacggaaucaccaacaagguuaauucuauuaucgagaaaaugaacacccaguucacagcugugggcaaggaguucagccagcuugagaaacggaucgaaucccugaauaacaaggucgaugacggguuucucgauauuuggaccuacaaugccgagcugcuugugcugcucgaaaacgagcgcacacuggacuaucacgauucuaauguuaagaaccuguacgaaaaagugagaagccaacucaagaacaaugccaaagagaucggaaacggcuguuucgaguuuuaucauaagugcgacgauacguguauggaauccgucaaaaaugggaccuacgacuaucccaaguacagcgaggaagcuaagcugaaccggcaggagauugauggcgugaaacuugaaucugcccgcaucuaccagauucuggcgaucuauuccacagucgcuagcucucucgugcugcuuguuucccugggagccgugagcuucuggaugugcuccaauggcucucuccaaugcagaauuuguaucuga

SEQ ID NO: 196917 - RNA, 1701 nt, Artificial Sequence
  derived and/or modified sequence opt5 from hemagglutinin__InfluenzaA__EPI687790
augaaggccauccuggugguccuccuguacaccuucacaacggcuaacgccgacacccuuugcauuggcuaucacgcgaauaacagcacagauaccguugacacagugcuggagaagaaugugaccgucacacauuccgugaaccuccuggaagauaagcacaaugggaaacuuuguaagcugggaggcguugcuccccuccaucuggggaaaugcaacaucgccggauggauucugggcaauccugagugugaaucucucagcaccgccuccucuuggagcuacaucguggagacguccaacucugacaaugggaccugcuauccgggagauuuuauuaacuacgaagaacugagagagcagcuuagcuccgucagcucuuucgaacgguuugagaucuuccccaagacauccagcuggccuaaucacgacucuaacaagggcgugaccgcugccuguccccaugcuggcgccaaauccuuuuauaagaaucugaucuggcucguuaaaaaggggaacagcuacccuaaacugaaucaaucuuauauuaacgauaagggaaaggaagugcuuguccuguggggcauccaccaccccuccacaaccgcggaccagcagagccucuaccagaacgccgaugcuuacguguucguggggacgucccgcuauucuaaaaaguuuaaaccugagauugccacaagaccgaagguccgggaccaagagggacgcaugaauuacuauuggacccugguugaacccggcgauaaaaucacauucgaggcuaccgggaaccugguggugccuagauacgccuuuaccauggaacggaaugcgggaagcggcauuaucauuuccgacacacccguccaugauugcaacacgaccugucagacaccugagggcgccaucaauaccagccuccccuuccagaacauccacccgauuacaaucgggaagugcccuaaauaugugaagucuaccaagcugcgccuugcuacgggacugagaaauguucccuccauucagagccggggccucuuuggggccaucgcuggauucauugaaggcggguggacaggaaugguggacggcugguacggcuaucaucaccaaaacgagcaggggucuggauacgccgccgaccugaaaagcacccagaaugcuaucgauaagaucaccaacaaagucaauuccgugauugagaagaugaacacacaguuuaccgcgguuggcaaagaguucaaucaccuugagaagcgcaucgaaaaccugaauaagaaaguggacgauggguuccucgacauuuggacauacaacgccgagcugcugguccuccuggaaaacgagagaacgcuugauuaucaugacucuaaugugaagaaccuguacgagaaaguccggaaucaacucaagaacaaugcuaaagaaaucggaaacggcuguuuugaguucuaucacaagugcgauaauaccuguauggaaagcgugaagaacgggacauacgacuauccuaaauacuccgaggaagccaagcugaaucgcgagaaaauugauggcguuaaacuugagagcaccagaaucuaucagauccuggccauuuacucuacaguggcuuccagccucguccuggugguuucucugggagccaucuccuuuuggaugugcagcaacggcucccuccagugccggauuuguaucuga

SEQ ID NO: 196918 - RNA, 1701 nt, Artificial Sequence
  derived and/or modified sequence opt5 from hemagglutinin__InfluenzaA__EPI841265
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugggaggcguugcuccccuccaucuggggaaaugcaacaucgccggauggauucugggcaauccugagugugaaucucucagcaccgccuccucuuggagcuacaucguggagacguccaacucugacaaugggaccugcuauccgggagauuuuauuaacuacgaagaacugagagagcagcuuagcuccgucagcucuuucgaacgguuugagaucuuccccaagacauccagcuggccuaaucacgacucuaacaagggcgugaccgcugccuguccccaugcuggcgccaaauccuuuuauaagaaucugaucuggcucguuaaaaaggggaacagcuacccuaaacugaaucaaucuuauauuaacgauaagggaaaggaagugcuuguccuguggggcauccaccaccccuccacaaccgcggaccagcagagcauuuaccagaacgccgaugcuuacguguucguggggacgucccgcuauucuaaaaaguuuaaaccugagaucgccacaagaccgaagguccgggaccaagagggacgcauuaauuacuauuggacccucguugaacccggcgauaaaaucacauucgaggcuaccgggaaccugguggugccuagauacgccuuuaccauggaacggaaugcgggaagcggcauuaucaucuccaacacacccguccaugacugcaauacgaccugucagacaccugagggcgccauuaacaccagccugcccuuccagaauauccacccgauuacaaucgggaagugcccuaaauaugugaagucuaccaagcuccgccuggcuacgggacuuagaaacguucccuccauucagagccggggccuguuuggggccaucgcuggauucaucgaaggcggguggacaggaaugguggauggcugguacggcuaucaucaccaaaaugagcaggggucuggauacgccgccgaccucaaaagcacccagaacgcuauugacaagaucaccaauaaagucaacuccgugauugagaagaugaauacacaguuuaccgcgguuggcaaagaguucaaccaccuggagaagcgcaucgaaaaucuuaacaagaaaguggaugacggguuccuggauauuuggacauacaacgccgagcuccugguccugcucgaaaaugagagaacgcuggacuaucaugauucuaacgugaagaaucuuuacgagaaaguccggaaccaacugaagaauaacgcuaaagaaaucggaaauggcuguuuugaguucuaucacaagugcgacaacaccuguauggaaagcgugaagaaugggacauacgauuauccuaaauacuccgaggaagccaagcucaaccgcgagaaaaucgacggcguuaagcuggagagcaccagaauuuaucagauccuugccauuuacucuacaguggcuuccagccugguccucgugguuucucugggagccaucuccuuuuggaugugcagcaauggcucccugcagugccggauuuguaucuga

SEQ ID NO: 196919 - RNA, 1701 nt, Artificial Sequence
  derived and/or modified sequence opt5 from hemagglutinin__InfluenzaA__EPI291846
augaaggccaucauugugguccugcucuacaccuucgcuacagccgacgcggauacgcugugcaucggcuaucacgcuaacaauagcaccgacacaguugauaccgugcuugagaaaaacgugacagucacccauuccgugaaucugcucgaaaacaagcacgacgggaaacuguguaaucuuaagggaguugcuccccugcaucucggcaaaugcaacauugccggguggcugcugggaaauccugagugugaaucucucuuuacagccagcuccuggucuuacaucguggagaccccgaacagcgauaauggcacgugcuaucccggggacuucauuaacuacgaggaacugagagagcaccuuuccucugucagcuccuuugaacgguucgagaucuuuccuaaggugaauagcuggcccaaccaugauaccaauaagggaguuacagccgcuuguccuuaugccggcgcgaacucuuucuaccgcaaucugaucuggcucgugaaaaagggcaacuccuaucccaaacugagcaagucuuacauuaacaauaaaaagaaggaaguccuugugaucugggggauucaccacccuccgaccuccacagaccagcaaacccuguaccagaacgccgaugcuuauguguuugucggaagcucuaaauacuccaagagauucgagcccgagaucgccgcucggccuaaaguucgcaaucaggccggcagaaugaacuauuacuggacgcucauugaacccggggacacaaucaccuuugaggcgacaggaaaucugguggugccucgguaugccuucgcuaugcgcagaggcagcggguccggaauuaucgucucugaugcccccgugcaugacugcaacaccaccugucagacaccgaagggcgcuaucaauacgagccugccuuuucaaaacauucaccccguuaccaucggcgaaugcccuaaauacgugaaguccacaaaacuccggauggccaccgggcugcgcaauauucccagcauccagucuagaggacuuuucggcgccauugcuggguuucuggagggaggcuggacagggaugaucgauggaugguauggcuaccaucaccagaacgaacagggcuccggguacgcggccgaccaaaagagcacccagaaugcuaucgacggaauuacgaacaaggucaauucuaucauugagaaaaugaacacacaguucaccgccgugggcaaggaguucagccagcucgaaaaacggaucgagucccugaauaacaagguugaugacggguuucuugauauuuggaccuauaacgccgaaaugcuggugcuccuggagaaugaacgcacacuggacuaccacgauucuaacgucaaaaaucucuaugagaaggugagaagccaacugaagaacaaugcuaaagagaucggaaacggcuguuucgaauuuuaccauaagugcgacaauaccuguauggaguccguccggaacgggacauaugauuaccccaaauauagcgaagaggccaaacuuaaucgcgaagagaucgacggcgugaagcuggagucugcgagaauuuaccagauccucgcuauuuacuccacgguugccagcucucuggugcuucuggucucccucggagccgugagcuucuggaugugcuccaacggcucucugcagugccggaucuguauuuga

SEQ ID NO: 196920 - RNA, 1695 nt, Artificial Sequence
  derived and/or modified sequence opt5 from hemagglutinin__InfluenzaA__EPI558121
augaaggccauccuggugguccuccuguacaccuucacaacggcuaacgccgacacccuuugcauuggcuaucacgcgaauaacagcacagauaccguugacacagugcuggagaagaaugugaccgucacacauuccgugaaccuccuggaaaauagacacaacgggaaacuuuguaagcugcggggaguugcuccccuccaucugggcaagugcaauaucgccggguggcugcucggaaacccugagugugaaucucugagcaccgccuccucuuggagcuacauuguggagacguccaauucugauaacgggaccugcuauccgggcgacuuuaucaauuacgaagaacuucgcgagcagcugagcuccgucagcucuuucgaaagauuugagauuuucccccaaacauccagcuggccuaaccacgauaccaaucggggagugacagcugccuguccccaugcuggcaccaacucuuuuuaucgcaaucucguuuggcuggugaaaaagggcaacuccuacagcaagaucaacaaaucuuauaucaauaacaaggaaaaagagguccuugugcugugggccauucaccacccuuccacgagcgcggaccagcagucccucuaccagaaugccgaugcuuacguguucgucgggucuagcagauauucccggaaguuugagcccgaaaucgccacacgcccuaaaguuagagaccaagcuggacggaugaacuacuauuggacccugguggagccgggcgauaagauuacauucgaagccaccgggaaucugguggcgccccgcuacgccuuugcucucaagagaaacagcggaucuggcaucauuaucuccgacaccagcguccaugauugcgacacaacgugucagaccccuaauggggccauuaacacaucucugcccuuccagaauauccacccugugaccaucggagagugccccaaauauguuaagagcacaaaacuucggauggcuaccggccugcgcaacauuccguccauccagucuagaggccucuuuggggccauugccggauucaucgaaggcggguggacgggaaugauugauggcugguacggguaucaucaccaaaaugagcagggaagcggcuacgcugcggaccugaaguccacacagaacgccaucgacggcaucaccaauaaagugaacagcgucauugagaagaugaauacccaguuuacagcuguggggaaagaguucucucaccuugagcggcgcaucgaaaaccugaacaagaagguugaugacggauuccucgauauuuggaccuacaaugccgagcugcuggugcuccuggaaaacgagagaacacuugacuaucaugauuccaaugucaaaaaccuguacgagaaggugcggagccaacucaaaaauaacgccaaggaaaucggcaauggguguuuugaguucuaucacaaaugcgacgauauguguauggaaucugucaagaacggaacguacgacuauccuaaguacuccgaggaagcuaaacugaauagagaggagauugauggcgugaaacuugaaagcacccgcaucuaucagauccuggccauuuacuccacaguugcgucuagccucgugcuggucgugucccugggggcuaucucuuuuuggaugugcagcaacggcucccuccagugccggauuuga

SEQ ID NO: 196921 - RNA, 1701 nt, Artificial Sequence; identical to SEQ ID NO: 195465
  derived and/or modified sequence opt5 from hemagglutinin__InfluenzaA__EPI564139

SEQ ID NO: 196922 - RNA, 1701 nt, Artificial Sequence; identical to SEQ ID NO: 196710
  derived and/or modified sequence opt5 from hemagglutinin__InfluenzaA__EPI786706

SEQ ID NO: 196923 - RNA, 1701 nt, Artificial Sequence
  derived and/or modified sequence opt5 from hemagglutinin__InfluenzaA__EPI395313
augaaggccauccugauugugcuccuguacaccuucacaacggcuaacgccgacacccuuugcaucggcuaucacgcgaauaacagcacagauaccgucgacacaguucuggagaaaaaugugaccgugacacauuccgucaaccuccuggaaaauagacacaacgggaaacuuuguaagcugcggggaguggcuccccuccaucugggcaagugcaauauugccggguggcugcucggaaacccugagugugaaucucugagcaccgccuccucuuggagcuacaucguugagacguccaauucugauaacgggaccugcuauccgggcgacuuuauuaauuacgaagaacuucgcgagcagcugagcuccgugagcucuuucgaaagauuugagaucuuccccaaaacauccagcuggccuaaccacgauaccaaucggggagucacagcugccuguccccaugcuggcaccaagucuuuuuauaagaaccucaucuggauugccaaaaagggcaauuccuacccuaaaaucaacaagagcuauauuaacaauaaagaaaaggaggugcugguucuuugggcgauccaccaccccucuacguccgccgaccaacagagccuguaccagaacgcugaugccuacguguucgucggguccucucgcuauagcagaaaguuugagccugaaauugcuacacggccgaaagugcgcgaccaggccggaagaaugaauuacuauuggacccucguggagcccggcgauaagaucacauucgaagcgaccgggaaccuggucgccccucgguacgcuuuugcccugaaacgcaauuccggaagcggcauuaucaucucugacaccuccguucaugauugcgacacaacgugucaaacccccaacggggcuauuaauacaagccucccuuuccagaacauccaccccgugaccauuggagagugcccgaaguaugugaaaucuacaaagcugagaauggccaccggccuucggaauaucccuagcauucagucccgcggccuguuuggggccaucgcuggauucaucgaaggcggguggacgggaaugauugauggcugguacggguaucaucaccagaacgagcaaggaucuggcuacgcggccgaccucaaaagcacacagaaugcuaucgacggcauuaccaacaaggucaauuccgugaucgagaagaugaacacccaguuuacagccguugggaaagaguucagccaccuggagagacggauugaaaaucuuaacaagaaaguggaugacggauuccuggauaucuggaccuacaacgccgagcuccugguccugcucgaaaaugagcgcacacuggacuaucaugauucuaacgugaagaaucuuuacgagaaaguuagaucccagcugaagaacaaugcuaaggaaaucggcaacggguguuuugaguucuaucacaaaugcgacgauauguguauggaaagcgugaagaauggaacguacgacuaucccaaauacucugaggaagccaagcucaaccgggaggucauugauggcgugaaacuggaguccaccagaaucuaucaaauucuugcgaucuacgcuacagucgccagcucccuggugcucguugugucucugggggccauuagcuuuuggaugugcuccaauggcucucugcagugccgcaucuguauuuga

SEQ ID NO: 196924 - RNA, 1701 nt, Artificial Sequence
  derived and/or modified sequence opt5 from hemagglutinin__InfluenzaA__EPI291696
augaaggccauccugcucgugcugcuuuacaccuucacagcugccaacgcggacacgcugugcauuggcuaucacgcuaauaacagcaccgauacagucgacaccguucucgagaaaaaugugacagugacccauuccgucaaccugcuugaaaauagacacaacgggaagcuguguaaacuccggggagugcccccucugcaucugggcaagugcaauaucgccggguggcuccugggaaacccggagugugaacuucuguuuacagccucuagcugguccuacauuguugagaccucuaauagcgauaacggcacgugcuaucccggggacuucaucaauuacgaggaacuccgcgagcagcuguccucugugagcuccuuugaaagauucgagauuuuuccuaaagcuagcucuuggcccgaucacgaaaccaaccggggagucacagccgcuuguccuuaugccggcgccaauuccuucuaccgcaaccuuaucuggcuggugaagaagggcaauagcuaucccaaacucucuaaguccuacguuaacaacaaagagaaggaggugcugguccugugggggauccaucacccuccgaccagcacagaccaacagucucucuaccagaaugcggaugcuuauguguuugugggauccagcaaauacaacaagaaguucaaacccgaaauggccgcuagaccuaagguccggggccaggccgggcgcaugaauuauuacuggacccugguugcgcccggagacacgauuacauuugaggccaccggcaaccuuguggugccuagauaugcuuucgccaugaaacggggguccggaucuggcaucauuaucagcgauacacccguccacgacugcaauaccaccugucaaacaccgaagggcgcuauuaacacgucccugccuuuucagaauauccaucccgugaccauuggggaaugcccuaaauacguuaagagcacaaaacuccgcauggccaccggacugagaaacauccccucuauccagucccggggccuuuucggggccauugcuggauuuaucgagggcggguggacaggaaugauugauggcugguauggcuaccaccaucagaaugaacaagggagcggauacgcggccgaccgcaagucuacccagaacgcuaucgauggcauuacgaauaaggugaacagcgucaucgagaaaaugaauacacaguucaccgccguggggaaggaguucaaccaccuggaaaagagaaucgagaaucucaacaagaaaguugacgacggauuucuggauguguggaccuauaacgccgaacugcucguccugcuugagaaugaacggacacuggacuaccacgauuccaacgugaagaaucucuaugagaagguccgcucucagcugaaaaacaaugcuaaggagauuggcaacggguguuucgaauuuuaccauaaaugcgacgauaccuguauggagagcgugaagaauggcacauaugacuaccccaaauauuccgaagagagcaaacuuaacagagaagagaucgauggaguuaagcuggagucuacgcggauuuaccaaauccucgccauuuacuccaccguggcgagcucucugguccuguccgugagccucggcgcuaucuccuucuggaugugcucuaaugggagccugcagugcagaaucuguauuuga

SEQ ID NO: 196925 - RNA, 1701 nt, Artificial Sequence; identical to SEQ ID NO: 192855
  derived and/or modified sequence opt5 from hemagglutinin__InfluenzaA__ACU80014

SEQ ID NO: 196926 - RNA, 1701 nt, Artificial Sequence; identical to SEQ ID NO: 185693
  derived and/or modified sequence opt5 from hemagglutinin__InfluenzaA__EPI177400

SEQ ID NO: 196927 - RNA, 1701 nt, Artificial Sequence; identical to SEQ ID NO: 186136
  derived and/or modified sequence opt5 from hemagglutinin__InfluenzaA__ACT36512

SEQ ID NO: 196928 - RNA, 1704 nt, Artificial Sequence
  derived and/or modified sequence opt5 from hemagglutinin__InfluenzaA__AJE30344
auggagaagaucgugcugcuccuggccgucauuagccuuguuaaauccgaccagaucugcauuggcuaccacgcuaacaauucuaccaagcaaguggauacaaucauggaaaagaacgugacggucacccaugcccaggacauucuggagaagacacacaaugggaaacucugugaucugaacggagugaagccccuuauccugaaggacugcagcguugcgggcuggcuccuggggaauccuaugugugaugaguucaucagagugccggagugguccuauauugucgaacgggcuaaccccgccaaugaccugugcuacccuggaacccucaacgauuaugaggagcugaaacaucuucugucucgcaucaaucacuuugaaaagaaccucauuauccccagaagcuccuggccuaaucaugagacaucucugggcgugagcgccgcuugucccuaccagggggccuccagcuucuuucggaacguuguguggcuuauuaaaaagaaugacgcuuauccuaccaucaaaauuucuuacaacaauacaaaccgcgaagaucugcucauccuguggggaauccaccacuccaacaaugccgcggagcagaccaaccuguauaagaauccggacacguacgucagcgugggcaccucuacacucaaccaaagacuggugcccaagauugccacccggucccaggucaauggccagagcgggcgcauggauuucuuuuggacaauccuuaaaccuaacgacgcuauucauuucgagucuaauggaaacuuuaucgcccccgaauacgcuuauaagauuguuaaaaagggcgauuccaccaucaugaaaagcgagauggaauacgggcacugcaauacgaagugucagacaccuaucggagccauuaacuccucuaugcccuuccauaauauccacccgcugaccauuggcgagugcccuaaauaugugaaaagcaacaagcucgugcuggcgacagggcuuagaaauagcccccugcgggaacgcagacggaaacgcggacucuuuggcgccaucgcuggcuucauugaagggggauggcaaggcauggucgacgggugguacggauaucaccauuccaacgagcagggcucuggguacgccgcugacaaggaauccacccagaaagccaucgauggagugaccaauaagguuaacagcaucauugacaaaaugaacacacaguuugaggccgugggcagagaguucaauaaccuggaacggcgcaucgaaaaucugaacaagaagauggaggauggcuuucucgacgucuggacguauaaugcugagcugcuugugcugauggaaaacgagagaacccucgauuuccacgacucuaauguuaaaaaccuguacgauaaggugcggcuucaacugagagacaaugcgaaagaacucgggaacggauguuucgaguuuuaccauaagugcgauaaugaauguauggagagcguccgcaacggcacauaugacuacccuaaauauuccgaggaagccauucugaagcgggaggaaaucucuggggugaagcuggagagcauuggaaccuaccagauccucuccauuuauagcacagucgcuucuucccuggcccuugccaucaucguggcuggccugagccucuggaugugcucuaaugggucccugcagugcagaauuuguaucuga

SEQ ID NO: 196929 - RNA, 1701 nt, Artificial Sequence; identical to SEQ ID NO: 196908
  derived and/or modified sequence opt5 from hemagglutinin__InfluenzaA__EPI178948

SEQ ID NO: 196930 - RNA, 1701 nt, Artificial Sequence; identical to SEQ ID NO: 196908
  derived and/or modified sequence opt5 from hemagglutinin__InfluenzaA__EPI178949

SEQ ID NO: 196931 - RNA, 1701 nt, Artificial Sequence
  derived and/or modified sequence opt5 from hemagglutinin__InfluenzaA__EPI590132
augaaggccauccugauugugcuccuguacaccuucacaacggcuaacgccgacaaaaucugcauuggcuaucacgcgaauaacagcaccgauacagucgacaccguucuugagaagaaugugacagugacccauuccgucaaccugcucgaaaauaaacacaacgggaagcuguguaaacuuagaggaguggcuccccugcaucucggcaagugcaauaucgccggguggcugcugggaaacccugagugugaaucucucgccacagcuagcuccuggucuuacauuguugagaccagcuccucuaauaacggcacgugcuauccgggggauuuuaucaauuacgaggagcugcgggagcagcuuagcuccgugagcucuuucgaaaaguuugagaucuuccccaaaaccuccagcuggccuaaccacgaaacaaauaagggagucaccgccgcuuguccccaugccggcacaaacucuuuuuauaaaaaucugauuuggcucgugaagaaagagaacuccuacccuaagaucaacauuagcuauaccaauaaccgcggcaaggagguucuggugcuuugggcgauccaccaucccccuacgucuacagaccaacagucccuguaccagaaugccaacagcuacgucuucgugggguccucuagauauagccggaaauuugaaccggagauugcuacccgccccaaggugagaggacaggccggccggaugaauuacuauuggacacucgucgaaccuggggauaaaaucaccuucgaggcuaccggaaaccugguugugccccgcuacgccuuugcgcugaagagaaauuccggcagcgggauuaucaucucugaaacaccugugcacgacugcgauacgaccugucaaacacccaacggagccauuaauaccucccucccguuccagaacauccacccugucacaauuggcgagugccccaaauauguuaagagcaccaaacugcggauggcuacgggccuucgcaauaucccuucuauucagagcagagggcuguuuggagccaucgcuggcuucaucgaagggggauggacaggcaugauugacgggugguacggauaucaucaccagaacgaacaaggcuccggcuacgccgccgaucucaagucuacccagaaugcuaucgacgggauuaccaacaaggugaauagcgugaucgagaaaaugaacacacaguuuaccgcggucggaaaggaguucucccaccuggaacggcgcauugaaaaccuuaauaaaaagguggaugacggcuucaucgauaucuggacauacaacgccgagcugcucguucugcuggagaaugaaagaacgcucgacuaucaugacagcaacgugaaaacccuguacgagaagguccggucucagcuuaagaauaacgcuaaagaaauugggaauggauguuuugaguucuaucacaagugcgaugacacauguauggaauccgugaaaaacggcaccuacgauuaucccaaguacagcgaggaggccaaacugaaucgcgaagagaucgacgggauuaagcucgaaucuacaagaaucuaucaaauucuggccaucuacuccaccgucgcuagcucccuugugcugguugugucucucggcgccauuagcuuuuggaugugcuccaacggaucucugcagugccgggucuguaucuga

SEQ ID NO: 196932 - RNA, 1701 nt, Artificial Sequence; identical to SEQ ID NO: 184760
  derived and/or modified sequence opt5 from hemagglutinin__InfluenzaA__ABU80400

SEQ ID NO: 196933 - RNA, 1698 nt, Artificial Sequence
  derived and/or modified sequence opt5 from hemagglutinin__InfluenzaA__ABO21709
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcagacucaaaggaaucgcuccccugcagcugggcaaguguaacauugccggguggcuccugggaaauccugagugcgauccgcuucugcccgugcggagcugguccuauaucguugaaacaccuaacucugagaauggcauuuguuaccccggggacuucaucgauuaugaagaacuccgcgagcaacugagcuccgugucuagcuuugaaagauucgagaucuuuccuaaagaauccagcuggcccaaccauaauaccaacggagucacagcugccugcucucacgagggcaaguccagcuucuaccggaaucuucuguggcucaccgagaaggaaggcucuuauccuaaacugaagaacuccuacgugaauaaaaaggggaaagagguucuggugcucuggggcauucaucacccgcccaacagcaaggaacagcagaaccuguaucagaaugagaacgcguacgucucuguggugacguccaauuacaaccgcagauuuaccccugaaaucgccgagcggcccaagguccgcgaccaagcuggaagaaugaauuauuacuggacacuucugaaaccuggggauaccauuaucuucgaggccaacggaaaucucauugcucccauguaugccuuugcgcugagccggggcuucggguccggaaucauuacaucuaacgccagcaugcacgaauguaauaccaagugccagacgccgcuuggcgcuaucaacuccagccugccuuaccagaauauccaucccguuacaauuggcgaguguccuaaauaugugcgcucugccaagcucagaauggugaccgggcugcggaacaaucccuccauccagagccgcggacuguuuggcgcuauugccggguucaucgaaggaggcuggacagggaugauugacggaugguacggcuaucaccaucaaaacgagcagggcucuggguacgccgcugaucagaaaagcacccagaaugcgaucaacggaaucaccaacaaggucaauacagugauugagaaaaugaacauccaauuuacggccguuggcaaggaguucaauaagcucgagaaaagaauggaaaaccugaauaagaaaguggacgauggguuucuugacauuuggaccuacaacgcugagcugcucguccugcuugaaaaugagcggacacuggacuuccacgauuccaacgugaagaaucucuaugaaaaaguuaagucucagcugaagaacaaugccaaagagaucggaaacggcugcuucgaguuuuaccacaagugugacaaugaaugcauggagagcgugcgcaacgggaccuaugauuaccccaaauauuccgaagagagcaagcugaauagagagaaagucgacggcgugaagcucgaaucuaugggaauuuaccagauccuggccaucuauuccacagucgcuagcucucuugugcugcucguuucccugggcgccauuagcuucuggaugugcuccaacgggucucugcaaugucggaucugcauuuga

SEQ ID NO: 196934 - RNA, 1701 nt, Artificial Sequence; identical to SEQ ID NO: 185680
  derived and/or modified sequence opt5 from hemagglutinin__InfluenzaA__CAZ65588

SEQ ID NO: 196935 - RNA, 1701 nt, Artificial Sequence; identical to SEQ ID NO: 196710
  derived and/or modified sequence opt5 from hemagglutinin__InfluenzaA__EPI697744

SEQ ID NO: 196936 - RNA, 1701 nt, Artificial Sequence; identical to SEQ ID NO: 196870
  derived and/or modified sequence opt5 from hemagglutinin__InfluenzaA__EPI768525

SEQ ID NO: 196937 - RNA, 1701 nt, Artificial Sequence
  derived and/or modified sequence opt5 from hemagglutinin__InfluenzaA__EPI726930
augaaggccauccuggugguccuccuguacaccuucacaacggcuaacgccgacacccuuugcauuggcuaucacgcgaauaacagcacagauaccguugacacagugcuggagaagaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccaacucugacaaugggaccugcuauccgggcgauuuuauuaacuacgaagaacugcgggagcagcuuagcuccgucagcucuuucgaacgcuuugagaucuuccccaaggcuuccagcuggccuaaucacgacucuaacaagggagugacagccgcuuguccccaugccggcgcgaaauccuuuuauaagaaucugaucuggcucguuaaaaagggcaacagcuacccuaaacugaaucaaucuuauauuaacgauaaggggaaggaagugcuuguccuguggggaauccaccaccccuccaccacagccgaccagcagagccucuaccagaacgcugaugccuacguguucgugggcaccuccagauauucuaaaaaguuuaaaccugagauugcuacgcggccgaagguccgcgaccaagaggggagaaugaauuacuauuggacacugguugaacccggagauaaaaucaccuucgaggccacaggcaaccugguggugccucgguacgcguuuaccauggaacgcaaugccgggagcggaauuaucauuuccgacacccccguccaugauugcaacacaacgugucagaccccugagggcgcuaucaauacaagccuccccuuccagaacauccacccgauuaccaucggcaagugcccuaaauaugugaagucuacaaagcugagacuugccaccgggcugcggaauguucccuccauucagagccgcggacucuuuggcgcuaucgccggguucauugaaggaggcuggacggggaugguggacggaugguacggcuaucaucaccaaaacgagcagggcucuggguacgccgcugaccugaaaagcacacagaaugcgaucgauaagaucaccaacaaagucaauuccgugauugagaagaugaacacccaguuuacagccguuggaaaagaguucaaucaccuugagaagagaaucgaaaaccugaauaagaaaguggacgauggcuuccucgacauuuggaccuacaacgcugagcugcugguccuccuggaaaacgagcggacacuugauuaucaugacucuaaugugaagaaccuguacgagaaaguccgcaaucaacucaagaacaaugccaaagaaaucgggaacggauguuuugaguucuaucacaagugcgauaauacguguauggaaagcgugaagaacggcaccuacgacuauccuaaauacuccgaggaagccaagcugaauagagagaaaauugaugggguuaaacuugagagcacacggaucuaucagauccuggcuauuuacucuaccguggccuccagccucguccuggugguuucucugggcgcgaucuccuuuuggaugugcagcaacggaucccuccagugccgcauuuguaucuga

SEQ ID NO: 196938 - RNA, 1701 nt, Artificial Sequence
  derived and/or modified sequence opt5 from hemagglutinin__InfluenzaA__EPI813817
augaaggccauccuggugguccuccuguacaccuucacaacggcuaacgccgacacccuuugcauuggcuaucacgcgaauaacagcacagauaccguugacacagugcuggagaagaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccaacucugacaaugggaccugcuauccgggcgauuuuauuaacuacgaagaacugcgggagcagcuuagcuccgucagcucuuucgaacgcuuugagaucuuccccaaggcuuccagcuggccuaaucacgacucuaacaagggagugacagccgcuuguccccaugccggcgcgaaauccuuuuauaagaaucugaucuggcucguuaaaaagggcaacagcuacccuaaacugaaucaaucuuauauuaacgauaaggggaaggaagugcuuguccuguggggaauccaccaccccuccaccacagccgaccagcagagccucuaccagaacgcugaugccuacguguucgugggcaccuccagauauucuaaaaaguuuaaaccugagauugcuacgcggccgaagguccgcgaccaagaggccagaaugaauuacuauuggacacugguugaacccggggauaaaaucaccuucgaggcgacaggaaaccugguggugccucgguacgccuuuaccauggaacgcaaugcuggcagcgggauuaucauuuccgacacccccguccaugauugcaacacaacgugucagaccccugagggagccaucaauacaagccuccccuuccagaacauccacccgauuaccaucggcaagugcccuaaauaugugaagucuacaaagcugagacuugcuaccggccugcggaauguucccuccauucagagccgcgggcucuuuggagccaucgccggcuucauugaagggggauggacgggcaugguggacgggugguacggauaucaucaccaaaacgagcagggcucuggcuacgcugcggaccugaaaagcacacagaaugccaucgauaagaucaccaacaaagucaauuccgugauugagaagaugaacacccaguuuacagcuguugggaaagaguucaaucaccuugagaagagaaucgaaaaccugaauaagaaaguggacgauggauuccucgacauuuggaccuacaacgccgagcugcugguccuccuggaaaacgagcggacacuugauuaucaugacucuaaugugaagaaccuguacgagaaaguccgcaaucaacucaagaacaaugccaaagaaaucggcaacggguguuuugaguucuaucacaagugcgauaauacguguauggaaagcgugaagaacggaaccuacgacuauccuaaauacuccgaggaagcuaagcugaauagagagaaaauugauggcguuaaacuugagagcacacggaucuaucagauccuggccauuuacucuaccguggcguccagccucguccuggugguuucucugggggcuaucuccuuuuggaugugcagcaacggcucccuccagugccgcauuuguaucuga

SEQ ID NO: 196939 - RNA, 1701 nt, Artificial Sequence
  derived and/or modified sequence opt5 from hemagglutinin__InfluenzaA__EPI466626
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauauguuaagagcaccaagcugagacuugccacagggcugcggaaugugcccucuauccagagccgcggacucuuuggcgcuauugccggguucaucgaaggaggcuggaccgggaugguggacggaugguacggcuaucaucaccaaaacgagcagggcuccggguacgccgcugaccugaaaucuacgcagaaugcgaucgauaagauuacaaacaaagucaauagcgugaucgagaagaugaacacccaguuuaccgccguuggaaaagaguucaaucaccuugagaagagaauugaaaaccugaauaagaaaguggacgauggcuuccucgacaucuggacauacaacgcugagcugcugguccuccuggaaaaugagcggacccuugauuaucaugacuccaacgugaagaaccuguacgagaaaguccgcaaucaacucaagaacaaugccaaagaaauugggaacggauguuuugaguucuaucacaagugcgauaauacauguauggaaagcgugaagaacggcacguacgacuauccuaaauacucugaggaagccaagcugaauagagagaaaaucgaugggguuaaacuugaguccacccggaucuaucagauucuggcuaucuacagcacaguggccucuuccgucgugcucguugugagccugggcgcgauuuccuuuuggaugugcucuaacggaagccugcagugccgcaucuguauuuga

SEQ ID NO: 196940 - RNA, 1701 nt, Artificial Sequence
  derived and/or modified sequence opt5 from hemagglutinin__InfluenzaA__EPI541966
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgaauccaauaagggagugacagccgcuuguccccaugccggcgcgaaaucuuuuuauaagaaccugaucuggcucguuaaaaagggcaauagcuacccuaaacugucccaaagcuauauuaacgacaaggggaaggaggugcuuguccuguggggaauccaccaccccuccaccacagccgaucagcagucucucuaccagaaugcugacgccuacguguucgugggcaccagcagauauuccaaaaaguuuaaaccugagauugcuauccggccgaagguccgcgaucaagaagggagaaugaacuacuauuggacgcugguugagcccggagacaaaauuacauucgaagccaccggcaaccugguggugccucgguacgcguuuacaauggagcgcaaugccgggagcggaaucauuaucucugauacccccguccaugacugcaacaccacaugucagacgccugaaggcgcuaucaauaccucccuccccuuccagaacauucacccgaucacaauuggcaagugcccuaaauauguuaagagcaccaagcugagacuugccacagggcugcggaaugugcccucuauccagagccgcggacucuuuggcgcuauugccggguucaucgagggaggcuggaccgggaugguggauggaugguacggcuaucaucaccaaaacgagcagggcuccggguacgccgcugaccugaaaucuacgcagaaugcgaucgacaagauuacaaacaaagucaauagcgugaucgaaaagaugaacacccaguuuaccgccguuggaaaagaguucaaucaccuugaaaagagaauugagaaccugaauaagaaaguggaugacggcuuccucgauaucuggacauacaacgcugaacugcugguccuccuggagaaugagcggacccuugacuaucaugauuccaacgugaagaaccuguacgaaaaaguccgcaaucaacucaagaacaaugccaaagagauugggaacggauguuuugaguucuaucacaagugcgacaauacauguauggagagcgugaagaacggcacguacgauuauccuaaauacucugaagaggccaagcugaauagagagaaaaucgacgggguuaaacuugaauccacccggaucuaucagauucuggcuaucuacagcacaguggccucuuccgucgugcucguugugagccugggcgcgauuuccuuuuggaugugcucuaacggaagccugcagugccgcaucuguauuuga

SEQ ID NO: 196941 - RNA, 1701 nt, Artificial Sequence
  derived and/or modified sequence opt5 from hemagglutinin__InfluenzaA__EPI652003
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgaauccaauaagggagugacagccgcuuguccccaugccggcgcgaaaucuuuuuauaagaaccugaucuggcucguuaaaaagggcaauagcuacccuaaacugucccaaagcuauauuaacgacaaggggaaggaggugcuuguccuguggggaauccaccaucccccuaccacagccgaucagcagucccucuaccagaaugcugacgccuacguguucgugggcaccucuagauauagcaaaaaguuuaaaccggagauugcuauccggcccaagguccgcgaucaagaagggagaaugaacuacuauuggacgcugguugagccuggagacaaaauuacauucgaagccaccggcaaccugguggugccccgguacgcguuuacaauggagcgcaaugccggguccggaaucauuaucagcgauaccccuguccacgacugcaacaccacaugucagacgcccgaaggcgcuaucaauaccucucucccguuccagaacauucacccuaucacaauuggcaagugccccaaauaugugaaguccaccaagcugagacuugccacagggcugcggaauguuccuagcauccagucucgcggacucuuuggcgcuauugccggguucaucgagggaggcuggaccgggaugguggauggaugguacggcuaucaucaccaaaacgagcagggcagcggguacgccgcugaccugaaauccacgcagaaugcgaucgacaagauuacaaacaaagucaauucugugaucgaaaagaugaacacccaguuuaccgccguuggaaaagaguucaaucaccuugaaaagagaauugagaaccugaauaagaaaguggaugacggcuuccucgauaucuggacauacaacgcugaacugcugguccuccuggagaaugagcggacccuugacuaucaugauagcaacgugaagaaccuguacgaaaaaguccgcaaucaacucaagaacaaugccaaagagauugggaacggauguuuugaguucuaucacaagugcgacaauacauguauggaguccgugaagaacggcacguacgauuaucccaaauacagcgaagaggccaagcugaauagagagaaaaucgacgggguuaaacuugaaucuacccggaucuaucagauucuggcuaucuacuccacaguggccagcucugucgugcucguugugucccugggcgcgauuagcuuuuggaugugcuccaacggaucucugcagugccgcaucuguauuuga

SEQ ID NO: 196942 - RNA, 1701 nt, Artificial Sequence
  derived and/or modified sequence opt5 from hemagglutinin__InfluenzaA__EPI291877
augaaggccaucauugugguccugcucuacaccuucgcuacagccgacgcggauacgcugugcaucggcuaucacgcuaacaauagcaccgacacaguugauaccgugcuugagaaaaacgugacagucacccauuccgugaauauucuggaaaacaagcacgacgggaaacucuguaagcugagaggaguugcuccccuucaucugggcaaaugcaauaucgccggguggcuccugggaaacccugagugugaaucucuguuugccgccagcuccuggucuuacauuguggagacaccgaauagcgauaacgggaccugcuaucccggcgacuucaucaauuacgaagaacuccgggagcaccuguccucugucagcuccuuugaacgcuucgagaucuuuccuaaggcuaacagcuggcccaaucaugauacgaacaagggagugaccgccgcguguccuuaugccggcgcuaauucuuucuacagaaaccuuauuuggcugguuaaaaagggcaauuccuaucccaaacucagcaagucuuacaucaacaacaaaaagaaggaagugcuggucauuugggggauccaccacccuccgacauccauugaccagcaaacccuuuaccagaaugccgaugcuuauguguuugugggaagcucuaaauacuccaagcgguucaaacccgagaucgccgcgcgcccuaaggucagagaccaggccggccggauggauuauuacuggacacugauugagcccggggacaccaucacguuugaagcuacaggaaaccucguugugccucgcuaugccuucgcuaugaaaagaggcagcggguccggaaucauugugucugaugcccccguccaugacugcaauaccacaugucagaccccgaagggcgccaucaacaccagccugccuuuucaaaauauucaccccgugacaaucggcgagugcccuaaauacguuaaguccacgaagcugcggauggcuaccgggcuccgcaacauucccagcauccagucuagaggacuguucggcgcgaucgccggguuuauugaaggaggcuggacagggaugaucgacggaugguauggcuaccaucaccagaaugagcagggcuccggguacgcugccgaucagaaaagcacccaaaacgccauugacggaaucacaaauaaggugaacucuauuaucgagaaaaugaauacccaguucacggcugucggcaaggaguucagccagcuugagaaacggaucgaaucccugaacaauaagguggaugacggguuucucgauauuuggacauauaacgccgagcugcuuguucugcucgaaaaugagcgcacccuggacuaccacgauucuaacgugaagaaccuguaugaaaaagucagaagccaacucaagaauaacgcgaaagagaucggaaauggcuguuucgaguuuuaccauaagugcgacaacaccuguauggaauccgugaaaaaugggacauaugauuaccccaaguauagcgaggaagcuaagcugaaccgggaggaaauugacggcaucaaacuugagucugcccgcauuuaccagauccuggccauuuacuccaccgucgcuagcucucucgugcugcuuguuucccugggagccgugagcuucuggaugugcuccaauggcucucuccagugcagaaucuguaucuga

SEQ ID NO: 196943 - RNA, 1701 nt, Artificial Sequence
  derived and/or modified sequence opt5 from hemagglutinin__InfluenzaA__ABR29595
augaaggccauccugcucgugcugcuuuacaccuucacagcugccaacgcggacacgcugugcauuggcuaucacgcuaauaacagcaccgauacagucgacaccguucucgagaagaaugugacagugacccauuccgucaaccugcuugaagauagacacaaugggaagcuguguaaacuccggggaguggcuccccugcaucugggcaagugcaacaucgccggguggcuccugggaaauccugagugugaacuucuguuuacagccucuagcugguccuacauuguugagaccucuaacagcgacaauggcacgugcuauccgggggauuucaucaacuacgaagaacuccgcgagcagcuguccucugugagcuccuuugaaagauucgagauuuuucccaaagccagcucuuggccuaaucacgaaaccaaccggggagucacagcugccugucccuaugcgggcgccaauuccuucuaccgcaaccuuaucuggcuggugaagaagggcaauagcuauccuaaacucucuaaguccuacguuaacaacaaagagaaggaggugcugguccugugggggauccaucaucccccuaccagcacagaccaacagucucucuaccagaaugcugaugccuauguguuugugggauccagcaaauacaacaagaaguucaaaccggaaauugcuaccagacccaagguccggggccaggccgggcgcaugaauuauuacuggacgcugguugagccuggagacacaaucaccuuugaagcgacaggcaaccuuguggugcccagauaugccuucgcuaugaaacggggguccggaucuggcauuaucauuagcgauaccccuguccacgacugcaauaccacaugucaaacgcccaagggcgccaucaacaccucccugccguuucagaauauucacccugugacaaucggggagugccccaaauacguuaagagcaccaaacuccgcauggcuacaggacugagaaacaucccuucuauucagucccggggccuuuucggggccaucgccggauuuauugaaggcggguggaccggaaugaucgauggcugguauggcuaccaccaucagaaugagcaagggagcggauacgcugcggaccgcaagucuacgcagaacgccauugauggcaucacaaauaaggugaacagcgucaucgagaaaaugaauacccaguucaccgcuguggggaaggaguucaaccaccuggagaaaagaauugaaaaucucaacaagaaaguugacgacggauuucuggauguguggacauauaacgccgagcugcucguccugcuugaaaaugagcggacccuggacuaccacgauuccaacgugaagaaucucuaugagaagguccgcucucagcugaaaaacaaugccaaggaaaucggcaacggguguuucgaguuuuaccauaaaugcgacgauacauguauggaaagcgugaagaauggcacguaugacuaccccaaauauuccgaggaaagcaaacuuaacagagaggagauugauggaguuaagcuggaaucuacccggaucuaccaaauucucgcuaucuacuccacaguggccagcucucugguccugcucgugucccugggcgcgaucagcuucuggaugugcuccaaugggucucuucagugcagaauuuguaucuga

SEQ ID NO: 196944 - RNA, 1701 nt, Artificial Sequence
  derived and/or modified sequence opt5 from hemagglutinin__InfluenzaA__EPI291885
augaaggccaucauugugguccugcuccacaccuucgcuacagccgacgcggauacgcugugcaucggcuaccaugcuaacaauagcaccgacacaguugauaccgugcuugagaaaaacgugacagucacccacuccgugaaucugcucgaaacaaagcaugacgggaaacuguguaaccuuaagggaguugcuccccugcaccucggcaaaugcaauauugccggguggcugcugggaaacccugagugugaaucucucuuuaccgccagcuccuggucuuauaucguggagacgccgaauagcgauaacgggaccugcuaccccggcaauuucauuaacuaugaggaacugagagagcaucuuuccucugucagcuccuuugaacgguucgagaucuuuccuaaggccaauagcuggcccaaccacgacacaaauaagggagugaccgcugccuguccuuacgcgggcgccaacucuuucuaucgcaaucugaucuggcucguuaaaaagggcaacuccuaccccaaacugagcaagucuuauauuaacaauaaaaagaaggaagugcuugucaucugggggauucaccauccuccgacauccaccgaucagcaaacgcuguaccagaacgcugacgccuacguguuugugggaagcucuaaauauuccaagagauucgagcccgagaucgcugcccggccuaaaguccgcaaucaggcgggcagaaugaacuacuauuggacacucauugaacccggggauaccaucacauuugaggccaccggaaaucugguugugccucgguacgcuuucgccaugcgcagaggcagcggguccggaauuaucgugucugacgcucccguccacgauugcaacaccacaugucagacgccgaagggcgccaucaauaccagccugccuuuucaaaacauucaucccgugacaaucggcgaaugcccuaaauauguuaaguccaccaaacuccggauggccacagggcugcgcaauauucccagcauccagucuagaggacuuuucggcgcuauugcgggguuucuggagggaggcuggaccgggaugaucgacggaugguacggcuaucaccaccagaacgaacagggcuccggguacgccgcugaucaaaagagcacgcagaaugccaucgacggaauuacaaacaaggucaauucuaucauugagaaaaugaacacccaguucaccgccgugggcaaggaguucagccagcucgaaaaacggaucgagucccugaauaacaagguggacgauggguuucuugacauuuggacauacaacgcugaaaugcugguucuccuggagaaugaacgcacccuggauuaucaugacucuaacgugaaaaaucucuacgagaaggucagaagccaacugaagaacaaugccaaagagaucggaaacggcuguuucgaauuuuaucacaagugcgauaauacauguauggaguccgugaaaaacgggacguacgacuaucccaaguacagcgaagaggcgaaacuuaaucgggaagagaucgauggcgucaagcuggagucugcucgcauuuaucagauccucgccauuuacuccaccguggccagcucucugguucuucuggugucccucggagcugucagcuucuggaugugcuccaacggcucucugcagugcagaaucuguauuuga

SEQ ID NO: 196945 - RNA, 1701 nt, Artificial Sequence; identical to SEQ ID NO: 185680
  derived and/or modified sequence opt5 from hemagglutinin__InfluenzaA__EPI176515

SEQ ID NO: 196946 - RNA, 1701 nt, Artificial Sequence; identical to SEQ ID NO: 186136
  derived and/or modified sequence opt5 from hemagglutinin__InfluenzaA__EPI189182

SEQ ID NO: 196947 - RNA, 1701 nt, Artificial Sequence; identical to SEQ ID NO: 185928
  derived and/or modified sequence opt5 from hemagglutinin__InfluenzaA__EPI180574

SEQ ID NO: 196948 - RNA, 1701 nt, Artificial Sequence; identical to SEQ ID NO: 191733
  derived and/or modified sequence opt5 from hemagglutinin__InfluenzaA__EPI377499

SEQ ID NO: 196949 - RNA, 1701 nt, Artificial Sequence
  derived and/or modified sequence opt5 from hemagglutinin__InfluenzaA__EPI346916
augaaggccauccuggugguccuccuguacaccuucacaacggcuaccgccgacacacuuugcauuggcuaucacgcgaacaauagcaccgauacaguugacaccgugcuggagaaaaacgugacagucacccauuccgugaaucuccuggaaaacagacacaaugggaaacuuuguaagcugcggggaguugcuccccuccaucugggcaagugcaacaucgccggguggcugcucggaaauccugagugugaaucucugagcacggccuccucuuggagcuacauuguggagaccuccaacucugauaauggcacaugcuauccgggggacuuuaucaacuacgaagaacuucgcgagcagcugagcuccgucagcucuuucgaaagauuugagauuuuccccaaaaccuccagcuggccuaaucacgauacaaaccggggagugaccgcugccuguccccaugacggcacaaauucuuuuuaucgcaaccucaucuggcugguuaagaagggcaauuccuacccuaaaaucaacaagagcuauauuaacaauaaagaaaaggagauccuugugcugugggcuauucaccaccccucuacguccgccgaucaacagagccucuaccagaacgcggacgccuacgucuucgugggguccucuagauauagccggaaauuugagccugaaguggcuacccgcccgaaggucagagaucaggccggacggaugaauuacuauuggacacugguugagcccggcgacaagaucaccuucgaagcuaccgggaaccugguggugccucgcuacgccuuugcgcucaaaagaaauuccggaagcggcauuaucauuucugauacauccguccaugacugcgauacgaacugucaaacccccaauggggccaucaacacaagccugccuuuccagaauauccaccccgugaccauuggagagugcccgaaguauguuaaaucuacaaagcugcggauggcuaccggccuucgcaacaucccuagcauucaguccagaggccucuuuggggccaucgcuggauucauugaaggcggguggacgggaaugaucgacggcugguacggguaucaucaccagaaugagcaaggaucuggcuacgccgccgaccugaaaagcacacagaacgcuaucgauggcauuaccaauaaggugaacuccgucaucgagaaaaugaauacccaguuuacagcgguggggaaggaguucagccaccuugagcggcgcauugaaaaccugaacaagaaaguugacgauggauuccucgacaucuggaccuacaaugccgagcugcuggugcuccuggaaaacgagagaacacuugauuaucaugacucuaaugucaagaaccuguacgagaaagugcggucccagcucaagaauaacgcuaaagaaauuggcaauggguguuuugaguucuaucacaagugcgaugacauguguauggaaagcgucaagaacggaacguacgauuaucccaaauacucugaggaagccaagcugaauagagaggagaucgacggcgugaaacuugaauccacccgcaucuaucaaauucuggccaucuacagcacaguugcuuccucucucgugcuggucgugagccugggggccauuuccuuuuggaugugcucuaacggcagccuccagugccggaucuguauuuga

SEQ ID NO: 196950 - RNA, 1689 nt, Artificial Sequence; identical to SEQ ID NO: 186307
  derived and/or modified sequence opt5 from hemagglutinin__InfluenzaA__ACV49600

SEQ ID NO: 196951 - RNA, 1701 nt, Artificial Sequence; identical to SEQ ID NO: 185353
  derived and/or modified sequence opt5 from hemagglutinin__InfluenzaA__BAF48361

SEQ ID NO: 196952 - RNA, 1701 nt, Artificial Sequence
  derived and/or modified sequence opt5 from hemagglutinin__InfluenzaA__EPI507594
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcaagagaggcagcaauucuuccuuuuucagccggcugaacuggcucacacaucugaauuuuaaguauccugcgcuuaacgucaccaugcccaacaaugagcaguucgacaaacuguacauuuggggagugcaccauccuguuacagauaaggaccagaucuuucucuaugcccagucuuccgggcgcauuaccgugagcacgaaaagaucccaacaggcugucaucccgaacauuggcuuccggccccgcaucagaaauaucccuucucggauuagcaucuacuggacaauugugaagcccggggauauccugcugauuaacuccaccggaaaucucaucgccccucgcggcuacuuuaaaaucagaagcgggaagucuuccauuaugcggagcgacgcucccaucggaaaguguaaaucugaaugcauuacaccgaacggcagcaucccuaaugacaagcccuuccagaacgugaaucgcauuaccuauggcgccuguccuagauacgucaaacaguccacccugaaacuugcgacagggaugcggaacguucccgagaagcaaacgcgcggaaucuuuggcgccaucgcuggguucauugaaaauggaugggagggcaugguggaugggugguauggauucagacaccagaacuuugagggccggggccaggccgcugaccugaagucuacccaagccgccaucgaucagauuaaugggaaacucaacagacugaucggaaagacaaaugaaaaguuccaccagauugagaaagaauuuagcgagguggaaggccgcauccaggaccuugagaaguacgucgaggauaccaaaauugaccugugguccuauaacgcugaacuccugguggcgcuggagaaccaacauacaaucgaucucaccgacagcgaaaugaauaagcuguucgagaaaacgaagaagcagcuucgggaaaacgccgaggauauggggaauggaugcuuuaaaaucuaccacaagugugacaacgcuugcauuggcucuaucagaaaugggacauaugaucaugacguuuaccgcgacgaggcccugaacaaucgguuccagauuaaaggcguggaacucaaguccggauacaaagauuggauccuguggauuagcuuugccaucucuugcuuccuucugugugucgcucuccugggcuuuaucaugugggccugccagaaggggaacauuagauguaauaucugcauuuga

SEQ ID NO: 196953 - RNA, 1701 nt, Artificial Sequence
  derived and/or modified sequence opt5 from hemagglutinin__InfluenzaA__EPI461953
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugguugauggaugguauggcuucagacaccagaacuucgagggccgggggcaggccgcugaccugaaaagcacccaagccgccauugaucagaucaauggaaagcucaacagacugauuggcaaaacaaaugaaaaguuucaccagaucgagaaggaguucuccgaaguggaagggcgcauucaggaccuugagaaauacguggaggauaccaagaucgaccuguggagcuauaacgcugaacuccuggucgcgcuggagaaccaacauacaaucgaucucaccgacucugaaaugaauaaacuguuugagaagacgaaaaagcagcuucgggaaaacgccgaggauaugggaaauggcugcuucaagauuuaccacaaaugugacaacgcuugcaucggguccauuagaaauggcacauaugaucaugacguguaccgcgacgaggcccugaacaaucgguuucagaucaagggaguugaacucaaaagcggcuacaaggauuggauucuguggaucucuuucgccaucuccugcuuucuucuguguguggcucuccugggguucauuaugugggccugccagaaaggaaacaucagauguaauauuugcaucuga

SEQ ID NO: 196954 - RNA, 1701 nt, Artificial Sequence
  derived and/or modified sequence opt5 from hemagglutinin__InfluenzaA__EPI461953/m1
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcaagagaggcagcaauucuuccuuuuucagccggcugaacuggcucacacaucugaauuuuaaguauccugcgcuuaacgucaccaugcccaacaaugagcaguucgacaaacuguacauuuggggagugcaccauccuguuacagauaaggaccagaucuuucucuaugcccagucuuccgggcgcauuaccgugagcacgaaaagaucccaacaggcugucaucccgaacauuggcuaccggccccgcaucagaaauaucccuucucggauuagcaucuacuggacaauugugaagcccggggauauccugcugauuaacuccaccggaaaucucaucgccccucgcggcuauuucaaaaucagaagcgggaagucuuccauuaugcggagcgacgcucccaucggaaaguguaaaucugaaugcauuacaccgaacggcagcaucccuaaugacaagcccuuucagaacgugaaucgcauuaccuacggcgccuguccuagauaugucaaacaguccacccugaaacuugcgacagggaugcggaacguucccgagaagcaaacgcgcggaaucuucggcgccaucgcuggguuuauugaaaauggaugggagggcaugguggaugggugguacggauucagacaccagaacuucgagggccggggccaggccgcugaccugaagucuacccaagccgccaucgaucagauuaaugggaaacucaacagacugaucggaaagacaaaugaaaaguuucaccagauugagaaagaguucagcgaaguggaaggccgcauccaggaccuugagaaguaugucgaggauaccaaaauugaccugugguccuacaacgcugaacuccugguggcgcuggagaaccaacauacaaucgaucucaccgacagcgaaaugaauaagcuguuugagaaaacgaagaagcagcuucgggaaaacgccgaggauauggggaauggaugcuucaaaaucuaucacaagugugacaacgcuugcauuggcucuaucagaaaugggacauacgaucaugacguuuaccgcgacgaggcccugaacaaucgguuucagauuaaaggcguggaacucaaguccggauauaaagauuggauccuguggauuagcuucgccaucucuugcuuucuucugugugucgcucuccugggcuucaucaugugggccugccagaaggggaacauuagauguaauaucugcauuuga

SEQ ID NO: 196955 - RNA, 1701 nt, Artificial Sequence
  derived and/or modified sequence opt5 from hemagglutinin__InfluenzaA__EPI668105
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaggcucuagcuccagcuuuuucucucggcuuaauuggcugacccaucucaacuauaaguacccugcccugaaugucacaaugcccaacaacgagcaguuugacaaacuuuauauuuggggagugcaccauccugggaccgauaaagaccagaucuucccguacgcgcaguccagcggccgcauuacgguuuccacaaagagaucucaacaggccgugauccccaauaucgggagccggccucgcauuagaggaauccccucccggauuagcaucuacuggaccauugucaaaccuggcgauauccugcucaucaacucuacagggaaucugauugcuccccgcggauauuuuaagaucagauccggcaaaagcucuauuaugcggagcgacgccccgaucggcaaguguaaguccgaaugcauuaccccuaacgggucuauccccaaugacaaaccuuuccagaacgugaaucgcaucaccuacggagcuugucccagauaugugaagcacagcacacugaaacucgccacgggcaugcggaacguccccgagaagcagacccgcgggauuuuuggagcgaucgccggcuucauugaaaaugggugggagggaaugguugauggcugguacggcuuuagacaccaaaacuccgaggggcggggacaggcugccgaccugaaaagcacacaggcugccaucgaucaaauuaauggcaaacuuaacagacugaucgggaagaccaaugaaaaguuccaucagauugagaaggaguucucugaaguggaaggacgcauccaggaccucgagaaauauguggaggauacaaagaucgaccugugguccuacaacgccgaacuucuggucgcucucgagaaucagcacaccauugaucugacggacagcgaaaugaacaaacuguuugagaagacaaagaagcaacuccgggaaaacgcggaggauaugggcaaugggugcuucaagaucuaucauaaaugugacaacgccugcauuggcucuaucagaaauggaaccuacgaucacaacguguaccgcgacgaggcucugaauaaccgguuucagauuaagggcguugaacuuaaauccggguauaaggacuggauccuguggaucagcuucgccauuuccugcuuucuccuguguguggcccuucugggauucaucaugugggcuugccagaaaggcaauauuagauguaacaucugcauuuga

SEQ ID NO: 196956 - RNA, 1701 nt, Artificial Sequence
  derived and/or modified sequence opt5 from hemagglutinin__InfluenzaA__EPI578446
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauaaguacccugcccugaaugucacaaugcccaacaacgagcaguuugacaaacuuuauauuuggggcgugcaccauccugggaccgauaaagaccagaucuucccguacgcgcaguccagcggaagaauuacgguuuccacaaagcggucucaacaggccgugauccccaauaucggcagccgcccucggauuagagggauccccucccgcauuagcaucuacuggaccauugucaaaccuggagauauccugcucaucaacucuacaggcaaucugauugcucccagaggguauuuuaagauccgguccggaaaaagcucuauuaugcgcagcgacgccccgaucggcaaguguaaguccgaaugcauuaccccuaacggcucuauccccaaugacaaaccuuuccagaacgugaauagaaucaccuacggggcuuguccccgguaugugaagcacagcacacugaaacucgccacgggaaugcgcaacguccccgagaagcagaccagaggcauuuuuggggcgaucgccggauucauugaaaauggcugggaggggaugguugauggaugguacggcuuucggcaccaaaacuccgagggcagagggcaggcugccgaccugaaaagcacacaggcugccaucgaucaaauuaauggaaaacuuaaccgccugaucggcaagaccaaugaaaaguuccaucagauugagaaggaguucucugaaguggaagggcggauccaggaccucgagaaauauguggaggauacaaagaucgaccugugguccuacaacgccgaacuucuggucgcucucgagaaucagcacaccauugaucugacggacagcgaaaugaacaaacuguuugagaagacaaagaagcaacucagagaaaacgcggaggauaugggaaauggcugcuucaagaucuaucauaaaugugacaacgccugcauugggucuauccgcaauggcaccuacgaucacaacguguaccgggacgaggcucugaauaacagauuucagauuaagggaguugaacuuaaauccggcuauaaggacuggauccuguggaucagcuucgccauuuccugcuuucuccuguguguggcccuucugggguucaucaugugggcuugccagaaaggaaauauucgcuguaacaucugcauuuga

SEQ ID NO: 196957 - RNA, 1701 nt, Artificial Sequence; identical to SEQ ID NO: 195465
  derived and/or modified sequence opt5 from hemagglutinin__InfluenzaA__EPI551882

SEQ ID NO: 196958 - RNA, 1701 nt, Artificial Sequence
  derived and/or modified sequence opt5 from hemagglutinin__InfluenzaA__EPI344389
augaagaccaucauugccuucagcugcauccugugucucauuuuugcucagaaacugcccggcuccgacaacucuauggccacacuuugccuggggcaccaugcggugccuaauggaacgcucgucaagaccaucacagaugaccaaauugagguuaccaacgcuacagaacuggugcagagcuccucuaccggcagaaucuguaauagcccgcaccagauccuugaugggaaaaacugcacacugauugacgcccuccugggagauccccauugugacgaucugcagaauaaggagugggaccucuucguggaacgguccaccgccuacucuaacugcuauccuuacuauguccccgauuacgcuacgcugcgcagccuuguggccuccagcggcaaucuggaguuuacccaagaaucuuucaacuggacagggguugcucaggacggauccagcuaugccuguagacggggcucugucaauuccuuuuucagccgccucaacuggcuguacaaucuuaacuauaaauacccugagcagaaugugaccaugcccaacaaugauaaguuugacaagcuguacaucuggggcgugcaccauccugggacagauaaagaccagaccaaccucuauguucaagcgucuggaagagugauugucuccacgaagcggagccagcagacagugaucccgaacauuggcucccgccccugggugagaggggucucuagcaucauuuccaucuacuggaccaucguuaaaccuggagacauucugcugaucaauagcacaggcaaccucauugcuccccggggguauuucaagauccagucuggaaaauccagcauuaugcgcucugaugcccacaucgacgagugcaauagcgaauguaucaccccuaacggcuccauucccaaugauaagccguuucaaaacgugaauaagaucaccuacggcgccugcccuagauaugugaaacagaacacacugaagcuggcuacggggaugcggaauguccccgagaaacagacccgcggaauuuucggcgccaucgcgggguuuauugaaaacggaugggagggcaugguggacgggugguacggauucagacaccaaaauucugagggcacaggccaggccgcugaucuuaagagcacccaggccgcuaucaaccagaucacagggaaacucaaucggguuauuaagaaaaccaacgaaaaguuucaucaaaucgagaaggaguucuccgaaguggaaggacgcauucaggaccuggagaaauaugucgaggauacgaagaucgaccuuuggagcuacaaugccgaacugcucguggcccuggagaaccagcacacaauugaucugaccgacucugaaauguccaaacucuucgagagaacccggagacagcugcgcgaaaacgcugaggauaugggcaauggguguuuuaagaucuaccauaaaugcgacaacgcgugcauuggaagcauccggaauggcacauaugaccacgauaucuacagaaacgaggcccuuaauaaccgcuuccaaauuaaggggguucagcugaagucuggcuauaaagacuggauccucuggauuuccuuugcuaucagcuguuuccugcuuugcgugguccugcucggauuuauuaugugggccugucagaagggcaauauccggugcaacaucuguauuuga

SEQ ID NO: 196959 - RNA, 1701 nt, Artificial Sequence
  derived and/or modified sequence opt5 from hemagglutinin__InfluenzaA__EPI348782
augaagaccaucauugccuucagcugcauccugugucucauuuuugcucagaaacugcccggcuccgacaacucuauggccacacuuugccuggggcaccaugcggugccuaauggaacgcucgucaagaccaucacagaugaccaaauugagguuaccaacgcuacagaacuggugcagagcuccucuaccggcagaaucuguaauagcccgcaccagauccuugaugggaaaaacugcacacugauugacgcccuccugggagauccccauugugacgaucugcagaauaaggagugggaccucuucguggaacgguccaccgccuacucuaacugcuauccuuacuauguccccgauuacgcuacgcugcgcagccuuguggccuccagcggcaaucuggaguuuacccaagaaucuuucaacuggacagggguugcucaggacggauccagcuaugccuguagacggggcucugucaauuccuuuuucagccgccucaacuggcuguacaaacuuaauuauaaguacccugagcagaacgugaccaugcccaauaacgauaaguuugacaaacuguacaucuggggcgugcaccauccugggacagauaaggaccagaccaauauuuauguucaagcgucuggaagagugaucgucuccacgaaacggagccagcagacagugauuccgaacaucggcucccgccccugggugagaggggucucuagcauuaucuccaucuacuggaccauuguuaagccuggagacauccuccugauuaacagcacaggcaaucugaucgcuccccggggguauuucaaaauucagucuggaaaguccagcaucaugcgcucugaugcccacaucgacgagugcaacagcgaauguauuaccccuaauggcuccauccccaacgauaagccguuucaaaaugugaacaaaauuaccuacggcgccugcccuagauaugugaagcagaauacacucaaacuggcuacggggaugcggaacguccccgagaagcagacccgcggaaucuucggcgccauugcgggguuuaucgaaaauggaugggagggcaugguggacgggugguacggauucagacaccaaaacucugagggcacaggccaggccgcugaucuuaaaagcacccaggccgcuaucaaucagauuacagggaagcugaaccggguuaucaaaaagaccaaugaaaaguuucaucaaauugagaaagaguucuccgaaguggaaggacgcauccaggaccucgagaaguaugucgaggauacgaaaauugaccuguggagcuacaacgccgaacuucugguggcccucgagaaucagcacacaaucgaucugaccgacucugaaauguccaagcuguucgagagaacccggagacagcuccgcgaaaacgcugaggauaugggcaacggguguuuuaaaauuuaccauaagugcgacaaugcgugcaucggaagcauccggaacggcacauaugaccacgauauuuacagaaaugaggcccugaacaaucgcuuccaaaucaaggggguucagcuuaaaucuggcuauaaggacuggauucuguggaucuccuuugcuauuagcuguuuccuccugugcgugguccuucugggauuuaucaugugggccugucagaaaggcaacauccggugcaauauuuguaucuga

SEQ ID NO: 196960 - RNA, 1701 nt, Artificial Sequence
  derived and/or modified sequence opt5 from hemagglutinin__InfluenzaA__EPI642513
augaagaccaucauugccuucagcugcauccugugucucauuuuugcucagaaacugcccggcuccgacaagucuauggccacacuuugccuggggcaccaugcggugccuaacggaacgcucgucaaaaccaucacagaugaccaaauugagguuaccaaugcuacagaacuggugcagagcuccucuaccagcagaaucuguaacuccccgcaccagauccuugauggcaagaauugcacacugauugacgcccuccugggggauccccauugugacgauuuccagaacaaaaagugggaccuguuuguggagcggucuaccgccuacagcaauugcuauccuuacuauguccccgauuacgcuacgcuccgcucccugaucgccagcucuggaaaccuugaguucacccaagaauccuuuaauuggacaggcguggcucaggacgggagcucuuaugccuguagacggggauccguuaacagcuucuuuucucgccugaauuggcucuacaaccugaauuauaaguacccugaacagaacgugaccaugcccaauaacgauaaauucgacaaacuuuacauuuggggcguccaccauccuggcacagauaaggaccagaccaaucuguaugugcaagcguccgggagaguuaucgugagcacgaagcggucccagcagacagucauuccgaacaucggaucucgccccugggugagaggcgugagcuccauuaucagcaucuacuggaccauugucaaaccuggggacauccuccugauuaacucuacaggaaaucugaucgcuccccggggcuauuuuaagauucaguccggaaagagcucuaucaugcgcagcgaugcccacaucgacgagugcaacuccgaguguauuaccccuaaugggucuauccccaacgauaaaccguuccaaaauguuaacaagauuaccuacggcgccugcccuagauaugugaaacagaauacacucaagcuggcuacgggcaugcggaacgugcccgaaaaacagacccgcgggaucuuuggagccauugcgggcuucaucgagaaugggugggaaggaauggucgacggcugguacggguuuagacaccaaaacagcgagggaacaggccaggccgcugaucuuaaguccacccaggccgcuaucaaucagauuacaggcaaacugaaccgggugaucaagaagaccaaugagaaauuccaucaaauugaaaaggaguucagcgaaguugaggggcgcauccaggaccucgaaaaauauguggaggauacgaagauugaccuguggucuuacaacgccgagcuucuggucgcccucgaaaaucagcacacaaucgaucugaccgacuccgagaugagcaaacuguuugaaagaacccggagacagcuccgcgagaacgcugaagauaugggaaacggcuguuucaagauuuaccauaagugcgacaaugcgugcaucgggucuauccggaacggaacauaugaccacgauauuuacagaaaugaggcccugaacaaucgcuuucaaaucaaaggcgugcagcuuaaguccggguauaaagacuggauucuguggaucagcuucgcuauuuccuguuuucuccugugcguugugcuucugggcuucaucaugugggccugucagaagggaaacauccggugcaauauuuguaucuga

SEQ ID NO: 196961 - RNA, 1701 nt, Artificial Sequence
  derived and/or modified sequence opt5 from hemagglutinin__InfluenzaA__EPI293965
augaagaccaucauugccuucagcugcauccugugucucauuuuugcucagaaacugcccggcuccgacaacucuauggccacacuuugccuggggcaccaugcggugccuaauggaacgcucgucaagaccaucacagaugaccaaauugagguuaccaacgcuacagaacuggugcagagcuccucuaccggcagaaucuguaauagcccgcaccagauccuugaugggaaaaacugcacacugauugacgcccuccugggagauccccauugugacgauuuccagaauaaggagugggaccuguuuguggaacgguccaccgccuacucuaacugcuauccuuacuauguccccgauuacgcuacgcuccgcagccugguggccuccagcggcaaucuugaguucacccaagaaucuuuuaacuggacagggguugcucaggacggauccagcuaugccuguagacggggcucugucaauuccuucuuuagccgccugaacuggcucuacaaucugaacuauaaauacccugagcagaaugugaccaugcccaacaaugauaaguucgacaaacuuuacaucuggggcgugcaccauccugggacagauaaggaccagaccaaccuguauguucaagcgucuggaagagugauugucuccacgaagcggagccagcagacagugaucccgaacauuggcucccgccccugggugagaggggucucuagcaucauuuccaucuacuggaccaucguuaaaccuggagacauucuccugaucaauagcacaggcaaccugauugcuccccggggguauuuuaagauccagucuggaaaauccagcauuaugcgcucugaugcccacaucgacgagugcaauagcgaauguaucaccccuaacggcuccauucccaaugauaagccguuccaaaacgugaauaagaucaccuacggcgccugcccuagauaugugaaacagaacacacucaagcuggcuacggggaugcggaauguccccgagaaacagacccgcggaauuuuuggcgccaucgcgggguucauugaaaacggaugggagggcaugguggacgggugguacggauuuagacaccaaaauucugagggcacaggccaggccgcugaucuuaagagcacccaggccgcuaucaaccagaucacagggaaacugaaucggguuauuaagaaaaccaacgaaaaguuccaucaaaucgagaaggaguucuccgaaguggaaggacgcauucaggaccucgagaaauaugucgaggauacgaagaucgaccuguggagcuacaaugccgaacuucugguggcccucgagaaccagcacacaauugaucugaccgacucugaaauguccaaacuguuugagagaacccggagacagcuccgcgaaaacgcugaggauaugggcaauggguguuucaagaucuaccauaaaugcgacaacgcgugcauuggaagcauccggaauggcacauaugaccacgauaucuacagaaacgaggcccugaauaaccgcuuucaaauuaaggggguucagcuuaagucuggcuauaaagacuggauccuguggauuuccuucgcuaucagcuguuuucuccugugcgugguccuucugggauucauuaugugggccugucagaagggcaauauccggugcaacaucuguauuuga

SEQ ID NO: 196962 - RNA, 1701 nt, Artificial Sequence
  derived and/or modified sequence opt5 from hemagglutinin__InfluenzaA__EPI465400
augaagaccaucauugccuucagcugcauccugugucucauuuuugcucagaaacugcccggcuccgacaacucuauggccacacuuugccuggggcaccaugcggugccuaauggaacgcucgucaagaccaucacagaugaccaaauugagguuaccaacgcuacagaacuggugcagagcuccucuaccggcagaaucuguaauagcccgcaccagauccuugaugggaaaaacugcacacugauugacgcccuccugggagauccccauugugacgauuuccagaauaaggagugggaccuguuuguggaacgguccaccgccuacucuaacugcuauccuuacuauguccccgauuacgcuacgcuccgcagccugguggccuccagcggcaaucuugaguucacccaagaaucuuuuaacuggacagggguugcucaggacggauccagcuaugccuguagacggggcucugucaauuccuucuuuagccgccugaacuggcucuacaaucugaacuauaaauacccugagcagaaugugaccaugcccaacaaugauaaguucgacaaacuuuacaucuggggcgugcaccauccugggacagauaaggaccagaccaagcuguauguucaagcgucuggaagagugauugucuccacgaaacggagccagcagacagugaucccgaacauuggcucccgccccugggugagaggggucucuagcaucauuuccaucuacuggaccaucguuaagccuggagacauucuccugaucaacagcacaggcaaucugauugcuccccggggguauuuuaaaauccagucuggaaaguccagcauuaugcgcucugaugcccacaucgacgagugcaacagcgaauguaucaccccuaauggcuccauucccaacgauaagccguuccaaaaugugaacaaaaucaccuacggcgccugcccuagauaugugaagcagaauacacucaaacuggcuacggggaugcggaacguccccgagaagcagacccgcggaauuuuuggcgccaucgcgggguucauugaaaauggaugggagggcaugguggacgggugguacggauuuagacaccaaaacucugagggcacaggccaggccgcugaucuuaaaagcacccaggccgcuaucaaucagaucacagggaagcugaaccggguuauuaaaaagaccaaugaaaaguuccaucaaaucgagaaagaguucuccgaaguggaaggacgcauucaggaccucgagaaguaugucgaggauacgaaaaucgaccuguggagcuacaacgccgaacuucugguggcccucgagaaucagcacacaauugaucugaccgacucugaaauguccaagcuguuugagagaacccggagacagcuccgcgaaaacgcugaggauaugggcaacggguguuucaaaaucuaccauaagugcgacaaugcgugcauuggaagcauccggaacggcacauaugaccacgauaucuacagaaaugaggcccugaacaaucgcuuucaaauuaaggggguucagcuuaaaucuggcuauaaggacuggauccuguggauuuccuucgcuaucagcuguuuucuccugugcgugguccuucugggauucauuaugugggccugucagaaaggcaacauccggugcaauaucuguauuuga

SEQ ID NO: 196963 - RNA, 1701 nt, Artificial Sequence
  derived and/or modified sequence opt5 from hemagglutinin__InfluenzaA__EPI328898
augaagaccaucauugccuucagcugcauccugugucucauuuuugcucagaaacugcccggcuccgacaacucuauggccacacuuugccuggggcaccaugcggugccuaauggaacgcucgucaagaccaucacagaugaccaaauugagguuaccaacgcuacagaacuggugcagagcuccucuaccggcagaaucuguaauagcccgcaccagauccuugaugggaaaaacugcacacugauugacgcccuccugggagauccccauugugacgauuuccagaauaaggagugggaccuguuuguggaacgguccaccgccuacucuaacugcuauccuuacuauguccccgauuacgcuacgcuccgcagccugguggccuccagcggcaaucuugaguucacccaagaaucuuuuaacuggacagggguugcucaggacggauccagcuaugccuguagacggggcucugucaauuccuucuuuagccgccugaacuggcucuacaaucugaacuauaaauacccugagcagaaugugaccaugcccaacaaugauaaguucgacaaacuuuacaucuggggcgugcaccauccugggacagauaaggaccagaccaagauuuauguucaagcgucuggaagagugaucgucuccacgaaacggagccagcagacagugauuccgaacaucggcucccgccccugggugagaggggucucuagcauuaucuccaucuacuggaccauuguuaagccuggagacauccugcucauuaacagcacaggcaaucugaucgcuccccggggguauuuuaaaauucagucuggaaaguccagcaucaugcgcucugaugcccacaucgacgagugcaacagcgaauguauuaccccuaauggcuccauccccaacgauaagccguuccaaaaugugaacaaaauuaccuacggcgccugcccuagauaugugaagcagaauacacugaaacucgcuacggggaugcggaacguccccgagaagcagacccgcggaaucuuuggcgccauugcgggguucaucgaaaauggaugggagggcaugguggacgggugguacggauuuagacaccaaaacucugagggcacaggccaggccgcugaucugaaaagcacccaggccgcuaucaaucagauuacagggaaacuuaaccggguuaucaagaagaccaaugaaaaguuccaucaaauugagaaagaguucuccgaaguggaaggacgcauccaggaccuggagaaguaugucgaggauacgaaaauugaccucuggagcuacaacgccgaacugcuuguggcccuggagaaucagcacacaaucgaucucaccgacucugaaauguccaagcuguuugagagaacccggagacagcugcgcgaaaacgcugaggauaugggcaacggguguuucaaaauuuaccauaagugcgacaaugcgugcaucggaagcauccggaacggcacauaugaccacgauauuuacagaaaugaggcccucaacaaucgcuuucaaaucaaggggguucagcugaaaucuggcuauaaggacuggauucuuuggaucuccuucgcuauuagcuguuuucugcucugcgugguccugcuuggauucaucaugugggccugucagaaaggcaacauccggugcaauauuuguaucuga

SEQ ID NO: 196964 - RNA, 1701 nt, Artificial Sequence; identical to SEQ ID NO: 196963
  derived and/or modified sequence opt5 from hemagglutinin__InfluenzaA__EPI328900

SEQ ID NO: 196965 - RNA, 1701 nt, Artificial Sequence
  derived and/or modified sequence opt5 from hemagglutinin__InfluenzaA__EPI574644
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugaugggaaaaacuguacacugaucgacgcccuccugggagauccccagugcgacggcuuucagaauaagcggugggaucuguucgucgaacgcucuaaagccuauagcaacuguuacccuuaugacgugcccgauuacgcuucccucagaucucugguugccagcuccgggacccuugaguuuaaugacgaauccuucaacugggcuggagugacgcaaaauggcaccucuuccgccugcauucggggcagcaacucuuccuuuuucagccgccugaauuggcucacacauucuaacuuuaaguauccugcgcugaaugucaccaugcccaacaacgagcaguucgauaaacuuuacaucuggggagugcaccauccugggacagacaaagaucagauuuuucuguaugcccacuccagcggcagaaucaccguuuccacgaagcggucucagcaagcugugauuccgaauaucgggagccgccccagaauccggaacauuccuucccgcaucagcauuuacuggacaaucgucaaacccggagacauucuccugaucaauucuaccggcaaccugaucgccccuagaggguacuucaagauucaguccggaaaaagcucuaucaugcggagcgacgcucccauuggcaaguguaaguccgagugcaucacaccgaauggcucuauuccuaacgauaaacccuuucagaaugugaaccgcaucaccuauggggccuguccuagauacgugaagcagagcacccucaaacuggcgacaggaaugcggaauguccccgaaaagcaaacgcgcggcaucuucggggccauugcuggauuuaucgagaacggcugggaagggaugaaagacggaugguauggcuucagacaccagaauagcgagggccgggggcaggccgcugaucuuaagagcacccaagccgccauugaccagaucaacggaaaacugaauagacucauuggcaagacaaacgagaaguuccaucagaucgaaaaagaguuuucugaaguugaggggcgcauucaggaucuggaaaaguacguggaggacaccaaaaucgaucuuugguccuauaaugcugagcugcucguggcgcuggaaaaccaacacacaaucgaccugaccgauagcgagaugaacaaacucuucgaaaagacgaagaagcagcugcgggagaaugccgaagacaugggaaacggcugcuuuaagauuuaccauaagugugauaaugcuugcaucgggucuauuagaaacggcacauaugaccacgacgucuaccgcgaugaggcccuuaauaaccgguuccagaucaaaggaguggagcugaaguccggcuacaaagacuggauucucuggaucagcuuugccaucuccugcuuccugcuuuguguugcucugcucggguuuauuaugugggccugccagaagggaaauaucagauguaacauuugcaucuga

SEQ ID NO: 196966 - RNA, 1701 nt, Artificial Sequence
  derived and/or modified sequence opt5 from hemagglutinin__InfluenzaA__EPI563212
augaagaccaucauugcccugagcuacauccucugccugguguucgcucagaaaauucccggcaacgacaauaacacagccacgcuuugucuggggcaccaugcggucccuaauggaaccaucguuaagacaauuaccaacgauagaaucgaggugacaaaugcuaccgaacucgugcaaaacuccucuaucggcgagauuugcgacagcccgcaccagauccuggauggggaaaauuguacacuuauugacgcccugcucggagauccccagugcgacggcuuucagaacaaaaagugggaucuguucgucgagcgguccaaagccuauucuaauuguuacccuuaugacgugcccgauuacgcuagccugcgcucccucguugccucuagcgggacccuggaauuuaacaaugaguccuucaacuggacgggagugacccaaaauggcacaagcucugcuugcaucagacgguccucuagcuccuuuuucagccgccuuaacuggcugacccaucucaauuauaaguacccugcccugaacgucacaaugcccaacaaugagcaguuugacaaacuuuauauuuggggcgugcaccauccugggaccgauaaagaccagaucuucccguacgcgcagucuuccggaagaauuacgguuagcacaaagcggucccaacaggccgugauccccaacaucggcucucgcccucggauuagagggauccccagccgcauuuccaucuacuggaccauugucaaaccuggagauauccugcucaucaauagcacaggcaaccugauugcucccagaggguauuuuaagauccggucuggaaaauccagcauuaugcgcucugacgccccgaucggcaaguguaagagcgaaugcauuaccccuaauggcuccauccccaacgacaaaccuuuccagaaugugaacagaaucaccuacggggcuuguccccgguaugugaagcacucuacacugaaacucgccacgggaaugcgcaauguccccgagaagcagaccagaggcauuuuuggggcgaucgccggauucauugaaaacggcugggaggggaugguugauggaugguacggcuuucggcaccaaaauagcgagggcagagggcaggcugccgaccugaaauccacacaggcugccaucgaucaaauuaacggaaaacuuaaucgccugaucggcaagaccaacgaaaaguuccaucagauugagaaggaguucagcgaaguggaagggcggauccaggaccucgagaaauauguggaggauacaaagaucgaccuguggucuuacaaugccgaacuucuggucgcucucgagaaccagcacaccauugaucugacggacuccgaaaugaacaaacuguuugagaagacaaagaagcaacucagagaaaaugcggaggauaugggaaacggcugcuucaagaucuaucauaaaugugacaaugccugcauugggagcauccgcaacggcaccuacgaucacaauguguaccgggacgaggcucugaacaauagauuucagauuaagggaguugaacuuaaaucuggcuauaaggacuggauccuguggaucuccuucgccauuagcugcuuucuccuguguguggcccuucugggguucaucaugugggcuugccagaaaggaaacauucgcuguaauaucugcauuuga

SEQ ID NO: 196967 - RNA, 1701 nt, Artificial Sequence; identical to SEQ ID NO: 196966
  derived and/or modified sequence opt5 from hemagglutinin__InfluenzaA__EPI553999

SEQ ID NO: 196968 - RNA, 1701 nt, Artificial Sequence
  derived and/or modified sequence opt5 from hemagglutinin__InfluenzaA__EPI551570
augaagaccaucauugcccugagcuacauccucugccugguguucgcucagaaaauucccggcaacgacaauaacacagccacgcuuugucuggggcaccaugcggucccuaauggaaccaucguuaagacaauuaccaacgauagaaucgaggugacaaaugcuaccgaacucgugcaaaacuccucuaucggcgagauuugcgacagcccgcaccagauccuggauggggaaaauuguacacuuauugacgcccugcucggagauccccagugcgacggcuuucagaacaaaaagugggaucuguucgucgagcgguccaaagccuauucuaauuguuacccuuaugacgugcccgauuacgcuagccugcgcucccucguugccucuagcgggacccuggaauuuaacaaugaguccuucaacuggacgggagugacccaaaauggcacaagcucugcuugcaucagacgguccucuagcuccuuuuucagccgccuuaacuggcugacccaucucaauuauacauacccugcccugaacgucaccaugcccaacaaugagcaguuugacaaacuuuauauuuggggcgugcaccauccugggacggauaaggaccagaucuuccuguacgcgcagucuuccggaagaauuacaguuagcaccaagcggucccaacaggccgugaucccgaacaucggcucucgcccccggauuagagauaucccuagccgcauuuccaucuacuggacaauugucaagcccggggacauccuccugaucaauagcaccggaaaccugauugcuccuagaggcuauuuuaaaauccggucugggaaguccagcauuaugcgcucugacgcccccaucggaaaauguaagagcgaaugcauuaccccgaauggcuccaucccuaacgauaagcccuuccagaaugugaacagaaucacauacggcgcuuguccucgguaugugaaacacucuacgcucaagcuggccaccgggaugcgcaauguccccgagaaacagacaagaggaauuuuuggcgcgaucgccggguucauugaaaacggaugggagggcaugguugacgggugguacggauuucggcaccaaaauagcgagggcagaggccaggcugccgaucuuaaguccacccaggcugccaucgaccaaauuaacgggaaacugaaucgccucaucggaaagacaaacgaaaaauuccaucagauugagaaggaguucagcgaaguggaaggccggauccaggaucuggagaaguauguggaggacaccaaaaucgaucuuuggucuuacaaugccgaacugcucgucgcucuggagaaccagcacacgauugaccugacagauuccgaaaugaacaagcucuuugagaaaaccaagaaacaacugagagaaaaugcggaggacauggggaacggaugcuucaagaucuaucauaagugugauaaugccugcauuggcagcauccgcaacgggaccuacgaccacaauguguaccgggacgaggcucuuaacaauagauuucagauuaaaggcguugaacugaagucuggauauaaagauuggauccucuggaucuccuucgccauuagcugcuuucugcuuuguguggcccugcucggcuucaucaugugggcuugccagaaggggaacauucgcuguaauaucugcauuuga

SEQ ID NO: 196969 - RNA, 1701 nt, Artificial Sequence
  derived and/or modified sequence opt5 from hemagglutinin__InfluenzaA__EPI629738
augaagaccaucauugcccugagcuacauccucugccugguguucgcucagaaaauucccggcaacgacaauaacacagccacgcuuugucuggggcaccaugcggucccuaauggaaccaucguuaagacaauuaccaacgauagaaucgaggugacaaaugcuaccgaacucgugcaaaacuccucuaucggcgagauuugcgacagcccgcaccagauccuggauggggaaaauuguacacuuauugacgcccugcucggagauccccagugcgacggcuuucagaacaaaaagugggaucuguucgucgagcgguccaaagccuauucuaauuguuacccuuaugacgugcccgauuacgcuagccugcgcucccucguugccucuagcgggacccuggaauuuaacaaugaguccuucaacuggacgggagugacccaaaauggcacaagcucugcuugcaucagacgguccucuagcuccuuuuucagccgccuuaacuggcugacccaucucaauuauaaguacccugcccugaacgucacaaugcccaacaaugagcaguuugacaaacuuuauauuuggggcgugcaccauccugggaccgauaaggaccagaucuucccguacgcgcagucuuccggaagaauuaucguuagcacgaagcggucccaacaggccgugauccccaacauuggcucucgcccuagaauccgggauauucccagccgcaucuccauuuacuggacaaucgucaaaccuggggacauccugcucauuaauagcaccggaaaccugaucgcucccagaggcuauuuuaagauucggucugggaaauccagcaucaugcgcucugacgccccgauuggaaaguguaagagcgaaugcaucacaccuaauggcuccauccccaacgauaaaccuuuccagaaugugaacagaauuaccuacggcgcuuguccccgguaugugaagcacucuacccugaaacucgccacagggaugcgcaauguccccgagaagcagacgagaggaaucuuuggcgcgauugccggguucaucgaaaacggaugggagggcaugguugacgggugguacggauuucggcaccaaaauagcgagggcagaggccaggcugccgaucugaaauccacccaggcugccauugaccaaaucaacgggaaacuuaaucgccugauuggaaagacaaacgaaaaguuccaucagaucgagaaggaguucagcgaaguggaaggccggauccaggaucucgagaaauauguggaggacaccaagauugaucuguggucuuacaaugccgaacuucuggucgcucucgagaaccagcacacaaucgaccugaccgauuccgaaaugaacaaacuguuugagaagacgaaaaagcaacucagagaaaaugcggaggacauggggaacggaugcuucaagauuuaucauaaaugugauaaugccugcaucggcagcauucgcaacgggacauacgaccacaauguguaccgggacgaggcucugaacaauagauuucagaucaagggcguugaacuuaaaucuggauauaaggauuggauccuguggauuuccuucgccaucagcugcuuucuccuguguguggcccuucugggcuucauuaugugggcuugccagaaagggaacauccgcuguaauauuugcaucuga

SEQ ID NO: 196970 - RNA, 1701 nt, Artificial Sequence
  derived and/or modified sequence opt5 from hemagglutinin__InfluenzaA__EPI631887
augaagaccaucauugcccugagcuacauccucugccugguguucgcucagaaaauucccggcaacgacaauaacacagccacgcuuugucuggggcaccaugcggucccuaauggaaccaucguuaagacaauuaccaacgauagaaucgaggugacaaaugcuaccgaacucgugcaaaacuccucuaucggcgagauuugcgacagcccgcaccagauccuggauggggaaaauuguacacuuauugacgcccugcucggagauccccagugcgacggcuuucagaacaaaaagugggaucuguucgucgagcgguccaaagccuauucuaauuguuacccuuaugacgugcccgauuacgcuagccugcgcucccucguugccucuagcgggacccuggaauuuaacaaugaguccuucaacuggacgggagugacccaaaauggcacaagcucugcuugcaucagacgguccucuagcuccuuuuucagccgccuuaacuggcugacccaucucaauuauaaguacccugcccugaacgucacaaugcccaacaaugagcaguuugacaaacuuuauauuuggggcgugcaccauccugggaccgauaaggaccagaucuucccguacgcgcagucuuccggaagaauuaucguuagcacgaagcggucccaacaggccgugauccccaacauuggcucucgcccuagaauccgggauagccccucccgcauuagcaucuacuggacaauugucaaaccuggggacauccugcucaucaauucuaccggaaaccugauugcucccagaggcuauuuuaagauccgguccgggaaaagcucuauuaugcgcagcgacgccccgaucggaaaguguaaguccgaaugcauuacaccuaauggcucuauccccaacgauaaaccuuuccagaaugugaacagaaucaccuacggcgcuuguccccgguaugugaagcacagcacccugaaacucgccacagggaugcgcaauguccccgagaagcagacgagaggaauuuuuggcgcgaucgccggguucauugaaaacggaugggagggcaugguugacgggugguacggauuucggcaccaaaauuccgagggcagaggccaggcugccgaucugaaaagcacccaggcugccaucgaccaaauuaacgggaaacuuaaucgccugaucggaaagacaaacgaaaaguuccaucagauugagaaggaguucucugaaguggaaggccggauccaggaucucgagaaauauguggaggacaccaagaucgaucugugguccuacaaugccgaacuucuggucgcucucgagaaccagcacacaauugaccugaccgauagcgaaaugaacaaacuguuugagaagacgaaaaagcaacucagagaaaaugcggaggacauggggaacggaugcuucaagaucuaucauaaaugugauaaugccugcauuggcucuauccgcaacgggacauacgaccacaauguguaccgggacgaggcucugaacaauagauuucagauuaagggcguugaacuuaaauccggauauaaggauuggauccuguggaucagcuucgccauuuccugcuuucuccuguguguggcccuucugggcuucaucaugugggcuugccagaaagggaacauucgcuguaauaucugcauuuga

SEQ ID NO: 196971 - RNA, 1701 nt, Artificial Sequence
  derived and/or modified sequence opt5 from hemagglutinin__InfluenzaA__EPI577026
augaagaccaucauugcccugagcuacauccucugccugguguucgcucagaaaauucccggcaacgacaauaacacagccacgcuuugucuggggcaccaugcggucccuaauggaaccaucguuaagacaauuaccaacgauagaaucgaggugacaaaugcuaccgaacucgugcaaaacuccucuaucggcgagauuugcgacagcccgcaccagauccuggauggggaaaauuguacacuuauugacgcccugcucggagauccccagugcgacggcuuucagaacaaaaagugggaucuguucgucgagcgguccaaagccuauucuaauuguuacccuuaugacgugcccgauuacgcuagccugcgcucccucguugccucuagcgggacccuggaauuuaacaaugaguccuucaacuggacgggagugacccaaaauggcacaagcucugcuugcaucagacgguccucuagcuccuuuuucagccgccuuaacuggcugacccaucucaauuauaaguacccugcccugaacgucacaaugcccaacaaugagcaguuugacaaacuuuauauuuggggcgugcaccauccugggaccgauaaagaccagaucuucccguacgcgcagucuuccggaagaauuacgguuagcacaaagcggucccaacaggccgugauccccaacaucggcucucgcccucggauuagagggauccccagccgcauuuccaucuacuggaccauugucaaaccuggagauauccugcucaucaauagcacaggcaaccugauugcucccagaggguauuuuaagauccggucuggaaaauccagcauuaugcgcucugacgccccgaucggcaaguguaagagcgaaugcauuaccccuaauggcuccauccccaacgacaaaccuuuccagaaugugaacagaaucaccuacggggcuuguccccgguaugugaagcacucuacacugaaacucgccacgggaaugcgcaauguccccgagaagcagaccagaggcauuuuuggggcgaucgccggauucauugaaaacggcugggaggggaugguugauggaugguacggcuuucggcaccaaaauagcgagggcagagggcaggcugccgaccugaaauccacacaggcugccaucgaucaaauuaacggaaaacuuaaucgccugaucggcaagaccaacgaaaaguuccaucagauugagaaggaguucagcgaaguggaagggcggauccaggaccucgagaaauauguggaggauacaaagaucgaccuguggucuuacaaugccgaacuucuggucgcucucgagaaccagcacaccauugaucugacggacuccgaaaugaacaaacuguuugagaagacaaagaagcaacucagagaaaaugcggaggauaugggaaacggcugcuucaagaucuaucauaaaugugacaaugccugcauugagagcauccgcaacgggaccuacgaucacaauguguaccgggacgaagcucugaacaauagauuucagauuaagggcguugagcuuaaaucuggauauaaggacuggauccuguggaucuccuucgccauuagcugcuuucuccuguguguggcccuucugggcuucaucaugugggcuugccagaaagggaacauucgcuguaauaucugcauuuga

SEQ ID NO: 196972 - RNA, 1701 nt, Artificial Sequence; identical to SEQ ID NO: 193018
  derived and/or modified sequence opt5 from hemagglutinin__InfluenzaA__EPI404927

SEQ ID NO: 196973 - RNA, 1701 nt, Artificial Sequence
  derived and/or modified sequence opt5 from hemagglutinin__InfluenzaA__EPI489319
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcaagagaggcagcaauucuuccuuuuucagccggcugaacuggcucacacaucugaauuuuaaguauccugcgcuuaacgucaccaugcccaacaaugagcaguucgacaaacuguacauuuggggagugcaccauccugggacagauaaggaccagaucuuuccguaugcccagucuuccggccgcauuaccguuagcacgaaaagaucccaacaggcugugauccccaacauugggucucggccucgcaucagaaauauccccagccggauuuccaucuacuggacaauugucaagccuggagauauccuccugauuaacagcaccggcaaucugaucgcuccccgcggguacuucaaaaucagaucuggaaaguccagcauuaugcggucugacgccccgaucggcaaguguaaaagcgaaugcauuacaccuaacggcuccauccccaaugacaagccuuuucagaacgugaaucgcauuaccuauggggccugucccagauacgugaaacagucuacccucaagcuggcgacaggaaugcggaacguccccgagaaacaaacgcgcggcaucuucggggccaucgcuggauuuauugaaaauggcugggaggggaugguugauggaugguauggcuucagacaccagaacagcgagggccgggggcaggccgcugaccuuaaguccacccaagccgccaucgaucagauuaauggaaaacugaacagacucaucggcaagacaaaugaaaaguuccaccagauugagaaagaauuuagcgagguggaagggcgcauccaggaccuggagaaguacguggaggauaccaaaauugaccuuuggucuuauaacgcugaacugcucgucgcgcuggagaaccaacauacaaucgaucugaccgacuccgaaaugaauaaacucuucgagaagacgaagaagcagcugcgggaaaacgccgaggauaugggaaauggcugcuuuaaaaucuaccacaagugugacaacgcuugcauugggagcaucagaaauggcacauaugaucaugacguguaccgcgacgaggcccuuaacaaucgguuccagauuaaaggaguugaacugaagucuggcuacaaagauuggauccucuggauuuccuuugccaucagcugcuuccugcuuuguguggcucugcucggguuuaucaugugggccugccagaagggaaacauuagauguaauaucugcauuuga

SEQ ID NO: 196974 - RNA, 1701 nt, Artificial Sequence; identical to SEQ ID NO: 195451
  derived and/or modified sequence opt5 from hemagglutinin__InfluenzaA__EPI530647

SEQ ID NO: 196975 - RNA, 1701 nt, Artificial Sequence; identical to SEQ ID NO: 195465
  derived and/or modified sequence opt5 from hemagglutinin__InfluenzaA__EPI541083

SEQ ID NO: 196976 - RNA, 1701 nt, Artificial Sequence
  derived and/or modified sequence opt5 from hemagglutinin__InfluenzaA__EPI684315
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggucuagcuccagcuuuuucucucgccuuaauuggcugacccaucucaacuauaaguacccugcccugaaugucacaaugcccaacaacgagcaguuugacaaacuuuauauuuggggcgugcaccauccugggaccgauaaggaccagaucuucccguacgcgcaguccagcggaagaauuaucguuuccacgaagcggucucaacaggccgugauccccaauauuggcagccgcccuagaauccgggauauucccucccgcaucagcauuuacuggacaaucgucaaaccuggggacauccugcucauuaacucuaccggaaaucugaucgcucccagaggcuauuuuaagauucgguccgggaaaagcucuaucaugcgcagcgacgccccgauuggaaaguguaaguccgaaugcaucacaccuaacggcucuauccccaaugauaaaccuuuccagaacgugaauagaauuaccuacggcgcuuguccccgguaugugaagcacagcacccugaaacucgccacagggaugcgcaacguccccgagaagcagacgagaggaaucuuuggcgcgauugccggguucaucgaaaauggaugggagggcaugguugacgggugguacggauuucggcaccaaaacuccgagggcagaggccaggcugccgaucugaaaagcacccaggcugccauugaccaaaucaaugggaaacuuaaccgccugauuggaaagacaaaugaaaaguuccaucagaucgagaaggaguucucugaaguggaaggccggauccaggaucucgagaaauauguggaggacaccaagauugaucugugguccuacaacgccgaacuucuggucgcucucgagaaucagcacacaaucgaccugaccgauagcgaaaugaacaaacuguuugagaagacgaaaaagcaacucagagaaaacgcggaggacauggggaauggaugcuucaagauuuaucauaaaugugauaacgccugcaucggcucuauucgcaaugggacauacgaccacaacguguaccgggacgaggcucugaauaacagauuucagaucaagggcguugaacuuaaauccggauauaaggauuggauccuguggauuagcuucgccaucuccugcuuucuccuguguguggcccuucugggcuucauuaugugggcuugccagaaagggaauauccgcuguaacauuugcaucuga

SEQ ID NO: 196977 - RNA, 1701 nt, Artificial Sequence
  derived and/or modified sequence opt5 from hemagglutinin__InfluenzaA__EPI614462
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccagcugcauuagaggcucuaauuccagcuuuuucucucggcugaacuggcucacacaucuuaauuccaaguauccugcccuuaacgucaccaugcccaacaaugagcaguuugacaagcuguacaucuggggagugcaccauccugggacagauaaagaccagauuuuccucuaugcgcagagcuccggccgcaucaccguuucuacgagacggagccaacaggccgugauuccgaacaucgggucccgccccagaauccgggauauuccuagccgcaucucuauuuacuggacaaucgucaagcccggagacauucugcugaucaauuccaccggcaaccucaucgcuccuagaggguacuuuaaaauucggagcggaaagucuagcaucaugcgcuccgacgcccccauuggcaaauguaagucugaaugcaucacaccgaauggcagcauuccuaacgauaagcccuuccagaaugugaacagaaucaccuauggggcuuguccucgguacgugaaacaguccacccugaagcuggccacaggaaugcgcaauguccccgagagacaaacgcggggcaucuuuggggcgauugccggauucaucgaaaacggcugggaggggaugguugacggaugguauggcuuuagacaccagaauagcgagggccgcgggcaggcugccgaucugaaaucuacccaagcugccauugaccagaucaacggaaagcucaaucggcugauuggcaaaacaaacgaaaaguuccaccagaucgagaaagaguucuccgaaguggaagggcgcauucaggaucuugagaaguacguggaggacaccaagaucgaucuguggagcuauaaugccgaacuccuggucgcucuggagaaccaacauacaaucgaccucaccgauucugaaaugaacaaacuguuugagaagacgaaaaagcagcuuagagaaaaugcggaggacaugggaaacggcugcuucaaaauuuaccacaagugugauaaugccugcaucggguccauucggaacggcacauaugaccaugacguguacagagaugaggcucugaauaaccgcuuucagaucaagggaguugaacucaaaagcggcuacaaggacuggauucuguggaucuccuucgccaucucuugcuuucuucuguguguggcccuccugggguucauuaugugggcuugccagaaaggaaauauccgguguaacauuugcaucuga

SEQ ID NO: 196978 - RNA, 1701 nt, Artificial Sequence
  derived and/or modified sequence opt5 from hemagglutinin__InfluenzaA__EPI541465
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccagcugcauuagaggcucuaauaacuccuuuuucagccggcugaauuggcucacacaucugaacucuaaguauccugcccuuaacgucaccaugcccaauaacgagcaguuugacaagcuguacaucuggggagugcaccauccuggaacagauaaagaccagauuuuccucuaugcgcaguccagcggccgcaucaccguuuccacgagacggucucaacaggccgugauuccgaauaucgggagccgccccagaauccgggggauuccuucccgcaucagcauuuacuggacaaucgucaagcccggcgauauucugcugaucaacucuaccgggaaucucaucgcuccuagaggauacuuuaaaauucgguccggcaagagcucuaucaugcgcagcgacgcccccauuggcaaauguaaguccgaaugcaucacaccgaacgggucuauuccuaaugacaagcccuuccagaacgugaauagaaucaccuauggagcuuguccucgguacgugaaacagagcacccugaagcuggccacaggcaugcgcaacguccccgagagacaaacgcgggggaucuuuggagcgauugccggcuucaucgaaaaugggugggagggaaugguugauggcugguauggcuuuagacaccagaacuccgaggggcgcggacaggcugccgaccuuaaaagcacccaagcugccauugaucagaucaauggcaagcucaaccggcugauugggaaaacaaaugaaaaguuccaccagaucgagaaagaguucucugaaguggaaggacgcauucaggaccuugagaaguacguggaggauaccaagaucgaccugugguccuauaacgccgaacuccuggucgcucuggagaaccaacauacaaucgaucucaccgacagcgaaaugaauaaacuguuugagaagacgaaaaagcagcuuagagaaaacgcggaggauaugggcaaugggugcuucaaaauuuaccacaagugugacaacgccugcaucggcucuauucggaauggaacauaugaucaugacguguacagagacgaggcucugaacaaucgcuuucagaucaagggcguugaacucaaauccggguacaaggauuggauucuguggaucagcuucgccaucuccugcuuucuucuguguguggcccuccugggauucauuaugugggcuugccagaaaggcaacauccgguguaauauuugcaucuga

SEQ ID NO: 196979 - RNA, 1701 nt, Artificial Sequence
  derived and/or modified sequence opt5 from hemagglutinin__InfluenzaA__EPI696967
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccagcugcauuagaggcucuaauuccagcuuuuucucucggcugaacuggcucacacgccuuaauuccaaguauccugcccuuaacgucaccaugcccaacaaugagcaguuugacaagcuguacaucuggggagugcaucacccugaaacagauaaagaccagauuuuccucuaugcgcagagcuccgggagaaucaccguuucuacgcggcgcagccaacaggccgugauuccgaacaucggcuccagaccccggauccgcgggauuccuagcagaaucucuauuuacuggacaaucgucaagcccggagauauucugcugaucaauuccaccggcaaccucaucgcuccucggggguacuuuaaaauucgcagcggaaagucuagcaucaugagauccgacgcccccauuggcaaauguaagucugagugcaucacaccgaauggcagcauuccuaacgacaagcccuuccagaaugugaaccggaucaccuauggggcuuguccucgcuacgugaaacaguccacccugaagcuggccacaggaaugagaaauguccccgaacggcaaacgagaggcaucuuuggggcgauugccggauucaucgagaacggcugggaggggaugguugauggaugguauggcuuucgccaucagaauagcgaaggccgggggcaggcugccgaccugaaaucuacccaagcugccauugaucagaucaacggaaagcucaauagacugauuggcaaaacaaacgagaaguuccaccagaucgaaaaagaguucuccgaaguggaggggcgcauucaggaccuugagaaguacguggaagauaccaagaucgaccuguggagcuauaaugccgagcuccuggucgcucuggaaaaccaacacacaaucgaucucaccgacucugagaugaacaaacuguuugaaaagacgaaaaagcagcuucgggagaaugcggaggauaugggaaacggcugcuucaaaauuuaccauaagugugacaaugccugcaucggguccauuagaaacggcacauaugaucacgacguguaccgcgacgaagcucugaauaaccgguuucagaucaagggaguugagcucaaaagcggcuacaaggauuggauucuguggaucuccuucgccaucucuugcuuucuucuguguguggcccuccugggguucauuaugugggcuugccagaaaggaaauaucagauguaacauuugcaucuga

SEQ ID NO: 196980 - RNA, 1701 nt, Artificial Sequence
  derived and/or modified sequence opt5 from hemagglutinin__InfluenzaA__EPI674597
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccagcugcauuagaggcucuaauaacuccuuuuucagccggcugaauuggcucacacaucugaacucuaaguauccugcccuuaacgucaccaugcccaauaacgagcaguuugacaagcuguacaucuggggagugcaccauccuguuacagauaaagaccagauuuuccucuaugcgcaguccagcgggcgcaucaccguguccacgagacggucucaacaggccgucauuccgaauaucggcagccgccccagaauccgggggauuccuucccgcaucagcauuuacuggacaaucgugaagcccggagauauucugcugaucaacucuaccggcaaucucaucgcuccuagaggguacuuuaaaauucgguccggaaagagcucuaucaugcgcagcgacgcccccauuggcaaauguaaguccgaaugcaucacaccgaacggcucuauuccuaaugacaagcccuuccagaacgugaauagaaucaccuauggggcuuguccucgguacgucaaacagagcacccugaagcuggccacaggaaugcgcaacguucccgagagacaaacgcggggcaucuuuggggcgauugccggauucaucgaaaauggcugggaggggaugguggauggaugguauggcuuuagacaccagaacuccgagggccgcgggcaggcugccgaccuuaaaagcacccaagcugccauugaucagaucaauggaaagcucaaccggcugauuggcaaaacaaaugaaaaguuccaccagaucgagaaagaguucucugaaguggaagggcgcauucaggaccuugagaaguacgucgaggauaccaagaucgaccugugguccuauaacgccgaacuccugguggcucuggagaaccaacauacaaucgaucucaccgacagcgaaaugaauaaacuguuugagaagacgaaaaagcagcuuagagaaaacgcggaggauaugggaaauggcugcuucaaaauuuaccacaagugugacaacgccugcaucgggucuauucggaauggcacauaugaucaugacguuuacagagacgaggcucugaacaaucgcuuucagaucaagggaguggaacucaaauccggcuacaaggauuggauucuguggaucagcuucgccaucuccugcuuucuucugugugucgcccuccugggguucauuaugugggcuugccagaaaggaaacauccgguguaauauuugcaucuga

SEQ ID NO: 196981 - RNA, 1701 nt, Artificial Sequence
  derived and/or modified sequence opt5 from hemagglutinin__InfluenzaA__EPI530677
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccagcugcauuagaggcucuaauuccagcuuuuucucucggcugaacuggcucacacaucuuaauuccaaguauccugcccugaacgucaccaugcccaacaaugagcaguuugacaagcuguacaucuggggagugcaccauccugggacagauaaagaccagauuuuccucuaugcgcagagcuccggccgcaucaccguuucuacgaagagaagccaacaggccgugauuccgaacaucgggucccggccccgcaucagagauauuccuagccggaucucuauuuacuggacaaucgucaaacccggagacauucugcugaucaauuccaccggcaaccucaucgcuccucgcggguacuuuaagauuagaagcggaaaaucuagcaucaugcgguccgacgcccccauuggcaaguguaagucugaaugcaucacaccgaauggcagcauuccuaacgauaaacccuuccagaaugugaaccgcaucaccuauggggcuuguccuagauacgugaagcaguccacccugaaacuugccacaggaaugcggaauguccccgagaagcaaacgcgcggcaucuuuggggcgauugccggauucaucgaaaacggcugggaggggaugguugacggaugguauggcuuuagacaccagaauagcgagggccgggggcaggcugccgaucugaaaucuacccaagcugccauugaccagaucaacggaaagcucaauagacugauuggcaaaacaaacgaaaaguuccaccagaucgagaaggaguucuccgaaguggaagggcgcauucaggaucuugagaaauacguggaggacaccaagaucgaucuguggagcuauaaugccgaacuccuggucgcucuggagaaccaacauacaaucgaccucaccgauucugaaaugaacaaacuguuugagaagacgaaaaagcagcuucgggaaaaugcggaggacaugggaaacggcugcuucaagauuuaccacaaaugugauaaugccugcaucggguccauuagaaacggcacauaugaccaugacguguaccgcgaugaggcucugaauaaccgguuucagaucaagggaguugaacucaaaagcggcuacaaggacuggauucuguggaucuccuucgccaucucuugcuuucuucuguguguggcccuccugggguucauuaugugggcuugccagaaaggaaauaucagauguaacauuugcaucuga

SEQ ID NO: 196982 - RNA, 1701 nt, Artificial Sequence
  derived and/or modified sequence opt5 from hemagglutinin__InfluenzaA__EPI530679
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccagcugcauuagaggcucuaauuccagcuuuuucucucggcugaacuggcucacacaucugaauuuuaaguauccugcccuuaacgucaccaugcccaacaaugagcaguucgacaagcuguacaucuggggagugcaccauccugggacagauaaagaccagauuuuucucuaugcgcaguccagcggccgcaucaccguuuccacgaagagaucucaacaggccgugauuccgaacaucgggagccggccccgcaucagagauauuccuucccggaucagcauuuacuggacaaucgucaaacccggagacauucugcugaucaauucuaccggcaaccucaucgcuccucgcggguacuucaagauuagauccggaaaaagcucuaucaugcggagcgacgcccccauuggcaaguguaaguccgaaugcaucacaccgaauggcucuauuccuaacgauaaacccuuucagaaugugaaccgcaucaccuauggggcuuguccuagauacgugaagcagagcacccugaaacuugccacaggaaugcggaauguccccgagaagcaaacgcgcggcaucuucggggcgauugccggauuuaucgaaaacggcugggaggggaugguugacggaugguauggcuucagacaccaaaauuccgagggccgggggcaggcugccgaucugaaaagcacccaggcugccauugaccagaucaacggaaagcucaauagacugauuggcaaaacaaacgaaaaguuccaccagaucgagaaggaauuuucugagguggaagggcgcauucaggaucuugagaaauacguggaggacaccaagaucgaucugugguccuauaaugccgaacuccuggucgcucuggagaaccaacauacaaucgaccucaccgauagcgaaaugaacaaacuguucgagaagacgaaaaagcagcuucgggaaaaugcggaggacaugggaaacggcugcuuuaagauuuaccacaaaugugauaaugccugcaucgggucuauuagaaacggcacauaugaccaugacguguaccgcgaugaggcucugaauaaccgguuccagaucaagggaguugaacucaaauccggcuacaaggacuggauucuguggaucagcuuugccaucuccugcuuccuucuguguguggcccuccugggguuuauuaugugggcuugccagaaaggaaauaucagauguaacauuugcaucuga

SEQ ID NO: 196983 - RNA, 1701 nt, Artificial Sequence; identical to SEQ ID NO: 183046
  derived and/or modified sequence opt5 from hemagglutinin__InfluenzaA__AAG01785

SEQ ID NO: 196984 - RNA, 1701 nt, Artificial Sequence; identical to SEQ ID NO: 195451
  derived and/or modified sequence opt5 from hemagglutinin__InfluenzaA__EPI814528

SEQ ID NO: 196985 - RNA, 1701 nt, Artificial Sequence
  derived and/or modified sequence opt5 from hemagglutinin__InfluenzaA__EPI674736
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccagcugcagacggggcucuaauuccagcuuuuucucucgccugaacuggcucacacaucuuaauuccaaguauccugcccugaacgucaccaugcccaacaaugagcaguuugacaagcuguacauuuggggagugcaccauccuguuacagauaaagaccagaucuuccucuaugcgcagagcuccgggagaauuaccgugucuacgaagcggagccaacaggccgucaucccgaacauuggcucccgccccagaauccgggauaucccuagccgcauuucuaucuacuggacaauugugaaacccggggacauccugcugauuaauuccaccggaaaccucaucgcuccuagaggcuacuuuaagauccggagcgggaaaucuagcauuaugcgcuccgacgcccccaucggaaaguguaagucugaaugcauuacaccgaauggcagcaucccuaacgauaaacccuuccagaaugugaacagaauuaccuauggcgcuuguccucgguacgucaagcaguccacccugaaacuugccacagggaugcgcaauguucccgagagacaaacgcggggaaucuuuggcgcgaucgccggguucauugaaaacggaugggagggcaugguggacgggugguauggauuuagacaccagaauagcgagggccgcggccaggcugccgaucugaagucuacccaagcugccaucgaccagauuaacgggaaacucaaucggcugaucggaaagacaaacgaaaaauuccaccagauugagaaggaguucuccgaaguggaaggcagaauccaggaucuugagaaguacgucgaggacaccaaaauugaucuguggagcuauaaugccgaacuccugguggcucuggagaaccaacauacaaucgaccucaccgauucugaaaugaacaagcuguuugagaaaacgaagaaacagcuucgcgaaaaugcggaggacauggggaacggaugcuucaagaucuaccacaagugugauaaugccugcauuggcuccauccggaacgggacauaugaccaugacguuuacagagaugaggcucugaauaaccgcuuucagauuaaaggcguggaacucaagagcggauacaaagacuggauccuguggauuuccuucgccaucucuugcuuucuucugugugucgcccuccugggcuucaucaugugggcuugccagaaggggaauauucgguguaacaucugcauuuga

SEQ ID NO: 196986 - RNA, 1701 nt, Artificial Sequence; identical to SEQ ID NO: 195451
  derived and/or modified sequence opt5 from hemagglutinin__InfluenzaA__EPI614444

SEQ ID NO: 196987 - RNA, 1701 nt, Artificial Sequence
  derived and/or modified sequence opt5 from hemagglutinin__InfluenzaA__EPI551814
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccagcugcagacggggcucuaauuccagcuuuuucucucgccugaacuggcucacaagacuuaauuccaaguauccugcccugaacgucaccaugcccaacaaugagcaguuugacaagcuguacauuuggggagugcaucacccuguuacagauaaagaccagaucuuccucuaugcgcagagcuccgggcggauuaccgugucuacgaagcgcagccaacaggccgucaucccgaacauuggcuccagaccccggauccgcgauaucccuagcagaauuucuaucuacuggacaauugugaaacccggggacauccugcugauuaauuccaccggaaaccucaucgcuccucggggcuacuuuaagauccgcagcgggaaaucuagcauuaugagauccgacgcccccaucggaaaguguaagucugaaugcauuacaccgaauggcagcaucccuaacgauaaacccuuccagaaugugaaccggauuaccuauggcgcuuguccucgcuacgucaagcaguccacccugaaacuugccacagggaugagaaauguucccgagcggcaaacgagaggaaucuuuggcgcgaucgccggguucauugaaaacggaugggagggcaugguggacgggugguauggauuucgccaucagaauagcgagggccggggccaggcugccgaucugaagucuacccaagcugccaucgaccagauuaacgggaaacucaauagacugaucggaaagacaaacgaaaaauuccaccagauugagaaggaguucuccgaaguggaaggccgcauccaggaucuugagaaguacgucgaggacaccaaaauugaucuguggagcuauaaugccgaacuccugguggcucuggagaaccaacacacaaucgaccucaccgauucugaaaugaacaagcuguuugagaaaacgaagaaacagcuucgggaaaaugcggaggacauggggaacggaugcuucaagaucuaccauaagugugauaaugccugcauuggcuccaucagaaacgggacauaugaccacgacguuuaccgcgaugaggcucugaauaaccgguuucagauuaaaggcguggaacucaagagcggauacaaagacuggauccuguggauuuccuucgccaucucuugcuuucuucugugugucgcccuccugggcuucaucaugugggcuugccagaaggggaauauuagauguaacaucugcauuuga

SEQ ID NO: 196988 - RNA, 1701 nt, Artificial Sequence
  derived and/or modified sequence opt5 from hemagglutinin__InfluenzaA__EPI696955
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccagcugcagacggggcucuaauuccagcuuuuucucucgccugaacuggcucacacaucugaauagcaaguauccugcccuuaacgucaccaugcccaacaaugagcaguuugacaagcuguacauuuggggagugcaccauccuguuacagauaaagaccagaucuuccucuaugcgcagagcuccgggagaauuaccgugucuacgaagcggagccaacaggccgucaucccgaacauuggcuaccgccccagaauccgggauaucccuucccgcauuagcaucuacuggacaauugugaaacccggggacauccugcugauuaauucuaccggaaaccucaucgcuccuagaggcuauuuuaagauccgguccgggaaaagcucuauuaugcgcagcgacgcccccaucggaaaguguaaguccgaaugcauuacaccgaauggcucuaucccuaacgauaaacccuuccagaaugugaacagaauuaccuacggcgcuuguccucgguaugucaagcagagcacccugaaacuugccacagggaugcgcaauguucccgagagacaaacgcggggaaucuuuggcgcgaucgccggguucauugaaaacggaugggagggcaugguggacgggugguacggauuuagacaccaaaauuccgagggccgcggccaggcugccgaucugaaguccacccaggcugccaucgaccagauuaacgggaaacucaaucggcugaucggaaagacaaacgaaaaauuccaccagauugagaaggaguucucugaaguggaaggcagaauccaggaucuugagaaguaugucgaggacaccaaaauugaucugugguccuacaaugccgaacuccugguggcucuggagaaccaacauacaaucgaccucaccgauagcgaaaugaacaagcuguuugagaaaacgaagaaacagcuucgcgaaaaugcggaggacauggggaacggaugcuucaagaucuaucacaagugugauaaugccugcauuggcucuauccggaacgggacauacgaccaugacguuuacagagaugaggcucugaauaaccgcuuucagauuaaaggcguggaacucaaguccggauauaaagacuggauccuguggauuagcuucgccaucuccugcuuucuucugugugucgcccuccugggcuucaucaugugggcuugccagaaggggaauauucgguguaacaucugcauuuga

SEQ ID NO: 196989 - RNA, 1701 nt, Artificial Sequence
  derived and/or modified sequence opt5 from hemagglutinin__InfluenzaA__EPI740790
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccagcugcagacggggcucuaauuccagcuuuuucucucgccugaacuggcucacacaucugaauagcaaguauccugcccuuaacgucaccaugcccaacaaugagcaguuugacaagcuguacauuuggggagugcaccauccuguuacagauaaagaccagaucuuccucuaugcgcagagcuccgggagaauuaccgugucuacgaagcggagccaacaggccgucaucccgaacauuggcuuucgccccagaauccgggauaucccuucccgcauuagcaucuacuggacaauugugaaacccggggacauccugcugauuaauucuaccggaaaccucaucgcuccuagaggcuacuucaagauccgguccgggaaaagcucuauuaugcgcagcgacgcccccaucggaaaguguaaguccgaaugcauuacaccgaauggcucuaucccuaacgauaaacccuuucagaaugugaacagaauuaccuauggcgcuuguccucgguacgucaagcagagcacccugaaacuugccacagggaugcgcaauguucccgagagacaaacgcggggaaucuucggcgcgaucgccggguuuauugaaaacggaugggagggcaugguggacgggugguauggauucagacaccaaaauuccgagggccgcggccaggcugccgaucugaaguccacccaggcugccaucgaccagauuaacgggaaacucaaucggcugaucggaaagacaaacgaaaaauuccaccagauugagaaggaauuuucugagguggaaggcagaauccaggaucuugagaaguacgucgaggacaccaaaauugaucugugguccuauaaugccgaacuccugguggcucuggagaaccaacauacaaucgaccucaccgauagcgaaaugaacaagcuguucgagaaaacgaagaaacagcuucgcgaaaaugcggaggacauggggaacggaugcuuuaagaucuaccacaagugugauaaugccugcauuggcucuauccggaacgggacauaugaccaugacguuuacagagaugaggcucugaauaaccgcuuccagauuaaaggcguggaacucaaguccggauacaaagacuggauccuguggauuagcuuugccaucuccugcuuccuucugugugucgcccuccugggcuuuaucaugugggcuugccagaaggggaauauucgguguaacaucugcauuuga

SEQ ID NO: 196990 - RNA, 1701 nt, Artificial Sequence; identical to SEQ ID NO: 191733
  derived and/or modified sequence opt5 from hemagglutinin__InfluenzaA__EPI377499

SEQ ID NO: 196991 - RNA, 1701 nt, Artificial Sequence
  derived and/or modified sequence opt5 from hemagglutinin__InfluenzaA__EPI391247
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggaacggagugacgcaaaauggcaccucuuccgcuugcauuagacggagcaacaauucuuucuucucccgccugaacuggcucacacaucugaacuuuaaguauccugcccuuaaugucaccaugcccaacaaugagcaguucgacaagcuguacaucuggggcgugcaccauccuguuacagauaaagaccagauuuuucucuaugcgcagccgagcgggagaaucaccgugucuacgaagcggucccaacaggccgucauucccaacaucggauuccgcccuagaauccggaauauucccagccgcaucuccauuuacuggacaaucgugaaaccuggcgauauucugcugaucaacucuaccgggaaucucaucgcucccagaggauacuuuaagauucggagcggcaaauccagcaucaugcgcucugacgccccgauugggaaguguaaguccgaaugcaucacaccuaacggaagcauucccaaugacaaaccuuuccagaacgugaauagaaucaccuauggcgcuuguccccgguacgucaagcagucuacccugaaacuugccacaggcaugcgcaacguucccgagaagcaaacgagagggaucuuuggagcgauugccggcuucaucgaaaaugggugggagggaaugguggauggcugguauggguuccggcaccagaacagcgagggaagaggccaggcugccgaccugaaauccacccaagcugccauugaucagaucaauggcaagcucaaccgccugauugggaaaacaaacgaaaaguuucaccagaucgagaaggaauuuucugagguggaaggacggauucaggaccuugagaaauacgucgaggauaccaagaucgaccuguggagcuauaaugccgaacuccugguggcucuggagaaccaacauacaaucgaucucaccgacuccgaaaugaauaaacuguuugagaagacgaaaaagcagcuuagagaaaacgcggaggauaugggcaaugggugcuucaagauuuaccacaaaugugacaacgccugcaucggaagcauucgcaauggcacauaugaucaugacguuuaccgggacgaggcucugaacaauagauuucagaucaaggggguggaacucaaaucuggcuacaaggauuggauucuguggaucuccuucgccaucagcugcuuucuucugugugucgcccuccugggauucauuaugugggcuugccagaaaggcaacauccgcuguaauauuugcaucuga

SEQ ID NO: 196992 - RNA, 1701 nt, Artificial Sequence
  derived and/or modified sequence opt5 from hemagglutinin__InfluenzaA__EPI407123
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggaacggagugacgcaaaauggcaccucuuccgcuugcauuagacggagcaacaauuccuuuuucucucgccugaacuggcucacacaucugaacuuuaaguauccugcccuuaaugucaccaugcccaacaaugagcaguucgacaagcuguacaucuggggcgugcaccauccuguuacagauaaagaccagauuuuucucuaugcgcagccgagcgggagaaucaccgugucuacgaagcggucccaacaggccgucauucccaacaucggauuccgcccuagaauccggaauaaccccagccgcauuuccaucuacuggacaauugugaaaccuggcgauauccugcugauuaauucuaccgggaaccucaucgcucccagaggauacuuuaagauccggagcggcaaauccagcauuaugcgcucugacgccccgaucgggaaguguaaguccgaaugcauuacaccuaauggaagcauccccaacgacaaaccuuuccagaaugugaacagaauuaccuauggcgcuuguccccgguacgucaagcagucuacccugaaacuugccacaggcaugcgcaauguucccgagaagcaaacgagagggaucuuuggagcgaucgccggcuucauugaaaacgggugggagggaaugguggauggcugguauggguuccggcaccagaauagcgagggaagaggccaggcugccgaccugaaauccacccaagcugccaucgaucagauuaacggcaagcucaaccgccugaucggggaaacaaaugagaaauuucaccagauugaaaaggaguucucugaaguggagggacggauccaggaccuugagaaguacgucgaagauaccaaaauugaccuguggagcuauaacgccgagcuccugguggcucuggaaaaucaacauacaaucgaucucaccgacuccgagaugaacaagcuguuugagaaaacgaagaaacagcuuagagaaaaugcggaggauaugggcaacgggugcuucaagaucuaccacaagugugacaaugccugcauuggaagcauccgcaacggcacauaugaucaugacguuuaccgggacgaagcucugaauaacagauuucagauuaaagggguggagcucaagucuggcuacaaagauuggauccuguggauuuccuucgccaucagcugcuuucuucugugugucgcccuccugggauucaucaugugggcuugccagaagggcaauauucgcuguaacaucugcauuuga

SEQ ID NO: 196993 - RNA, 1701 nt, Artificial Sequence
  derived and/or modified sequence opt5 from hemagglutinin__InfluenzaA__EPI407126
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggaacggagugacgcaaaauggcaccucuuccgcuugcauuagacggagcaacaauucuuucuucucccgccugaacuggcucacacaucugaacuuuaaguauccugcccuuaaugucaccaugcccaacaaugagcaguucgacaagcuguacaucuggggcgugcaccauccuguuacagauaaagaccagauuuuucucuaugcgcagccgagcgggagaaucaccgugucuacgaagcggucccaacaggccgucauucccaacaucggauuccgcccuagaauccggaauaaccccagccgcauuuccaucuacuggacaauugugaaaccuggcgauauccugcugauuaauucuaccgggaaccucaucgcucccagaggauacuuuaagauccggagcggcaaauccagcauuaugcgcucugacgccccgaucgggaaguguaaguccgaaugcauuacaccuaauggaagcauccccaacgacaaaccuuuccagaaugugaacagaauuaccuauggcgcuuguccccgguacgucaagcagucuacccugaaacuugccacaggcaugcgcaauguucccgagaagcaaacgagagggaucuuuggagcgaucgccggcuucauugaaaacgggugggagggaaugguggauggcugguauggguuccggcaccagaauagcgagggaagaggccaggcugccgaccugaaauccacccaagcugccaucgaucagauuaacggcaagcucaaccgccugaucgggaaaacaaaugaaaaguuucaccagauugagaaggaauuuucugagguggaaggacggauccaggaccuugagaaauacgucgaggauaccaagauugaccuguggagcuauaacgccgaacuccugguggcucuggagaaucaacauacaaucgaucucaccgacuccgaaaugaacaaacuguuugagaagacgaaaaagcagcuuagagaaaaugcggaggauaugggcaacgggugcuucaagaucuaccacaaaugugacaaugccugcauuggaagcauccgcaacggcacauaugaucaugacguuuaccgggacgaggcucugaauaacagauuucagauuaaggggguggaacucaaaucuggcuacaaggauuggauccuguggauuuccuucgccaucagcugcuuucuucugugugucgcccuccugggauucaucaugugggcuugccagaaaggcaauauucgcuguaacaucugcauuuga

SEQ ID NO: 196994 - RNA, 1701 nt, Artificial Sequence; identical to SEQ ID NO: 196879
  derived and/or modified sequence opt5 from hemagglutinin__InfluenzaA__EPI562037

SEQ ID NO: 196995 - RNA, 1701 nt, Artificial Sequence; identical to SEQ ID NO: 195465
  derived and/or modified sequence opt5 from hemagglutinin__InfluenzaA__EPI562034

SEQ ID NO: 196996 - RNA, 1701 nt, Artificial Sequence
  derived and/or modified sequence opt5 from hemagglutinin__InfluenzaA__EPI653140
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcuccuguuacccuuaugacgugcccgauuacgcuucucugcgcagccucguugccuccagcgggacccuggaauuuaacaaugagucuuucaacuggacgggagugacccaaaauggcacauccagcgcuugcaucagacggucuuccagcucuuucuucucccgccuuaacuggcugacccaucucaauuauaaguacccugcccugaacgucacaaugcccaauaacgagcaguuugacaaacuuuauauuuggggcgugcaccauccugggaccgauaaagaccagaucuucccguacgcgcagagcuccggaagaauuacgguuucuacaaagcggagccaacaggccgugauccccaacaucggcucccgcccucggauuagagggauccccagccgcauuucuaucuacuggaccauugucaaaccuggagauauccugcucaucaauuccacaggcaaccugauugcucccagaggguauuuuaagauccggagcggaaaaucuagcauuaugcgcuccgacgccccgaucggcaaguguaagucugaaugcauuaccccuaauggcagcauccccaacgacaaaccuuuccagaaugugaacagaaucaccuacggggcuuguccccgguaugugaagcacuccacacugaaacucgccacgggaaugcgcaauguccccgagaagcagaccagaggcauuuuuggggcgaucgccggauucauugaaaacggcugggaggggaugguugauggaugguacggcuuucggcaccaaaauagcgagggcagagggcaggcugccgaccugaaaucuacacaggcugccaucgaucaaauuaacggaaaacuuaaucgccugaucggcaagaccaacgaaaaguuccaucagauugagaaggaauuuuccgagguggaagggcggauccaggaccucgagaaauauguggaggauacaaagaucgaccuguggagcuacaaugccgaacuucuggucgcucucgagaaccagcacaccauugaucugacggacucugaaaugaauaaacuguuugagaagacaaagaagcaacucagagaaaacgcggaggauaugggaaacggcugcuucaagaucuaucauaaaugugacaaugccugcauuggguccauccgcaacggcaccuacgaucacaauguguaccgggacgaggcucugaacaauagauuucagauuaagggaguugaacuuaaaagcggcuauaaggacuggauccuguggaucuccuucgccauuucuugcuuucuccuguguguggcccuucugggguucaucaugugggcuugccagaaaggaaacauucgcuguaauaucugcauuuga

SEQ ID NO: 196997 - RNA, 1707 nt, Artificial Sequence
  derived and/or modified sequence opt5 from hemagglutinin__InfluenzaA__ACR48873/m
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugagaaaacacacaaugggaagcugugugaucucgacggagugaaaccccugauccuuagagauugcagcguugcgggcuggcugcucgggaacccuaugugugacgaguuuaucaaugugccggaaugguccuauauugucgagaaggcuaaccccgugaaugaucugugcuacccuggagacuucaacgauuaugaggaacugaagcaucuccugucucggaucaaucacuuugagaaaauucagaucauucccaagagcuccuggucuagccaugaagccucccuuggcguuagcucugccuguccuuaccaggggaaauccagcuucuuucgcaacguggucuggcugaucgagaaaaauucuaccuaucccacaauuaagagauccuacaacaauaccaaccaagaggaccuccuggugcuuuggggaauccaccacccuaaugaugcugccgaacagacaaagcuguaucagaacccgaccacguacaucagcgugggcaccucuacacucaaccagcggcuggucccccgcauugcuaccagauccaagguuaauggccaaagcgggcggauggaguucuuuuggacaauccugaaaccuaacgacgccauuaauuucgaauccaacggaaauuuuaucgcgcccgaguacgccuauaagauugugaaaaagggcgauucuaccaucaugaaaagcgaacucgaguacgggaacugcaauacgaagugucagacaccuaugggagcuaucaacuccagcaugcccuuccauaauauucacccgcugaccaucggcgagugcccuaaauaugugaagucuaaccgccuuguccuggccacagggcucagaaauagcccccagcgggaacgcagacggaagaaacgcggacuguuuggcgcuauugccggcuucaucgaagggggauggcagggcaugguggacgggugguacggauaucaucacuccaacgaacaaggcucuggguacgcggccgacaaggagagcacccagaaagcuauugauggaguuaccaauaaggugaacuccaucaucgacaaaaugaauacacaguuugaagccgucggcagagaguucaacaaccuugagcggcgcauugaaaaucugaacaagaagauggaggauggcuuccucgacguguggacguauaaugcugaacugcugguucucauggagaacgaaagaacccuggauuuucacgacucuaaugugaaaaaccuuuacgauaagguccggcugcaacucagagacaaugccaaagagcuggggaacggauguuucgaguuuuaccauaagugcgauaaugaauguauggagagcgugcgcaacggcacauaugacuacccucaguauuccgaagaggcccggcuuaaaagagaggaaaucagcggggucaagcuggagucuauuggaaucuaccagauucucuccaucuauagcaccguggcuucuucccuggcgcuggccauuaugguugcuggccucagccuguggaugugcuccaaugggucucuucagugccgcaucuguaucuga

SEQ ID NO: 196998 - RNA, 1707 nt, Artificial Sequence
  derived and/or modified sequence opt5 from hemagglutinin__InfluenzaA__ACR48874/m
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugagaaaacacacaaugggaagcugugugaucucgacggagugaaaccccugauccuuagagauugcagcguugcgggcuggcugcucgggaacccuaugugugacgaauuuaucaaugugccggaaugguccuauauugucgagaaggcuaaccccgugaaugaucugugcuacccuggagacuucaacgauuaugaggaacugaagcaucuccugucucggaucaaucacuuugagaaaauucagaucauucccaagagcuccuggucuagccaugaagccucccuuggcguuagcucugccuguccuuaccaggggaaauccagcuucuuucgcaacguggucuggcugaucaagaaaaauucuaccuaucccacaauuaagagauccuacaacaauaccaaccaagaggaccuccuggugcuuuggggaauccaccacccuaaggaugcugccgagcagacaaaacuguaucagaauccgaccacguacaucagcgugggcaccucuacacucaaccagcggcuggucccccgcauugcuaccagauccaagguuaacggccaaagcgggcggauggaguucuuuuggacaauccugaaaccuaaugacgccauuaacuucgaauccaauggaaacuuuaucgcgcccgaauacgccuauaagauugugaaaaagggcgauucuaccaucaugaaaagcgagcucgaauacgggaauugcaacacgaagugucagacaccuaugggagcuaucaauuccagcaugcccuuccauaacauucacccgcugaccaucggcgagugcccuaaguaugugaaaucuaaucgccuuguccuggccacagggcucagaaacagcccccagcgggagcgcagacggaagaaacgcggacuguuuggcgcuauugccggcuucaucgaagggggauggcagggcaugguggacgggugguacggauaucaucacuccaaugagcaaggcucuggguacgcggccgacaaggaaagcacccagaaagcuauugauggaguuaccaacaaggucaauuccaucaucgacaagaugaacacacaguuugaggccgugggcagagaguucaauaaccuugaacggcgcauugagaaccugaauaaaaagauggaagauggcuuccucgacguguggacguauaacgcugagcugcugguucucauggaaaaugagagaacccuggauuuucacgacucuaacgugaaaaaucuuuacgauaagguccggcugcaacucagagacaacgccaaagaacuggggaauggauguuucgaguuuuaccauaagugcgauaacgaguguauggaaagcgugcgcaauggcacauaugacuacccucaguauuccgaggaagcccggcuuaagagagaggagaucagcggggucaaacuggaaucuauuggaaucuaccagauucucuccaucuauagcaccguggcuucuucccuggcgcuggccauuaugguugcuggccucagccuguggaugugcuccaacgggucucuucagugccgcaucuguaucuga

SEQ ID NO: 196999 - RNA, 1701 nt, Artificial Sequence; identical to SEQ ID NO: 192170
  derived and/or modified sequence opt5 from hemagglutinin__InfluenzaA__ACD47234

SEQ ID NO: 197000 - RNA, 1707 nt, Artificial Sequence
  derived and/or modified sequence opt5 from hemagglutinin__InfluenzaA__ACZ36881
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugagagauugcagcguugcgggcuggcuccuggggaacccuaugugugacgaguuccugaaugugccggaaugguccuauaucgucgagaagauuaaccccgcuaaugaucucugcuacccuggaaacuuuaaugacuaugaggaacugaagcaucuucugucucggaucaaccacuucgagaaaauucagaucauucccaagagcuccuggucugaucaugaagccagcuccggcgugagcucugccuguccuuaccaggggcgcuccagcuuuuucagaaauguuguguggcucaucaaaaaggacaacgcuuaucccaccauuaaacggucuuacaauaacacaaaucaagaggaucugcuuguccuguggggaauccaccacccuaacgacgccgcugagcagacccgccucuaucagaacccgacaaccuacaucuccgugggcacgagcacccugaaucagagacuggugcccaagauugccacacggucuaaggucaacggccaauccgggcgcauggaauuuuucuggaccauccucaaaccuaaugaugcgauuaacuuugagagcaauggaaacuucaucgcccccgaaaaugcuuacaagauuguuaaaaagggcgacuccacaaucaugaaaucugagcuggaauaugggaacugcaauaccaagugucagacgccuaucggagccauuaacagcuccaugcccuuucauaauauccacccgcuuacaauuggcgagugcccuaaauacgugaaaagcaacagacuggugcucgcuaccgggcugcgcaauucuccccagggagagcggagacggcgcaagagaggccuuuucggcgccaucgcgggguuuauugaaggaggcuggcaggggauggucgacggaugguauggcuaccaucacuccaacgagcaagggagcggauaugccgcugauaaagaaucuacacagaaggccaucgacggcgugaccaauaaaguuaacagcaucauugauaagaugaacacccaguucgaggcugugggccgggaauuuaauaaccuggagcgcagaaucgagaaucucaacaaaaagauggaagacggguuccuggaugucuggacauacaaugccgagcugcucgugcugauggaaaacgagcggacgcuugacuuccacgauuccaauguuaagaaccuguaugacaaagugagacuccaacugcgcgauaaugccaaggaacuuggaaacggcuguuuugaguucuaccaucggugcgacaaugaguguauggaaucugucagaaacgggaccuacgauuauccucaguacagcgaggaagcucgccugaaacgggaggagauuuccggagugaagcucgaaagcaucggcacauaucagauucugucuaucuacuccaccgucgcgagcucucuggcccucgcuauuaugguggccgggcugucccuuuggaugugcagcaauggcucccugcagugcagaaucuguaucuga

SEQ ID NO: 197001 - RNA, 1704 nt, Artificial Sequence
  derived and/or modified sequence opt5 from hemagglutinin__InfluenzaA__EPI500771
auggagaagaucgugcugcuguucgccaccauuagccuggucaaauccgaccacaucugcauuggcuaccaugcuaacaauucuacagaacagguugauacgaucauggagaagaacgugaccgugacacacgcccaagacauucuugagaaaacccauaaugggaagcugugugaucucaacggagucaaaccccugauccuuaaggacugcagcguggcgggcuggcugcucgggaauccucugugugaugaauuuacaaacguuccggaaugguccuauaucguggagaaggcuaaucccgccaacgaccugugcuacccuggaaauuucaacgauuaugaggaacucaaacaccuccuuucuagaauuaaucauuuugagaagauccagauuauccccaaagacagcugguccgaucacgaagccucucugggcgucagcgcugccuguuccuaccaggggaacagcucuuucuuucggaaugugguuuggcucauuaagaaagacaacgcuuauccuaccaucaagaagggauacaauaacacaaaccgcgaggaucugcuuauucuguggggcauccaccaucccaaugacgaggccgaacagaccaaacucuaucaaaacccuacgaccuacaucuccauuggcacaagcacccugaaucagagacuggugccgaagaucgcgacacggucuaaaauuaaccgccaguccgggagaaucgauuucuuuuggaccauucucaagcccaaugacgccauccacuucgagagcaacggaaauuuuaucgcuccugaauacgccuauaaaauugucaagaaaggcgacucuacgaucaugcgguccgagguggaauacgggaacugcaauacacgcugucagacccccauuggagcuaucaacagcuccaugccuuuccauaauauucacccccugacaaucggcgagugcccgaaguaugugaagucuaacaaacuuguccuggccaccgggcucagaaauagcccucaacgggagcgcagacggaagcgcggacuguuuggcgcgaucgccggcuucauugaagggggauggcagggcaugguugaugggugguacggauaucaccauuccaacgagcagggcagcggguacgcugccgacaaagaaucuacccagaaggcuaucgauggagugacaaauaaagugaacuccauuaucgacaagaugaacacgcaauuugaggccgucggcagagaguucaauaaccuugaacggcgcauugagaaucugaacaagaaaauggaagauggcuuccucgacguguggaccuauaaugccgagcugcugguucucauggaaaacgagagaacacuggauuuucacgacagcaaugugaagaaccuuuacgauaaaguccggcugcagcucaaggacaaugcuaaagaacuggggaacggauguuucgaguuuuaccauaagugcaauaacgaguguauggaaucugugagaaauggcaccuaugauuacccccaguauagcgaggaagcgcgccuuaagcgggaggagaucuccgggguuaaacuggaaucuauuggaaucuaccaaauccucagcauuuauuccacaguggccagcucucugguccuggcuaucaugauggccggccucucccuguggaugugcagcaacgggucucuucagugcagaauuuguaucuga

SEQ ID NO: 197002 - RNA, 1695 nt, Artificial Sequence
  derived and/or modified sequence opt5 from hemagglutinin__InfluenzaA__ABF93441
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugagagauugcagcguugcgggcuggcuccuggggaacccuaugugugacgaguuccugaaugugccggaaugguccuauaucgucgagaagauuaaccccgcuaaugaucucugcuacccuggaaacuuuaaugacuaugaggaacugaagcaucuucugucucggaucaaccacuucgagaaaauucagaucauucccaagagcuccuggucugaucaugaagccagcuccggcgugagcucugccuguccuuaccaggggcgcuccagcuuuuucagaaauguuguguggcucaucaaaaagaacaaugcuuaucccaccauuaaacggucuuacaacaauacaaaccaagaggaccugcuuguccuguggggaauccaccacccuaacgaugccgcugagcagacccgccucuaucagaauccgacaaccuacaucuccgugggcacgagcacccugaaccagagacuggugcccaagauugccacacggucuaaggucaauggccaauccgggcgcauggaauuuuucuggaccauccucaaaccuaacgacgcgauuaauuuugagagcaacggaaauuucaucgcccccgaaaacgcuuacaagauuguuaaaaagggcgauuccacaaucaugaaaucugagcuggaauaugggaauugcaacaccaagugucagacgccuaucggagccauuaauagcuccaugcccuuucauaacauccacccgcuuacaauuggcgagugcccuaaauacgugaaaagcaauagacuggugcucgcuaccgggcugcggaacucuccccagaucgagacacgcggacuuuucggcgccauugcgggcuuuaucgaagggggauggcagggcauggucgacgggugguauggauaccaucacuccaaugagcaaggcagcggguaugccgcugacaaggaaucuacccagaaagccaucgauggagugaccaacaagguuaacagcauuaucgacaaaaugaauacacaguucgaggcugugggcagagaauuuaacaaucuggagcggcgcauugagaaccucaauaagaaaauggaagauggcuuccuggacgucuggacguacaacgccgagcugcucgugcugauggaaaaugagagaacccuugauuuccacgacuccaacguuaagaaucuguaugauaaggugcggcuccaacugcgcgacaacgccaaagaacuugggaauggauguuuugaguucuaccauagaugcgauaacgaguguauggaaucuguccggaauggcacauacgacuauccucaguacagcgaggaagcuagacugaagcgcgaggagaucuccggggugaaacucgaaagcauuggaaccuaucagauccugucuauuuacuccacagucgcgagcucucuggcccucgcuaucaugguggccggccugucccuuuggaugugcagcaacgggucccugcagugccggaucuguauuuga

SEQ ID NO: 197003 - RNA, 1707 nt, Artificial Sequence
  derived and/or modified sequence opt5 from hemagglutinin__InfluenzaA__AGG12577
auggagaagaucgugcuucucuucgccauuaucagccuggucaaauccgaccacauuugcaucggcuaccaugcuaacaauucuaccgaacagguugauacaauuauggagaagaacgugacggugacccacgcccaagacauccuugaaaagacacauaaugggaagcugugugaucucaacggagucaaaccccugauccuuaaggacugcagcguggcgggcuggcugcucgggaauccuaugugugaugaguuuauugacguuccggaaugguccuauaucguggagaaggcuaaccccgccaaugaucugugcuacccuggaaacuucaaugacuaugaggaacugaaacaccuccugucuagaauuaaccauuuugagaagauccggauuauccccaaagauagcuggccugaccacgaagccucccuuggcgucucugcugccuguagcuaccagggaaauuccagcuucuuucgcaacgugguuuggcugcucaagaaagauaaugcuuaucccauuaucaagaagucuuacaacaauaccaacaaagaggaccugcuugugcugugggggauccaccauccuaacgaugaggccgaacagacaagacucuaucagaauccgaccacauacgucuccauuggcaccagcacgcugaaccaacggcuggugccccgcaucgcgaccagaucuaaggugaauggccaguccgggcggauugacuucuuuuggacaauccucaaaccuaacgacgccauuaauuucgagagcaacggaaauuuuaucgcucccgaauacgccuauaagaucgucaaaaagggcgauucuaccauuaugcgcuccgagguugaauacgggaacugcagcacaagaugucagaccccuaugggagcuaucaauuccucuaugcccuuccacaacauucauccgcugacgaucggcgagugcccuaaauaugugaaaagcaauaagcuggugcuggccacagggcuccggaacagcccccagauugagcgcagacggcgcaaaagaggacuguuuggcgcgaucgccggcuucaucgaagggggauggcaaggcauggucgacgggugguacggauaucaccacuccaaugagcagggcucuggguacgcugccgauaaggaauccacccagaaagcuauugacggagugacaaacaagguuaauagcaucauugauaaaaugaacacccaguuugaggccgugggccgggaguucaacaaucuugaacgcagaaucgagaaccugaauaagaagauggaagacggcuuccucgaugucuggaccuauaacgccgagcugcuggugcucauggaaaaugagcggacacuggacuuucaugauucuaacguuaaaaaucuuuacgacaaggugagacugcaacuccgcgauaacgcuaaagaacuggggaauggauguuucgaguuuuaccacaagugcgacaacgaguguauggaaagcguccggaauggcacguaugacuacccucaguauuccgaggaagcgagacuuaaacgcgaggagauuucuggggugaagcuggaaagcaucggaaccuaccagauucucuccaucuauagcacagucgccucuucccuggugcuggcuaucaugguugccggccucagccuguggaugugcucuaacgggucccuucaaugccggauuuguaucuga

SEQ ID NO: 197004 - RNA, 1707 nt, Artificial Sequence; identical to SEQ ID NO: 197003
  derived and/or modified sequence opt5 from hemagglutinin__InfluenzaA__AGC13463

SEQ ID NO: 197005 - RNA, 1707 nt, Artificial Sequence; identical to SEQ ID NO: 188867
  derived and/or modified sequence opt5 from hemagglutinin__InfluenzaA__ACI06178/m1

SEQ ID NO: 197006 - RNA, 1707 nt, Artificial Sequence
  derived and/or modified sequence opt5 from hemagglutinin__InfluenzaA__AHF20402
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugagaaaacacacaaugggaagcugugugaucucgacggagugagaccccugauccuucgggauugcagcguugcgggcuggcugcucgggaacccuaugugugacgaguuuaucaaugugccggaaugguccuauauugucgagaaagcuaaccccgugaaugaucugugcuacccuggaguuuucaacgacuaugaggaacugaagcaucuccugucucgcaucaaucacuuugagaagauucagaucauucccaaaaacagcuggccuucccaugaagccucucuuggcgugagcgccgcuugucccuaccaggggcaauccagcuucuuuagaaaugucguguggcugaucaagaaaaacaauaccuauccuacaauuaagcggucuuacaacaauaccaaccaggaggaucuccuggugauguggggaauccaccacccgaacgacgccgucgagcagacaaaacuuuaucagaaucccaccacguacaucuccguuggcaccagcacacugaaccaacgccucaccccuagaauugcuacacggucuaaggugaagggccuguccgggcgcauggaguucuuuuggaccauccugaaacccaaugaugccauuaacuucgaaagcaauggaaacuuuaucgcgccugaauacgccuauaagauugugaaaaagggcgacucuacgaucaugagauccgagcucgaauacgggaauugcaacacaaaaugucagacccccaugggagcuaucaauagcuccaugccguuccauaacauucacccucugacaaucggcgagugccccaaguaugucaaaucuacccggcuugugcuggccaccgggcuccgcaauagcccucagagagaggaacggcgcaagaagagaggacuguuuggcgcuauugccggcuucaucgaagggggauggcagggcaugguugaugggugguacggauaucaucacuccaacgaacaaggcagcggguacgcggccgacaaagagucuacacagaaggcuauugacggagugacgaauaaagucaacuccaucaucgauaagaugaauacccaguuugaagccgugggccgggaguucaacaaccuugagcgcagaauugaaaaucugaacaaaaagauggaggacggcuuccucgauguuuggacauauaaugcugaacugcuggugcucauggagaacgaacggacccuggacuuucacgauagcaaugucaagaaccuuuacgacaaagugagacugcaacuccgcgauaaugccaaggagcuggggaacggauguuucgaguuuuaccauaaaugcgacaauaaguguauggaaucuguccggaacggcacauaugauuacccccaguauagcgaggaagccagacuuaaacgcgaggagaucuccggggugaagcuggaaucuauuggaguuuaccagauccucagcauuuauuccaccguggcuagcucucuggcgcuggccaucauggucgcuggccucucccuguggaugugcagcaaugggucucuucagugccggauuuguaucuga

SEQ ID NO: 197007 - RNA, 1707 nt, Artificial Sequence
  derived and/or modified sequence opt5 from hemagglutinin__InfluenzaA__ABQ45850
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugagagauugcagcguugcgggcuggcuccuggggaacccuaugugugacgaguuccugaaugugccggaaugguccuauaucgucgagaagauuaaccccgcuaaugaucucugcuacccuggaaacuuuaaugacuaugaggaacugaagcaucuucugucucggaucaaccacuucgagaaaauucagaucauucccaagagcuccuggucugaucaugaagccagcuccggcgugagcucugccuguccuuaccaggggcgcuccagcuuuuucagaaauguuguguggcucaucaaaaagaacgacgcuuaucccaccauuaaacggucuuacaauaacacaaaucaagaggaucugcuuguccuguggggaauccaccacccuaacgacgccgcugagcagacccgccucuaucagaacccgacaaccuacaucuccgugggcacgagcacccugaaucagagacuggugcccaagauugccacacggucuaaggucaacggccaauccgggcgcauggaauuuuucuggaccauccucaaaccuaaugaugcgauuaacuuugagagcaauggaaacuucaucgcccccgaaaaugcuuacaagauuguuaaaaagggcgacuccacaaucaugaaaucugagcuggaauaugggaacugcaauaccaagugucagacgccuaucggagccauuaacagcuccaugcccuuucauaauauccacccgcuuacaauuggcgagugcccuaaauacgugaaaagcaacagacuggugcucgcuaccgggcugcgcaauucuccccagggagagcggagacggaagaaacgcggccuuuucggcgccaucgcgggguuuauugaaggaggcuggcaggggauggucgacggaugguauggcuaccaucacuccaacgagcaagggagcggauaugccgcugauaaggaaucuacacagaaagccaucgacggcgugaccaauaagguuaacagcaucauugauaaaaugaacacccaguucgaggcugugggcagagaauuuaauaaccuggagcggcgcaucgagaaucucaacaagaagauggaagacggguuccuggaugucuggacauacaaugccgagcugcucgugcugauggaaaacgagagaacgcuugacuuccacgauuccaauguuaaaaaccuguaugacaaggugcggcuccaacugagagauaaugccaaagaacuuggaaacggcuguuuugaguucuaccaucgcugcgacaaugaguguauggaaucuguccggaacgggaccuacgauuauccucaguacagcgaggaagcuagacugaagcgcgaggagauuuccggagugaaacucgaaagcaucggcacauaucagauucugucuaucuacuccaccgucgcgagcucucuggcccucgcuauuaugguggccgggcugucccuuuggaugugcagcaauggcucccugcagugccggaucuguaucuga

SEQ ID NO: 197008 - RNA, 1713 nt, Artificial Sequence
  derived and/or modified sequence opt5 from hemagglutinin__InfluenzaA__AKI82373
auggagaagaucgugccccugcucgccauuaucggccuggucaaaagcgaccagauuugcaucggguaccacgcuaacaauuccaccgaacaaguugauacaauuauggagaagaacgugacggugacccaugcccaggacauccuugaaaagacacacaauggaaaacuguguaaccucgauggcgucaaaccucugauccuuaaggacugcucuguggcgggguggcugcucggaaauccgaugugugaugaguuccugaacguuagcgaaugguccuauauuguggagaaggcuucucccgccaauggccugugcuacccuggggacuuuaacgauuaugaggaacucaaacaucugcuuaauagaaucacccaccugaagaaaauuaagaucauucccaaaagcuacugguccaaccaugaggccucuagcggagucuccgcugccuguagcuauaugggcgaaccuucuuucuuucggaaugugguuuggcucaucaagaagaacaauacauaucccccuauuaaagugaacuacaccaauacaaaccaggaggaccugcuuguccuguggggcauccaccacccgaacaaugaggcugaacagauccaaauuuaccagaaccucaucacccauauuuccguggggacgagcacccugaaucagcgccugauccccaagauugccacaagaucuaaagugaacggacaguccggccggauggaguucuuuuggaccauccucaagccuaaugauagcaucaacuucgacucuaaugggaacuuuauugcgcccgaauacgccuauaucgucaaaaagggagauuccgcuauuaugaaaagcgagcuggaauacggcaauugcaacacaaagugucaaaccccuaugggggccaucaauuccucuaugcccuuccacaacauucauccgcuuacgaucggagagugcccuaaguauguuaaaagcaaucgccuggugcucgcuacaggccugagaaacgcgccccagcgggagcgcgaaggcgggagacggcgcaagagaggacuuuuuggcgccaucgccggguucauugagggaggcuggcaggggaugguggacggaugguacggcuaucaccacuccaaugaacagggcagcggguacgcugccgauaaagagucuacccaaaaggcuaucgacggaauuacaaacaaagucaacuccaucauugacaagaugaauacccaguuugaagccgugggccgggaguucaacaaucuggagcgcagaaucgaaaaccucaauaagaaaauggaggauggguuucuggacguuuggaccuauaacgccgaacugcucgugcugauggagaaugaacggacacuugauuuccaugacagcaacgucaagaaucuguacgagaaagugcgccuccagcugagagauaacgcuaaggagcuuggaaauggcuguuucgaauuuuaccacaaaugcgacaacgaguguauggaaucuguucggaaugggacguaugauuacagccaauauuccgaggaggcgagacugucucgcgaagagauuaacggcgugaagcucgaaagcauggucaccuaccagauccuguccaucuauagcacaguggccucuucccuggcucucgccauuauggucgccggacugagccuuuggaugugcucuaauggcucccugcagugccggaucuguauuuga

SEQ ID NO: 197009 - RNA, 1713 nt, Artificial Sequence
  derived and/or modified sequence opt5 from hemagglutinin__InfluenzaA__EPI284473
auggagaagaucgugcugcuccuggccauuaucagccuugucaaauccgaccagauuugcaucggcuaccacgcuaacaauucuaccgaacaaguugauacaauuauggagaagaacgugacggugacccaugcccaggacauccuggagaaaacacacaaugggaagcucuguaaccuggauggagucaaaccccuuauccugaaggacugcagcguggcgggcuggcuccuggggaauccuaugugugaugaguuccugaacguuuccgaauggucuuauauuguggagaaggcuagcccggccaauggacucugcuaccccggcgacuuuaacgauuaugaggaacugaaacaucuucugaauagaaucacccaccucaagaaaauuaagaucauuccuaaauccuacuggucuaaccaugaggccagcuccggggucagcgcugccuguucuuauaugggagaacccuccuucuuucggaaugugguuuggcugaucaagaagaacaauacauacccucccauuaaagugaacuauaccaauacaaaccaggaggaccuucugguccucuggggcauccaccacccuaacaaugaggcugaacagauccaaauuuaccagaaccugaucacccauauuagcgugggcacgucuacccugaaucagcgccucaucccgaagauugccacaagauccaaagugaacgggcagagcggacggauggaguucuuuuggaccauccugaagcccaaugauucuaucaacuucgacuccaauggcaacuuuauugcgccugaauacgccuauaucgucaaaaagggggauagcgcuauuaugaaauccgagcuugaauacggaaauugcaacacaaagugucaaacccccaugggcgccaucaauucuagcaugccuuuccacaacauucauccccugacgaucggggagugcccgaaguauguuaaauccaaucgccucgugcuggcuacaggacuuagaaacgccccucagcgggagcgcgaaggcggcagacggcgcaagagagggcuguuuggagcgaucgccggcuucauugaagggggauggcagggcaugguggacgggugguacggauaucaccacagcaaugaacagggcucuggcuacgcugccgauaaagaguccacccaaaaggcuaucgacgggauuacaaacaaagucaacagcaucauugacaagaugaauacccaguuugaagccgugggacgggaguucaacaaucucgagcgcagaaucgaaaaccugaauaagaaaauggaggauggcuuucuggacguuuggaccuauaacgccgaacuccuggugcuuauggagaaugaacggacacuggauuuccaugacucuaacgucaagaaucucuacgagaaagugcgccugcagcuuagagauaacgcuaaggagcuggggaauggauguuucgaauuuuaccacaaaugcgacaacgaguguauggaaagcguucggaauggcacguaugauuacucccaauauucugaggaggcgagacucagccgcgaagagauuaacggggugaagcuggaauccauggucaccuaccagauccugagcaucuauucuacaguggccuccagccucgcucuggccauuauggucgccggccuuucucuguggaugugcuccaauggaagccuccagugccggaucuguauuuga

SEQ ID NO: 197010 - RNA, 1710 nt, Artificial Sequence
  derived and/or modified sequence opt5 from hemagglutinin__InfluenzaA__ACO07033
auggagaagaucgugcugcuccuggccaugauuggccuugucaaaagcgaccagaucugcauuggguaccacgcuaacaauuccaccgaacaaguugauacaaucauggagaagaacgugacggugacccaugcccaggacauucuggaaaagacacacaauggaaaacucuguaaccuggauggcgucaaaccccuuauccugaaggacugcucuguggcgggguggcuccugggaaauccuaugugugaugaguuccugaacguuagcgaaugguccuauaucguggagaaggcuucuccggccaauggccucugcuaccccggggacuuuaacgauuaugaggaacugaaacaucuucugagcagaauuaaucaccucaagaaaaucaagauuaucccuaaauccuacuggucuaaccaugaggccagcuccggagucagcgcugccuguucuuaucugggcgaacccuccuucuuucggaaugugguuuggcuuauuaagaagaacaauaccuacccucccaucaaagugaacuauacaaauaccaaccaggaggaccugcucguccuguggggcauucaccacccuaacgaugagaaggaacagauccgcaucuaccaaaauccgaacacaagcauuucuguggggaccuccacgcugaaucagagacucgugcccaaaaucgcuacccggccuaaggucaacggacagagcggccgcauggaguucuuuuggacaauucugaaacccaaugacucuaucaacuucgauuccaaugggaacuuuauugccccugaauacgcguauaagaucgccaaaaagggagacagcguuaucaugaaguccgagcuugaauacggcaauugcaacaccaaaugucagacacccaugggggcuauuaauucuagcaugccguuccauaacauccacccucugaccauuggagagugccccaaguaugugaaauccaauagacucgugcuggccacgggccuucggaacgcuccucaacgcgagggcgggagacggcgcaagagaggacuguuuggcgccaucgcgggguucauugaaggaggcuggcaggggauggucgauggaugguacggcuaucaucacagcaaugagcagggcucuggguacgccgcugacaaagaauccacacagaaggccaucgacggaaucaccaacaaggugaacagcauuaucgauaaaaugaauacacaauuugagauuguuggccgggaguucaacaaucucgaacgcagaaucgagaaccugaauaagaaaauggaagacggguuucuggauguguggaccuauaacgcugagcuccugguccuuauggaaaaugagcggacccuggacuuccacgauucuaacgugaagaaucucuacgaaaaaguucgccugcagcuuagagacaacgccaaggagcugggaaauggcuguuucgaguuuuaccauaagugcgauaacgaauguauggagagcgugcggaaugggacauaugacuacccccaguauuccgaagaggccagacucucucgcgaggaaauuagcggcgucaaaauggaguccauggugacguaccaaauccugagcauuuauucuaccgucgcuuccagccuggcgcucgccaucaugguggcuggacugucucuuuggaugugcuccaacggcagccugcagugccggaucuguauuuga

SEQ ID NO: 197011 - RNA, 1695 nt, Artificial Sequence
  derived and/or modified sequence opt5 from hemagglutinin__InfluenzaA__EPI174803
auggagaagaucgugcugcuccuggccaugauuggccuugucaaaagcgaccagaucugcauuggguaccacgcuaacaauuccaccgaacaaguugauacaaucauggagaagaacgugacggugacccaugcccaggacauucuggaaaagacacacaauggaaaacucuguaaccuggauggcgucaaaccccuuauccugaaggacugcucuguggcgggguggcuccugggaaauccuaugugugaugaguuccugaacguuagcgaaugguccuauaucguggagaaggcuucuccggccaauggccucugcuaccccggggacuuuaacgauuaugaggaacugaaacaucuucugagcagaauuaaucaccucaagaaaaucaagauuaucccuaaauccuacuggucuaaccaugaggccagcuccggagucagcgcugccuguucuuaucugggcgaacccuccuucuuucggaaugugguuuggcuuauuaagaagaacaauaccuacccucccaucaaagugaacuauacaaauaccaaccaggaggaccugcucguccuguggggcauucaccacccuaacgaugagaaggaacagauccgcaucuaccaaaauccgaacacaagcauuucuguggggaccuccacgcugaaucagagacucgugcccaaaaucgcuacccggccuaaggucaacggacagagcggccgcauggaguucuuuuggacaauucugaaacccaaugacucuaucaacuucgauuccaaugggaacuuuauugccccugaauacgcguauaagaucgccaaaaagggagacagcguuaucaugaaguccgagcuugaauacggcaauugcaacaccaaaugucagacacccaugggggcuauuaauucuagcaugccguuccauaacauccacccucugaccauuggagagugccccaaguaugugaaauccaauagacucgugcuggccacgggccuucggaacgcuccucaaacagagacccgcggccuguuuggggccaucgcgggauucauugaaggcggguggcagggaauggucgauggcugguacggguaucaucacagcaaugagcagggaucuggcuacgccgcugacaaggaauccacacagaaagccaucgacggcaucaccaacaaggugaacagcauuaucgauaagaugaauacccaauuugagauuguugggagagaguucaacaaucucgaacggcgcaucgagaaccugaauaaaaagauggaagacggauuucuggauguguggacauauaacgcugagcuccugguccuuauggaaaaugagagaacgcuggacuuccacgauucuaacgugaaaaaucucuacgaaaagguucggcugcagcuucgcgacaacgccaaagagcugggcaauggguguuucgaguuuuaccauaagugcgauaacgaauguauggagagcgugagaaauggaaccuaugacuacccccaguauuccgaagaggcccggcucucucgcgaggaaauuagcggcgucaagauggaguccauggugacauaccaaauccugagcauuuauucuaccgucgcuuccagccuggcgcucgccaucaugguggcugggcugucucuuuggaugugcuccaacggcagccugcagugcagaaucuguauuuga

SEQ ID NO: 197012 - RNA, 1704 nt, Artificial Sequence
  derived and/or modified sequence opt5 from hemagglutinin__InfluenzaA__AGZ62382
auggagaagaucgugcuccuguucgccgcuauuagccuggucaaauccgaccacaucugcauuggcuaccaugccaacaauucuaccaagcagguugauacaaucauggagaaaaacgugacggugacccacgcgcaagacauucuugaaaagacacauaaugggaaacugugugaucucaacggagucaagccccugauccuuaaggacugcagcguggcuggcuggcugcucgggaauccuaugugugaugaauuuaucaacguuccggagugguccuauauuguggaaaaagccaaucccgccaacggacugugcuacccuggcaauuucaacgacuaugaggagcugaagcaccuccugucuagaaucaaucauuuugaaaagauucggaucauucccaaggauagcugguccgaccacgaggcuucucuuggggucagcgccgcuuguccuuaccagggaaacuccagcuucuuucgcaaugugguuuggcugaucaaaaaggauaacaccuaucccacaauuaagaaaucuuacaauaacaccaaccaggaagaccuccugauccuuuggggcauccaccauccuaaugaugaggccgagcagacaagacuguaucaaaacccgaccacguacauuuccaucggcaccagcacacucaaucagcggcuggugcccaagauugcgacccgcucuaaaaucaacgggcaguccggaagaauugacuucuuuuggacaauccugaagccuaaugaugccauccacuucgaaagcaacggcaauuuuauugcucccgaguacgccuauaaaaucgucaagaaaggggacucuaccauuaugaaguccgaaguggaguacggaaacugcaauacgcggugucagacaccuaucggcgcuauuaacagcuccaugcccuuccauaauauccacccgcucaccaucggggaaugcccuaaguaugugaaaucuaacaagcugguccuugccacaggacugcgcaauagcccccaaagagagcggcgcagaaaacggggccucuuuggcgcgauugccggguucaucgagggaggcuggcaggggaugguugacggaugguacggcuaucaccauuccaacgaacaggggagcggauacgcugccgauaaggagucuacccagaaagcuauugacggcgugaccaauaaggugaacuccaucauugauaagaugaacacacaauuugaagccgucggccgcgaguucaauaaccuggaaagacggaucgagaaucuuaacaaaaagauggaggacggguuccuggauguguggacguauaaugccgaacuccugguucugauggagaacgaacgcacccucgacuuucacgauagcaaugugagaaaccuguacgacaaaguccggcuucagcugaaggauaaugcuaaagagcucggaaacggcuguuucgaauuuuaccauaagugcaauaacgaguguauggagucugugagaaaugggacauaugacuacccucaguauagcgaagaggcgcgccugcggagagaagagauuuccggaguuaaacuugagucuaucggcaucuaccaaauucugagcaucuauuccaccguggccagcucucucguccuggcuauuaugauggccgggcugucccucuggaugugcagcaacggcucucugcagugccgcaucuguauuuga

SEQ ID NO: 197013 - RNA, 1704 nt, Artificial Sequence
  derived and/or modified sequence opt5 from hemagglutinin__InfluenzaA__ABG67978/m
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugagagauugcagcguugcgggcuggcuccuggggaacccuaugugugacgaguucaucaaugugccggaaugguccuauauugucgagaaggcuaaccccgccaaugaucugugcuacccuggaaacuuuaaugacuaugaggaacucaagcaucugcuuucucggaucaaccacuucgagaaaauucagaucauucccaagagcuccuggucugaucaugaagccagcuccggcgugagcucugcuuguccuuaccaggggacccccuccuuuuuccgcaauguuguguggcugaucaaaaagaacaauacauauccuaccauuaaaagaagcuacaacaauacaaaccaagaggaccuccugauccuuuggggaauccaccacucuaacgaugccgcugagcagaccaagcuguaucagaauccgacgaccuacauuuccgucggcacaagcacccucaaccagcggcuggugcccaagaucgccacacgcucuaaagugaauggccaauccgggagaauggacuuuuucuggaccauucugaagccuaacgaugcgaucaauuuugaaagcaacggaaauuucauugcccccgaguacgcuuauaaaaucgucaagaaaggcgacuccgccaucauuaagucugaaguugaguacgggaacugcaauacgaaaugucagacaccuaucggagcuauuaacagcuccaugcccuuucauaauauccacccgcucaccauuggcgaaugcccuaaguaugugaaaagcaacaaacuggugcuugccacagggcugcgcaauucuccccuccgggagagacggcgcaagagaggacuguucggcgcgaucgccggcuuuaucgaagggggauggcagggcauggucgacgggugguacggauaucaucacuccaacgaacagggcagcggguacgcugccgauaaagagucuacccaaaaggcuauugacggagugaccaauaaaguuaacagcaucauugauaagaugaacacacaguucgaagccgugggccgggaguuuaauaaccuugaacgcagaaucgagaaucugaacaagaaaauggaggacggcuuccucgaugucuggacguauaaugccgaacugcuggugcucauggagaacgaacggacccuggacuuccacgauuccaauguuaagaaccuuuacgacaaagugcgccugcagcucagagauaaugcuaaggagcuggggaacggauguuuugaguucuaccauaaaugcgacaaugaguguauggagucuguccggaacggcacauaugauuacccucaauauagcgaagaggcgagacuuaagcgcgaagagauuuccggggugaagcuggagagcaucggaaccuaccagauucucucuaucuauuccacagucgccagcucucuggcucuggccaucaugguggccggccucucccuguggaugugcagcaaugggucccuucagugccggauuuguaucuga

SEQ ID NO: 197014 - RNA, 1695 nt, Artificial Sequence
  derived and/or modified sequence opt5 from hemagglutinin__InfluenzaA__EPI827075
auggagaagaucgugcugcuguucgccaccauuagccuggucaaauccgaccacaucugcauuggcuaccaugcuaacaauucuacagaacagguugauacgaucauggagaagaacgugaccgugacacacgcccaagacauucuugaaaagacccauaaugggaagcugugugaucucaacggagucaaaccccugauccuuaaggacugcagcguggcgggcuggcugcucgggaauccucugugugaugaguuuacaaacguuccggaaugguccuauaucguggagaaggcuaaucccgccaacgaccugugcuacccuggaaauuucaacgauuaugaggaacucaaacaccuccuuucuagaauuaaucauuuugagaagauccagauuauccccaaagacagcugguccgaucacgaagccucucugggcgucagcgcugccuguuccuaccaggggaacagcucuuucuuucggaaugugguuuggcucauuaagaaagacaacgcuuauccuaccaucaagaagggauacaauaacacaaaccgcgaggaucugcuuauucuguggggcauccaccaucccaaugacgaggccgaacagaccagacucuaucaaaacccuacgaccuacaucuccauuggcacaagcacccugaaucagcggcuggugccgaaaaucgcgacacgcucuaagauuaacgggcaguccggaagaaucgauuucuuuuggaccauucucaaacccaaugacgccauccacuucgagagcaacggcaauuuuaucgcuccugaauacgccuauaagauugucaaaaagggggacucuacgaucaugcgguccgagguggaauacggaaacugcaauacacgcugucagacccccauuggcgcuaucaacagcuccaugccuuuccauaauauucacccccugacaaucggggagugcccgaaauaugugaagucuaacaaacuuguccuggccaccggacucagaaauagcccucaacgggagacccgcggccuguuuggcgcgaucgccggguucauugaaggaggcuggcaggggaugguugauggaugguacggcuaucaccauuccaacgagcaggggagcggauacgcugccgacaaagaaucuacacagaaggcuaucgauggcgugacgaauaaagugaacuccauuaucgacaagaugaacacccaauuugaggccgucggcagagaguucaauaaccuugaacggcgcauugagaaucugaacaaaaagauggaagauggguuccucgacguguggacauauaaugccgagcugcugguucucauggaaaacgagagaacccuggauuuucacgacagcaaugugaagaaccuuuacgauaaaguccggcugcagcucaaggacaaugcuaaagaacugggaaacggcuguuucgaguuuuaccauaagugcaauaacgaguguauggaaucugugcgcaaugggacauaugauuacccccaguauagcgaggaagcgagacuuaaacgggaggagaucuccggaguuaagcuggaaucuauuggcaucuaccaaauccucagcauuuauuccaccguggccagcucucugguccuggcuaucaugauggccgggcucucccuguggaugugcagcaacggcucucuucagugcagaauuuguaucuga

SEQ ID NO: 197015 - RNA, 1707 nt, Artificial Sequence
  derived and/or modified sequence opt5 from hemagglutinin__InfluenzaA__ABP96850
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucugugaucuggacggagugaaaccccuuauccugagagauugcagcguugcgggcuggcuccuggggaacccuaugugugacgaguuccugaaugugccggaaugguccuauaucgucgagaagauuaaccccgcuaaugaucucugcuacccuggagacuuuaacgauuaugaggaacugaagcaucuucugucucggaucaaucacuucgagaaaauucagaucauucccaagagcuccuggucugacuacgaagccagcuccggcgugagcucugccuguccuuaucaggggcgcuccagcuuuuucagaaacguuguguggcucaucaaaaagaauaacgcuuaccccaccauuaaacggucuuauaauaacacaaaucaagaggaucugcuuguccuguggggaauccaucacccuaacgacgccgcugagcagauccgccucuaccagaacccgaccacauacauuuccgugggcaccagcacgcugaaucagagacuggugcccaagaucgccacccggucuaaggucaacggccaauccgggcgcauggaauuuuucuggacaauucucaaaagcaaugaugcgaucaacuuugaguccaauggaaacuucauugccccugaauaugcuuacaagaucguuaaaaagggcgacucuaccaucaugaaaagcgagcuggaauaugggaauugcaacacaaagugucagacccccauuggagccaucaauuccagcaugccuuuucacaacauucauccccuuacgaucggcgagugcccgaaauacgugaagucuaauagacuggugcucgcuacagggcugcggaacuccccucagggagagcgcagacggcgcaagagaggccuuuucggcgccauugcgggguuuaucgaaggaggcuggcaggggauggucgacggaugguauggcuaccaccauagcaaugagcaagggucuggauaugccgcugauaaagaaagcacccagaaggccaucgacggcgugacaaacaaaguuaauuccauuaucaacaagaugaacacccaguucgaggcugugggccgggaauuuaauaaccuggagcgcagaauugagaaucucaacaaaaagauggaagauggguuccuggacgucuggaccuacaaugccgagcugcucgugcugauggaaaacgagcggacacuugauuuccacgacucuaauguuaagaaccuguacgauaaagugagacuccaacugcgcgacaaugccaaggaacuuggaaacggcuguuuugaguucuaucaccggugcgauaaugaguguauggaaagcgucagaaacgggacguacgacuauccccaguacuccgaggaagcucgccugaaacgggaggagaucagcggagugaagcucgaaucuauuggcaucuaucagauucuguccaucuacagcaccgucgcgucuucccuggcccucgcuaucaugguggccgggcuguuucuuuggaugugcagcaauggcucccugcagugcagaauuuguaucuga

SEQ ID NO: 197016 - RNA, 1692 nt, Artificial Sequence
  derived and/or modified sequence opt5 from hemagglutinin__InfluenzaA__EPI827077
auggagaagaucgugcugcuccuggccauugucagcaucguuaaauccgaccagauuugcaucggcuaccacgcuaacaauucuaccgaacaaguggauacaauuauggagaagaacgugacggucacccaugcccaggacauccuugaaaagacacacaaugggaagcuguguaaccucgauggagugaaaccccugauccuuagagacugcagcguugcgggcuggcugcucgggaauccuaugugugaugaguuccugaacgugccggaaugguccuauauugucgagaagaucaaucccgcuaacgaccugugcuacccuggaaauuuuaacgauuaugaggaacucaagcaucugcuuucucggauuaaucacuucgagaaaauccagauuauccccaaggacagcugguccgaucaugaagccucuggcgugagcuccgccuguccuuaccaggggcgcagcuccuuuuucagaaacguuguguggcugaccaaaaagaaugacgcuuaucccacaauuaaaaagucuuacaacaauaccaaccaagaggaucuccugguccuuuggggaauccaccacccuaacgacgccgcugagcagacacggcuguaucagaauccgaccacguacaucagcgugggcaccucuacacucaaccagcgccuggugcccaagauugccaccagauccaaagucaauggccaaagcgggcggauggaauuuuucuggacaauccugaagucuaacgaugcgauuaauuuugaguccaacggaaauuucaucgccccugaaaacgcuuacaaaauuguuaagaaaggcgacagcaccaucaugaaguccgagcucgaauauucuaauugcaacacgaaaugucagacacccaucggggccauuaauagcuccaugccuuuucauaacauccacccccugaccauuggagagugcccgaaguacgugaaaagcaaucgccuugugcuggcuacaggccucagaaacucuccucagcgggagacccgcgggcuguucggagccaucgcgggcuuuauugaaggcggguggcagggaauggucgacggcugguauggguaccaucacuccaaugagcaaggaagcggcuaugccgcugauaaagaaucuacccagagagccaucgacggggugacaaacaagguuaacagcaucauugauaaaaugaauacgcaguucgaggcugugggacgggaauuuaacaaucuugagcgcagaaucgagaaccugaauaagaaaauggaagacggcuuccucgaugucuggaccuacaacgccgagcugcuggugcucauggaaaaugagcggacacuggacuuccacgauuccaacguuaagaaucuuuaugacaaggugcgccugcaacucagagauaacgccaaagaacugggcaauggguguuuugaguucuaccaucggugcgacaacgaguguauggaaucugucagaaauggaaccuacgauuauccccaguacagcgaggaagcucgccuuaagcgggaggagauuuccggcgugaaacuggaaagcaucgggacauaucagauucucucuaucuacuccaccgucgcgagcucucuggcccuggcuauuaugguggccggacucucccuguggaugugcagcaacggcucccuucagugcagaaucuguaucuga

SEQ ID NO: 197017 - RNA, 1704 nt, Artificial Sequence
  derived and/or modified sequence opt5 from hemagglutinin__InfluenzaA__EPI594523
auggagaagaucauucugcuccuggccaucauuggccuugugaaaagcgaccagaucugcgucggguaccacgcuaacaauuccaccgaaagaguugauacaauuauggagaagaacgugacggugacccaugcccaagacauccuggagaaaacacacaauggaaagcucuguaaccugaauggcgucaaaccccuuauccuggaagauugcucuguggcgggguggcuccugggaaacccuaugugugacaaguuccugaauguuagcgaaugguccuauauuguggagaaggcuggcccggccaacgggcucugcuaccccggagauuuuaaugacuaugaggaacugaaacaucuucugucucggaucaaccacuucgagaagauugaaaucauuccuaaaaaucauuggagcaaccacaauaccuccggcgucucuagcgccuguuccuaccucgagaaccccagcuuuuuccgcaaugugguuuggcugacaaagaaaaacaacaccuauccuacaaucaaggugaauuacaccaacgcuaaucagaaggaucuucugguccucuggggcauucaccaucccaacaaugaggccgaacagaaaaugaucuaucagaacucuaauacguacguguccguggggaccagcacacugaaccaaagacuggucccuaagaucgcuacccggucuaaaguuaauggacaguccggccgcauugacuuuuucuggacaauccucaagccgaacgauaccauuaauuuugacagcaacgggaauuucaucgcccccaaauacgcguauaagauugugaaaaagggagauucugccaucaugaaguccgagcugaaauacgacaacugcaauacgaagugucagacaccuaucggcgcuauuaacagcuccaugcccuuucacaacauccauccucuuaccauuggggaaugccccaaauaugugaagucuaauagacugguccucgccacaggacugcggaacgcuccgcagaucgagggccgcagacggaaacgcggccuuuucggggccauugcgggauuuaucgaaggcggguggcaaggaaugguggauggcugguacggguaucaccacagcaaugagcagggauccggcuacgccgcugacaaggagagcacccagaaggccguugacggcaucaccaacaaaauuaauucuaucauugauaagaugaacaaucaguucgaagcuguggggagagaguuuaacaaucuggaacggcgcaucgagaaccucaauaaaaagauggaagacggauuccuggaugucuggacauauaacgccgagcugcucgugcugauggagaaugaaagaacgcuugacuuccaugauuccaacguuaaaaaucuguacgagaaggugcggcuccaacugcgcgacaacgccaaggaacuuggcaacggguguuuugaguucuaccacaaaugcgauaaugaauguauggagagcgucaagaacggaaccuaugacuacccucaguauucugaggaagcuagacugaaucgggaggaaauuagcggcgugaaacucgaguccacagucaccuaccagauccugucuauuuauagcacaguggcguccagccugguucucgccaucaugguggcugggcugucucuuuggaugugcuccaacggcagccugcaaugcagaaucuguauuuga

SEQ ID NO: 197018 - RNA, 1707 nt, Artificial Sequence
  derived and/or modified sequence opt5 from hemagglutinin__InfluenzaA__AAD37782
auggagagaaucgugcugcuccuggccauugucagccuuguuaaguccgaccagaucugcauuggcuaccacgcuaacaauucuaccgaacaaguggauacaaucauggagaaaaacgugacggucacccaugcccaggacauucuggaaaagacacacaaugggaaacucugugaucugaacggagugaagccccuuauccugcgggacugcagcguugcgggcuggcuccuggggaauccuaugugugaugaguucaucaacgugccggaaugguccuauauugucgagaaggcuucucccgccaaugaccugugcuacccuggagauuuuaacgacuaugaggaacucaaacaucugcuuagccgcaccaaucacuucgagaagauccagauuauucccccuuccucuuggagcaaccaugaugccuccagcggcgugucuuccgcuugucccuaccacgggagaagcuccuuuuuccggaauguuguguggcugauuaaaaagaacucugccuauccuacaaucaaacgcagcuacaauaacaccaaucaggaagaccuccugguccuuuggggaauccaccauccgaacgaugcugccgagcaaacaaagcuguaucagaaccccaccacguacaucucugugggcaccuccacacucaaucagagacuggugccugagaucgcgacccggcccaaagucaacggccagagcgggcgcauggaauuuuucuggacaauucugaagccuaaugacgccaucaacuuugaguccaauggaaacuucauugcucccgaauacgccuauaagaucguuaaaaagggcgauucugcuauuaugaaaagcgagcucgaauacgggaauugcaacaccaagugucaaacgccgaugggagccaucaauuccagcaugccuuuucacaacauccauccccugacaauuggcgagugcccuaaauaugugaagucuaauagacuugugcuggcgaccgggcuccggaacacaccccagcgcgagagacggcgcaaaaagagaggacuguucggcgccaucgcuggcuuuauugaagggggauggcagggcauggucaaugggugguacggauaucaccacuccaacgagcagggcagcggguacgccgcugacaaggaaucuacccaaaaagccaucgacggagugaccaauaagguuaacagcauuaucgauaaaaugaacacacaguucgaggccgugggccgggaauuuaauaaccuugagcgcagaaucgagaaucugaacaagcagauggaagacggcuuccucgaugucuggacguauaaugcugagcugcuggugcucauggaaaacgagcggacccuggacuuccaugauuccaauguuaaacaccuuuacgacaaggugagacugcaacuccgcgauaacgcgaaggaacuggggaauggauguuuugaguucuaccauaaaugcgacaacgaguguauggaaucugucaagaauggcacauaugauuacccccaguauagcgaggaagcccggcuuaacagagaggagauuuccggggugaaacuggaaagcaugggaaccuaccagauccucucuauuuauuccacagucgcuagcucucuggcccuggccaucaugguggcuggccucucccuguggaugugcagcaaugggucccuucagugccgcauuuguaucuga

SEQ ID NO: 197019 - RNA, 1707 nt, Artificial Sequence
  derived and/or modified sequence opt5 from hemagglutinin__InfluenzaA__AAD51927
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucugugaucugaacggagugaaaccccuuauccugagagacugcagcguugcgggcuggcuccuggggaauccuaugugugaugaguucaucaacgugccggaaugguccuauauugucgagaaggcuucucccgccaaugaccugugcuacccuggagauuuuaacgacuaugaggaacucaagcaucugcuuagccggaccaaucacuucgagaaaauccagauuauccccaaguccucuuggagcaaccaugaugccuccagcggcgugucuuccgcuuguccuuaccacgggcgcagcuccuuuuucagaaauguuguguggcugauuaaaaagaacucugccuaucccacaaucaaacggagcuacaauaacaccaaucaggaagaccuccugguccuuuggggcauucaccauccuaacgaugcugccgagcaaacaaagcuguaucagaacccgaccacguacaucucugugggaaccuccacacucaaucagcgccuggugcccgagaucgcgaccagaccuaaggucaacggccagagcgggcggauggaauuuuucuggacaauucugaaacccaaugacgccaucaacuuugaguccaauggaaacuucauugcuccugaauacgccuauaagaucguuaaaaagggcgauucugcuauuaugaaaagcgagcucgaauacgggaauugcaacaccaagugucaaacgcccaugggagccaucaauuccagcaugccguuucacaacauccauccucugacaauuggcgagugccccaaauaugugaagucuaaucgccuugugcuggcgaccgggcucagaaacacaccucagcgggagcgcagacggaagaaacgcggacuguucggcgccaucgcuggcuuuauugaagggggauggcagggcauggucgacgggugguacggauaucaccacuccaaugagcagggcagcggguacgccgcugacaaggaaucuacccaaaaagccaucgauggagugaccaacaagguuaauagcauuaucgacaaaaugaacacacaguucgaggccgugggcagagaauuuaacaaucuugagcggcgcaucgagaaccugaauaagcagauggaagauggcuuccucgacgucuggacguauaacgcugagcugcuggugcucauggaaaaugagagaacccuggauuuccaugacuccaacguuaagaaucuuuacgauaaagugcggcugcaacucagagacaacgcgaaggaacuggggaauggauguuuugaguucuaccacaaaugcgauaacgaguguauggaaucugucaagaauggcacauaugacuacccccaguauagcgaggaagcccgccuuaaccgggaggagauuuccggggugaaacuggaaagcaugggaaccuaccagauccucucuauuuauuccacagucgcuagcucucuggcccuggccaucaugguggcuggccucucccuguggaugugcagcaaugggucccuucagugcagaauuuguaucuga

SEQ ID NO: 197020 - RNA, 1704 nt, Artificial Sequence; identical to SEQ ID NO: 190741
  derived and/or modified sequence opt5 from hemagglutinin__InfluenzaA__AEO89181

SEQ ID NO: 197021 - RNA, 1707 nt, Artificial Sequence; identical to SEQ ID NO: 192195
  derived and/or modified sequence opt5 from hemagglutinin__InfluenzaA__AFM78567

SEQ ID NO: 197022 - RNA, 1707 nt, Artificial Sequence
  derived and/or modified sequence opt5 from hemagglutinin__InfluenzaA__ACR48872
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucugugaucuggacggagugaaaccccuuauccugagagauugcagcguugcgggcuggcuccuggggaacccuaugugugacgaguucaucaaugugccggaaugguccuauauugucgagaaggcuaaccccaccaaugaucugugcuacccuggaucuuuuaacgacuaugaggaacucaagcaucugcuuagccggaucaaucacuucgagaaaauucagaucauucccaaguccucuuggagcgaucaugaagccuccagcggcgugucuuccgccuguccuuaccuggggagccccuccuuuuuccgcaacguuguguggcucaucaaaaagaacucuacauauccuaccauuaaaaagagcuacaauaauacaaaccaggaggaccugcuuguccuguggggaauccaccacccgaaugaugcugccgagcaaaccaugcucuaucagaaccccacgaccuacaucucuauuggcacauccacccugaaccagagacuggugccuaagaucgcuacacggagcaaagugaauggccaguccgggcgcauggaauuuuucuggaccauucucaagcccaacgacgccaucaauuuugagucuaacggaaauuucauugcgccugaauacgccuauaaaaucgucaagaaaggcgauagcgcuaucaugaaguccgagcuggaauacgggaacugcaauacgaaaugucaaacacccaugggagccauuaacagcucuaugccguuucauaauauccacccucuuaccauuggcgagugccccaaguauguuaaguccaacagacuggugcucgcuacagggcugcggaauagcccucagcgcgagucuagacggaaaaagcgcggacuuuucggcgccaucgcgggcuuuauugaagggggauggcagggcaugguggacgggugguacggauaucaucacagcaacgagcagggcuccggguacgccgcugacaaagaaucuacccaaaaggccaucgauggagucaccaauaaagugaacagcaucauugacaagaugaauacacaguucgaggcuguuggcagagaauuuaacaaccuggagcggcgcaucgagaaucucaacaagaaaauggaagauggcuuccuggacguguggacguauaaugccgagcugcucguccugauggaaaacgagagaacccuugauuuccacgacuccaaugugaagaaccuguacgauaaaguucggcuccagcugcgcgacaaugccaaggaacuugggaacggauguuuugaguucuaccauaaaugcgauaaugaguguauggaaagcauuagaaacggcacauauaauuacccccaauauucugaggaagcucggcugaagagagaggagaucuccggggugaagcucgaaagcauuggaaccuaccagauccugucuauuuauuccacagucgcgagcucccuggcccucgcuaucaugauggccggccugucucuuuggaugugcagcaacgggucccugcagugccgcaucuguauuuga

SEQ ID NO: 197023 - RNA, 1707 nt, Artificial Sequence; identical to SEQ ID NO: 192195
  derived and/or modified sequence opt5 from hemagglutinin__InfluenzaA__ABW06108

SEQ ID NO: 197024 - RNA, 1707 nt, Artificial Sequence
  derived and/or modified sequence opt5 from hemagglutinin__InfluenzaA__EPI341633
auggagaagaucacccugcuccugagcauugugucccuugucaaaucugaccagaucugcauuggcuaccacgccaacaauagcacagaacaaguugauacgaucauggagaagaacgugaccgugacacaugcucaggacauucuggaaaagacccacaaugggaaacucugugaucuggacggagucaaaccccuuauccugaaggauugcuccguggccggcuggcuccuggggaacccuaugugugacgaguucaucaauguuccggaauggucuuauauuguggagaaggcgaaccccacaaaugaucugugcuacccuggcagcuuuaacgacuaugaggaacucaaacaucugcuuuccagaaucaaucacuucgagaagauucagaucauucccaaaucuagcugguccgaucaugaagcuagcucuggagucuccagcgccuguccuuaccuggggucucccuccuuuuuccggaacgugguuuggcucaucaagaaaaauagcaccuauccuacaauuaagaagaccuacaacaauacgaaccaggaggaccugcuuauccuguggggaauccaccacccgaauaacggcgccgagcaaaccaugcucuaucagaaccccacaaccuacauuucuaucggcacauccacccugaaucagcgccuggugccuaaaauugcuacgagaagcaaggucaacgggcaguccggacggauggaauuuuucuggacaauccucaaacccaaugaugccauuaacuuugagucuaauggcaacuucaucgcuccugaauacgccuauaagaucgugaaaaagggggacagcgcgauuaugaaauccgagcuggaauacggaaauugcaacaccaagugucaaacacccaugggcgccaucaauagcucuaugccguuucauaacauucacccuaucaccauuggggagugccccaaguaugugaaauccaaucgccuuguccuggcuaccggacucagaaacagcccucagcgggagucucgcagaaagaaacggggccuguucggcgccaucgcuggguuuaucgaaggaggcuggcaggggaugguugauggaugguacggcuaucaucacagcaaugagcagggguccggauacgccgcggacaaggaaucuacacaaaaagccauugacggcgugacgaacaaggugaauagcaucauugauaagaugaacacccaguucgaggcugucggccgcgaauuuuccaaccuugagagacggaucgagaaucugaacaaaaagauggaagacggguuccucgauguguggacauauaaugccgagcugcugguucucauggaaaacgagcgcacccuggacuuccacgauagcaaugugaaaaaccuuuacgacaaggucagacugcagcuccgggauaaugcuaaagaacugggaaacggcuguuuugaguucuaccauaagugcgacaaugaguguauggaaucuauucgcaacgggacauauaauuacccccaauauuccgaggaagccagacuuaagcgggaggagaucagcggagugaaacuggaaucuauuggcaccuaccagauccucuccaucuauagcacgguugccuccucucuggcucuggcgauuaugaucgccgggcucagccuguggaugugcuccaacggcucucuucagugcagaauuuguaucuga

SEQ ID NO: 197025 - RNA, 1707 nt, Artificial Sequence
  derived and/or modified sequence opt5 from hemagglutinin__InfluenzaA__ABD95991
auggagaagaucaugcugcuccuggccauugugagccuugucaaauccgaccagaucugcauuggcuaccacgcuaacaauucuaccgaacaaguugauacaaucauggagaagaacgugacggugacccaugcccaggacauucuggaaaagacacacaaugggaaacucugugaucuggacggagucaaaccccuuauccugagagauugcagcguggcgggcuggcuccuggggaacccuaugugugacgaguuccugaauguuccggaaugguccuauaucguggagaagauuaaccccgcuaaugaucucugcuacccuggaaacuuuaaugacuaugaggaacugaagcaucuucugucucggaucaaccacuucgagaaaauucagaucauucccaagagcuccuggucugaucaugaagccagcuccggcgucagcucugccuguccuuaccaggggcgcuccagcuuuuucagaaaugugguuuggcucaucaaaaaggacaacgcuuaucccaccauuaaacggucuuacaauaacacaaaucaagaggaucugcuugugcuguggggaauccaccacccuaacgacgccgcugagcagacccgccucuaucagaacccgacaaccuacaucuccgucggcacgagcacccugaaucagagacuggugcccaagauugccacacggucuaaggugaacggccaauccgggcgcauggaauuuuucuggaccauccucaaaccuaaugaugcgauuaacuuugagagcaauggaaacuucaucgcccccgaaaaugcuuacaagauugucaaaaagggcgacuccacaaucaugaaaucugagcuggaauaugggaacugcaauaccaagugucagacgccuaucggagccauuaacagcuccaugcccuuucauaauauccacccgcuuacaauuggcgagugcccuaaauacguuaagagcaacagacuggugcucgcuaccgggcugcgcaauucuccccagggagagcggagacggaagaaacgcggccuuuucggcgccaucgcgggguuuauugaaggaggcuggcaggggaugguggacggaugguauggcuaccaucacuccaacgagcaagggagcggauaugccgcugauaaggaaucuacacagaaagccaucgacggcgucaccaauaaggugaacagcaucauugauaaaaugaacacccaguucgaggcuguuggcagagaauuuaauaaccuggagcggcgcaucgagaaucucaacaagaagauggaagacggguuccuggauguguggacauacaaugccgagcugcucguccugauggaaaacgagagaacgcuugacuuccacgauuccaaugugaaaaaccuguaugacaagguucggcuccaacugagagauaaugccaaagaacuuggaaacggcuguuuugaguucuaccaucgcugcgacaaugaguguauggaaucugugcggaacgggaccuacgauuauccucaguacagcgaggaagcuagacugaagcgcgaggagauuuccggagucaaacucgaaagcaucggcacauaucagauucugucuaucuacuccaccguggcgagcucucuggcccucgcuauuauggucgccgggcugucccuuuggaugugcagcaauggcucccugcagugccggaucuguaucuga

SEQ ID NO: 197026 - RNA, 1707 nt, Artificial Sequence
  derived and/or modified sequence opt5 from hemagglutinin__InfluenzaA__AGN69453
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugagagauugcagcguugcgggcuggcuccuggggaacccuaugugugacgaguuccugaaugugccggaaugguccuauaucgucgagaagauuaaccccgcuaaugaucucugcuacccuggaaacuuuaaugacuaugaggaacugaagcaucuucugucucggaucaaccacuucgagaaaauucagaucauucccaagagcuccuggucugaucaugaagccagcgccggcguguccagcgcuuguccuuaccaggggaugucuuccuuuuuccgcaauguuguguggcucaucaaaaaggacaacgccuaucccaccauuaaaagaagcuacaauaacacaaaucaagaggaucugcuuguccuguggggaauccaccacccuaacgacgcugccgagcagaccaagcucuaucagaacucuacaaccuacaucuccgugggcacgagcacccugaaucagcggcuggugccgaagauugcgacacgcucuaaagucaacggccaauccgggagaaucgaauuuuucuggaccauucucaagcccaaugauacaaucaacuuugagagcaauggaaacuucauugccccugaaaaugcuuacaaaaucguuaagaaaggcgacuccaccaucaugaagucugagcuggaauaugggaacugcaauacgaaaugucagacacccauuggagccaucaacagcuccaugccuuuucauaauauucacccccuuaccaucggcgagugcccgaaguacgugaaaagcucucggcuggugcucgcuacagggcugcgcaacuccccucagggagagagacggcgcaaaaagagaggccuuuucggcgccauugcgggguuuaucgaaggaggcuggcaggggauggucgacggaugguauggcuaccaucacagcaaugagcaagggucuggauaugccgcugauaaagaaagcacccagaaggccaucgacggcgugaccaacaaaguuaauuccauuaucgauaagaugaacacacaguucgaggcugugggccgggaauuuaacaaucuggagcgcagaauugagaaccucaauaagaaaauggaagacggguuccuggaugucuggacguacaacgccgagcugcucgugcugauggaaaaugagcggacccuugacuuccacgauucuaacguuaagaaucuguaugacaaagugcgccuccaacugagagauaacgccaaggaacuuggaaauggcuguuuugaguucuaccaucggugcgacaacgaguguauggaaagcgucagaaaugggacauacgauuauccccaguacuccgaggaagcucgccugaaacgggaggagaucagcggagugaagcucgaaucuauuggcaccuaucagauccuguccauuuacagcacagucgcgucuucccuggcccucgcuaucaugguggccgggcugagccuuuggaugugcuccaacggcucucugcagugcagaaucuguauuuga

SEQ ID NO: 197027 - RNA, 1707 nt, Artificial Sequence
  derived and/or modified sequence opt5 from hemagglutinin__InfluenzaA__AGN69452
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugagagauugcagcguugcgggcuggcuccuggggaacccuaugugugacgaguuccugaaugugccggaaugguccuauaucgucgagaagauuaaccccgcuaaugaucucugcuacccuggaaacuuuaaugacuaugaggaacugaagcaucuucugucucggaucaaccacuucgagaaaauucagaucauucccaagagcuccuggucugaucaugaagccagcgccggcguguccagcgcuuguccuuaccaggggagaucuuccuuuuuccgcaauguuguguggcucaucaaaaaggacaacgccuaucccaccauuaaacggagcuacaauaacacaaaucaagaggaucugcuuguccuguggggaauccaccacccuaacgacgcugccgagcagacccgccucuaucagaacucuacaaccuacaucuccgugggcacgagcacccugaaucagagacuggugccgaagauugcgacacggucuaaggucaacggccaauccgggcgcaucgaauuuuucuggaccauucucaaacccaaugauacaaucaacuuugagagcaauggaaacuucauugccccugaaaaugcuuacaagaucguuaaaaagggcgacuccaccaucaugaaaucugagcuggaauaugggaacugcaauacgaagugucagacacccauuggagccaucaacagcuccaugccuuuucauaauauucacccccuuaccaucggcgagugcccgaaauacgugaaaagcucuagacuggugcucgcuacagggcugcggaacuccccucagggagagcgcagacggaagaaacgcggccuuuucggcgccauugcgggguuuaucgaaggaggcuggcaggggauggucgacggaugguauggcuaccaucacagcaaugagcaagggucuggauaugccgcugauaaggaaagcacccagaaagccaucgacggcgugaccaacaagguuaauuccauuaucgauaaaaugaacacacaguucgaggcugugggcagagaauuuaacaaucuggagcggcgcauugagaaccucaauaagaagauggaagacggguuccuggaugucuggacguacaacgccgagcugcucgugcugauggaaaaugagagaacccuugacuuccacgauucuaacguuaaaaaucuguaugacaaggugcggcuccaacugagagauaacgccaaagaacuuggaaauggcuguuuugaguucuaccaucgcugcgacaacgaguguauggaaagcguccggaaugggacauacgauuauccccaguacuccgaggaagcuagacugaagcgcgaggagaucagcggagugaaacucgaaucuauuggcaccuaucagauccuguccauuuacagcacagucgcgucuucccuggcccucgcuaucaugguggccgggcugagccuuuggaugugcuccaacggcucucugcagugccggaucuguauuuga

SEQ ID NO: 197028 - RNA, 1707 nt, Artificial Sequence
  derived and/or modified sequence opt5 from hemagglutinin__InfluenzaA__ABD73284
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucugugaucuggacggagugaaaccccuuauccugagagauugcagcguugcgggcuggcuccuggggaacccuaugugugacgaguuccugaaugugccggaaugguccuauaucgucgagaagauuaaccccgcuaaugaucucugcuacccuggaaacuuuaaugacuaugaggaacugaagcaucuucugucucggaucaaccacuucgagaaaauucagaucauucccaagagcuccuggucugaucaugaagccagcgccggcguguccagcgcuuguccuuaccaggggagaucuuccuuuuuccgcaauguuguguggcucaucaaaaaggacaacgccuaucccaccauuaaacggagcuacaauaacacaaaucaagaggaucugcuuguccuguggggaauccaccacccuaacgacgcugccgagcagacccgccucuaucagaacccgacaaccuacaucucugugggcacguccacccugaaucagagacuggugcccaagauugcgacacggagcaaggucaacggccaaucugggcgcauggaauuuuucuggaccauccucaaaccuaaugaugccauuaacuuugaguccaauggaaacuucaucgcucccgaaaaugccuacaagauuguuaaaaagggcgacagcacaaucaugaaauccgagcuggaauaugggaacugcaauaccaagugucagacgccuaucggagcuauuaacucuagcaugcccuuucauaauauccacccgcuuacaauuggcgagugcccuaaauacgugaaguccagcagacuggugcucgccaccgggcugcggaacucuccccagggagagcgcagacggaagaaacgcggccuuuucggcgcgaucgccggguuuauugaaggaggcuggcaggggauggucgacggaugguauggcuaccaucacuccaaugagcaagggagcggauaugcugccgauaaggaaucuacacagaaagcuaucgacggcgugaccaacaagguuaauagcaucauugauaaaaugaacacccaguucgaggccgugggcagagaauuuaacaaucuggagcggcgcaucgagaaccucaauaagaagauggaagacggguuccuggaugucuggacauacaacgccgagcugcucgugcugauggaaaaugagagaacgcuugacuuccacgauuccaacguuaaaaaucuguaugacaaggugcggcuccaacugagagauaacgcuaaagaacuuggaaauggcuguuuugaguucuaccaucgcugcgacaacgaguguauggaaucuguccggaaugggaccuacgauuauccucaguacagcgaggaagcgagacugaagcgcgaggagauuuccggagugaaacucgaaagcaucggcacauaucagauucugucuaucuacuccaccgucgccagcucucuggcucucgccauuaugguggccgggcugucccuuuggaugugcagcaacggcucccugcagugccggaucuguaucuga

SEQ ID NO: 197029 - RNA, 1695 nt, Artificial Sequence
  derived and/or modified sequence opt5 from hemagglutinin__InfluenzaA__ABF93440
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugagagauugcagcguugcgggcuggcuccuggggaacccuaugugugacgaguuccugaaugugccggaaugguccuauaucgucgagaagauuaaccccgcuaaugaucucugcuacccuggaaacuuuaaugacuaugaggaacugaagcaucuucugucucggaucaaccacuucgagaaaauucagaucauucccaagagcuccuggucugaucaugaagccagcuccggcgugagcucugccuguccuuaccaggggcgcuccagcuuuuucagaaauguuguguggcucaucaaaaaggacaacgcuuaucccaccauuaaacggucuuacaauaacacaaaucaagaggaucugcuuguccuguggggaauccaccacccuaacgacgccgcugagcagacccgccucuaucagaacccgacaaccuacaucuccgugggcacgagcacccugaaucagagacuggugcccaagauugccacacggucuaaggucaacggccaauccgggcgcauggaauuuuucuggaccauccucaaaccuaaugaugcgauuaacuuugagagcaauggaaacuucaucgcccccgaaaaugcuuacaagauuguuaaaaagggcgacuccacaaucaugaaaucugagcuggaauaugggaacugcaauaccaagugucagacgccuaucggagccauuaacagcuccaugcccuuucauaauauccacccgcuuacaauuggcgagugcccuaaauacgugaaaagcaacagacuggugcucgcuaccgggcugcgcaauucuccccagaucgagacacggggacuuuucggcgccauugcgggcuuuaucgaagggggauggcagggcauggucgacgggugguauggauaccaucacuccaacgagcaaggcagcggguaugccgcugauaaggaaucuacccagaaagccaucgacggagugaccaauaagguuaacagcauuaucgauaaaaugaacacacaguucgaggcugugggcagagaauuuaauaaccuggagcggcgcauugagaaucucaacaagaaaauggaagacggcuuccuggaugucuggacguacaaugccgagcugcucgugcugauggaaaacgagagaacccuugacuuccacgauuccaauguuaagaaccuguaugacaaggugcggcuccaacugcgcgauaaugccaaagaacuugggaacggauguuuugaguucuaccauagaugcgacaaugaguguauggaaucuguccggaacggcacauacgauuauccucaguacagcgaggaagcuagacugaagcgcgaggagaucuccggggugaaacucgaaagcauuggaaccuaucagauccugucuauuuacuccacagucgcgagcucucuggcccucgcuaucaugguggccggccugucccuuuggaugugcagcaaugggucccugcagugccggaucuguauuuga

SEQ ID NO: 197030 - RNA, 1701 nt, Artificial Sequence
  derived and/or modified sequence opt5 from hemagglutinin__InfluenzaA__AKC45369
auggagaagaucgugcugcuccuggccgucguuagccuugugaaauccgaccagauuugcaucggcuaccacgcuaacaauucuaccgaacaaguggauacaauuauggagaagaacgucacggugacccaugcccaggacauccuggagaaaacacacaaugggagacucugugaucugaacggaguuaagccccuuauucugaaagacugcagcguggcgggcuggcuccuggggaauccuaugugugaugaguucauccgggucccggaaugguccuauaucguggagcgcgcuaaccccgccaaugaccugugcuacccuggaaaccucaaugauuaugaggaacugaagcaucuucugucuagaauuaaccacuuugagaagacccucaucauucccaaaagcuccuggccuaaucauacaucuagcggcguuuccgccgcuugucccuaccaggggaccccuagcuucuuucggaacguggucuggcugacaaagaaaaaugacgccuauccgaccaucaagaugucuuacaacaauacgaaccgcgaagaucuucugauucucuggggaauccaccacuccaacaaugcugccgagcagaccaaccuguauaaaaaucccacaaccuacgugagcgugggcacaucuacccugaaccaaagacucgucccuaagauugcgacgcggucccagguuaauggccagcgcgggagaauggacuucuuuuggacaauccugaagcccaacgaugccauccauuucgagagcaauggaaacuuuauugcuccugaauacgccuauaaaaucgugaagaaaggcgacucuaccauuaugaaguccgagauggaauacgggcacugcaauacaaaaugucagacccccaucggagcuauuaacagcuccaugccguuccauaauauccacccucuuaccaucggcgagugccccaaguaugugaaaucuaacaagcugguccucgccacagggcugcggaauagcccucuucgcgaaagacggcgcaagagaggacuguuuggcgcgauugccggcuucaucgaagggggauggcaaggcaugguggaugggugguacggauaucaccauuccaacgagcagggcagcggguacgcugccgaccgggaaucuacgcagaaagcuauugacggaguuaccaauaaggugaacuccaucauugauaaaaugaacacacaguuugaggccgucggccgcgaguucaauaaccucgaaagacggaucgaaaaucugaacaagaaaauggaggacggcuuucuggauguguggaccuauaaugccgagcuccugguucuuauggaaaacgagagaacacuggacuuccacgauagcaaugugaagaaccucuacgacaagguccgccugcaacuucgggauaaugcuaaagaacuggggaacggauguuucgaguuuuaccauaagugcgacaaugaauguauggagucugugagaaacggcaccuaugauuacccccaguauagcgaggaagcgcgccucaaacgggaggaaaucuccggggucaagcuggagucuauuggaacguaccagauccugagcauuuauuccacaguggccagcucucucgcucuggccaucauuguugccggccuuucccuguggaugugcagcaaugggucucuccaaugcagaaucuguauuuga

SEQ ID NO: 197031 - RNA, 1704 nt, Artificial Sequence; identical to SEQ ID NO: 195982
  derived and/or modified sequence opt5 from hemagglutinin__InfluenzaA__AJS18479

SEQ ID NO: 197032 - RNA, 1704 nt, Artificial Sequence
  derived and/or modified sequence opt5 from hemagglutinin__InfluenzaA__EPI691378
auggagaagaucgugcugcuccuggccgucguuagccuugugaaauccgaccagauuugcaucggcuaccacgcuaacaauucuaccgaacaaguggauacaauuauggagaagaacgucacggugacccaugcccaggacauccuggagaaaacacacaaugggagacucugugaucugaacggaguuaagccccuuauucugaaagacugcagcguggcgggcuggcuccuggggaauccuaugugugaugaguucauccgggucccggaaugguccuauaucguggagcgcgcuaaccccgccaaugaccugugcuacccuggaaaccucaaugauuaugaggaacugaagcaucuucugucuagaauuaaccacuuugagaagacccucaucauucccaaaagcuccuggccuaaucaugaaacaucucugggcguuagcgccgcuugucccuaccagggggugccuuccuucuuucggaacgucguguggcuuaccaagaaaaaugacgccuauccgacaaucaagaugagcuacaacaauaccaaccgcgaggaucugcucauucuguggggaauccaccacucuaacaaugcugccgagcagacgaaccuguauaaaaaucccaccacauacguguccgucggcaccagcacacucaaccaaagacugguuccuaagauugcgacccggucucaggugaauggccagcgcgggagaauggacuucuuuuggacgauccuuaagcccaacgaugccauccauuucgaauccaauggaaacuuuauugcuccugaguacgccuauaaaaucgugaagaaaggcgacagcacaauuaugaagucugaaauggaguacgggcacugcaauaccaaaugucagacacccaucggagcuauuaacuccagcaugccguuccauaauauccacccucugaccaucggcgaaugccccaaguaugucaaauccaacaagcucgugcuggccaccgggcuucgcaauucuccucugcgggagagacggcgcaagagaggacucuuuggcgcgauugccggcuucaucgaagggggauggcaaggcaugguugaugggugguacggauaucaccauagcaacgaacagggcuccggguacgcugccgaccgggagagcacacagaaagcuauugacggagugacgaauaaggucaacucuaucauugauaaaaugaacacccaguuugaagccgugggccgcgaguucaauaaccuggaaagacggaucgagaaucugaacaagaaaauggaggacggcuuucucgauguuuggacauauaaugccgaacugcuugugcugauggagaacgaaagaacccucgacuuccacgauuccaaugucaagaaccuguacgacaaggugcgccuucaacugcgggauaaugcuaaagagcucgggaacggauguuucgaauuuuaccauaagugcgacaaugaguguauggagagcgucagaaacggcacauaugauuacccccaguauucugaagaggcgcgccugaaacgggaagagaucagcggggugaagcuggaguccauuggaaccuaccagauccucucuauuuauagcacgguugccuccagccuggcucuugccaucauuguggccggccugucucucuggaugugcuccaaugggagccugcaaugcagaaucuguauuuga

SEQ ID NO: 197033 - RNA, 1704 nt, Artificial Sequence
  derived and/or modified sequence opt5 from hemagglutinin__InfluenzaA__EPI533583
auggagaagaucgugcugcuccuggccauugucagccuuguuaaaggcgaccagaucugcauuggguaccacgcuaacaauuccaccgaacaaguggauacaaucauggagaagaacgugacggucacccaugcccaggacauucuggaaaagacacacaauggaaagcucugugaucugaacggcgugaaaccccuuauccugaaggacugcucuguugcgggguggcuccugggaaauccuaugugugaugaguucaucagagugccggaauggagcuauauugucgagcgggcuaaccccgccaaugaccugugcuacccuggcaaccucaaugauuaugaggaacugaagcaucuucugucccgcaucaaccacuuugagaaaauucucaucauucccaagucuagcuggaccaaucaugaaacaucccugggggugucugccgcuuguccuuaccagggaacccccagcuucuuuagaaacguuguguggcuuaucaaaaagaaugacgccuauccuacaauuaaaaucuccuacaacaauaccaaccaggaggaucugcucauccuguggggcguccaccacagcaacaaugcugccgagcaaacgaaccuguauaagaauccgaccacauacauuucugugggcaccuccacacucaaccagcggcuggugcccaagaucgcgacccgcagccaggucaaugggcagagaggacggauggacuucuuuuggacgauucuuaaaccuaacgaugccauccauuucgaaucuaauggcaacuuuauugcucccgaguacgccuauaagaucguuaaaaagggggacuccacaaucaugaaaagcgaaauggaguacggacacugcaauaccaagugucaaacaccuauuggcgcuaucaacucuuccaugcccuuccauaauauucacccgcugaccaucggggaaugcccuaaauaugugaaaagcaacaagcucgugcuggccaccggacuucgcaauucuccccugagagagaaacggcgcaagagaggccucuuuggcgcgauugccggguucaucgagggaggcuggcaggggauggucgauggaugguacggcuaucaccauuccaacgaacaggggagcggauacgcugccgacaaagaguccacacagaaggcuaucgacggcgugacgaauaaaguuaacagcauuaucgauaagaugaacacccaauuugaagccgugggccgggaguucaauaaccuggaacgcagaauugagaaucugaacaagaaaauggaggacggguuucucgaugucuggacauauaaugccgaacugcuugugcugauggagaacgaacggacccucgacuuccacgauucuaauguuaagaaccuguacgacaaagugcgccuucagcugagagauaaugcuaaggagcucggaaacggcuguuucgaauuuuaccauaaaugcgacaauaaguguauggaguccguccggaacgggacauaugauuacccucaguauagcgaggaagcgagacugaagcgcgaggaaaucucuggagugaaacuggagagcauuggcaccuaccaaauccucuccauuuauucuacggucgccagcucccuggcucuugccaucaucguggccgggcugagccucuggaugugcucuaauggcucccugcagugccggauuuguaucuga

SEQ ID NO: 197034 - RNA, 1701 nt, Artificial Sequence; identical to SEQ ID NO: 195995
  derived and/or modified sequence opt5 from hemagglutinin__InfluenzaA__AKS48023

SEQ ID NO: 197035 - RNA, 1701 nt, Artificial Sequence
  derived and/or modified sequence opt5 from hemagglutinin__InfluenzaA__EPI587621
auggagaagauggugcugcuccuggccgcugucagccuuguuaaauccgaccagaucugcauuggcuaccacgccaacaauucuaccgaacaaguggauacaaucauggagaagaacgugacggucacccaugcgcaggacauucuggagaaaacacacaaugggagacucugugaucugaacggagugaagccccuuauccugaaagacugcagcguugcuggcuggcuccuggggaauccuaugugugaugaguucauucgggugccggaaugguccuauaucgucgagcgcgccaaccccgccaaugaccugugcuacccuggaaaccucaaugauuaugaggaacugaagcaucuucugucuagaaucaaccacuuugagaagacccucauuauccccaaaagcuccuggccuaaucauacaucuagcggcguguccgcugccugucccuaccaggggaugccuagcuucuuucggaacguuguguggcugaccaagaaaaaugacgcuuauccgacaauuaagaugucuuacaacaauaccuaucgcgaagaucuucugauccucuggggcauucaccacuccaacaacgccgcggagcagacgaaucuguacaaaaaccccaccacauacgucagcgugggaaccucuacacugaaucaaagacucgagccuaagaucgccacccggucccaggugaacggccagcgcgggagaauggacuucuuuuggacgauucugaagcccaaugaugcuauccauuucgaaagcaacggaaauuuuaucgccccugaguaugcuuacaaaauugucaagaaaggcgacucuacaaucaugaaguccgaaauggaguaugggcacugcaacaccaaaugucagacacccauuggagccaucaauagcuccaugccguuccauaacauucacccucuuaccaucggcgaaugccccaaguacguuaaaucuaauaagcuggugcucgcgaccgggcugcggaacagcccucuucgcgagagacggcgcaagagaggacuguuuggcgccaucgcuggcuucauugaagggggauggcaaggcaugguggaugggugguauggauaccaccauuccaaugaacagggcagcggguaugccgcugaccgggagucuacacagaaagccaucgacggagucacgaacaagguuaauuccauuaucgauaaaaugaacacccaguuugaagccgugggccgcgaguucaacaaucucgaaagacggauugagaaccugaauaagaaaauggaggacggcuuucuggauguguggacauacaacgcugaacuccugguccuuauggagaaugaaagaacccuggacuuccacgauagcaacgugaagaaucucuacgacaagguucgccugcaacuucgggauaacgcgaaagagcuggggaauggauguuucgaauuuuaucauaagugcgacaacgaguguauggagucugugagaaauggcacauacgauuauccccaguacagcgaagaggcccgccucaaacgggaagagaucuccggggucaagcuggagucuaucggaaccuaucagauucugagcaucuacuccacgguggcuagcucucucgcccuggccauuaucgucgcuggccuuucccuguggaugugcagcaacgggucucuccaaugcagaauuuguaucuga

SEQ ID NO: 197036 - RNA, 1704 nt, Artificial Sequence
  derived and/or modified sequence opt5 from hemagglutinin__InfluenzaA__AJE30333
auggagaagaucgugcugcuccuggccgucauuagccuuguuaaauccgaccagaucugcauuggcuaccacgcuaacaauucuaccaagcaaguggauacaaucauggaaaagaacgugacggucacccaugcccaggacauucuggagaagacacacaaugggaaacucugugaucugaacggagugaagccccuuauccugaaggacugcagcguugcgggcuggcuccuggggaauccuaugugugaugaguucaucagagugccggagugguccuauauugucgaacgggcuaaccccgccaaugaccugugcuacccuggaacccucaacgauuaugaggagcugaaacaucuucugucucgcaucaaucacuuugaaaagacacucauuauccccagaagcuccuggccuaaccaugagaccucucugggcgugagcgccgcuugucccuaccagggggccuccagcuucuuucggaauguuguguggcuuauuaaaaagaacgacgcuuauccuacaaucaaaauuucuuacaauaacaccaaucgcgaagaucugcucauccuguggggaauccaccacuccaacaacgccgcggagcagacgaaucuguauaagaacccggacaccuacgucagcgugggcacaucuacccucaaucaaagacuggugcccaagauugccacacggucccaggucaacggccagagcgggcgcauggauuucuuuuggaccauccuuaaaccuaaugacgcuauucauuucgagucuaacggaaauuuuaucgcccccgaauacgcuuauaagauuguuaaaaagggcgauuccacgaucaugaaaagcgagauggaauacgggcacugcaacacaaagugucagaccccuaucggagccauuaauuccucuaugcccuuccauaacauccacccgcugacaauuggcgagugcccuaaauaugugaaaagcaauaagcucgugcuggcgaccgggcuuagaaacagcccccugcgggaacgcagacggaaacgcggacucuuuggcgccaucgcuggcuucauugaagggggauggcaaggcauggucgacgggugguacggauaucaccauuccaaugagcagggcucuggguacgccgcugacaaggaauccacccagaaagccaucgauggagugacaaacaagguuaauagcaucauugacaaaaugaacacgcaguuugaggccgugggcagagaguucaacaaucuggaacggcgcaucgaaaaccugaauaagaagauggaggauggcuuucucgacgucuggaccuauaacgcugagcugcuugugcugauggaaaaugagagaacacucgauuuccacgacucuaacguuaaaaaucuguacgauaaggugcggcuucaacugagagacaacgcgaaagaacucgggaauggauguuucgaguuuuaccauaagugcgauaacgaauguauggagagcguccgcaauggcaccuaugacuacccuaaauauuccgaggaagccauucugaagcgggaggaaaucucuggggugaagcuggagagcauuggaacauaccagauccucuccauuuauagcaccgucgcuucuucccuggcccuugccaucaucguggcuggccugagccucuggaugugcucuaacgggucccugcagugcagaauuuguaucuga

SEQ ID NO: 197037 - RNA, 1704 nt, Artificial Sequence
  derived and/or modified sequence opt5 from hemagglutinin__InfluenzaA__EPI459855
augaucgccauuguggucaucgcuauucuggccagcgcgggcaaguccgacaagaucugcauuggguaccacgcuaacaauucuaccacacagguugauacgcuccuggagaagaacgugaccgugacacauagcgucgaacuucuggagaaucaaaaagaaaagagauucuguaaaaucaugaacaaggcuccccucgaccugaaggauugcaccaucgagggauggauucuuggcaauccuaaaugugaccugcuccugggggaucaguccuggucuuauaucguggaacggccgaacgcccagaauggaauuugcuaccccggcguucugaacgagcucgaggaacugaaggccuuuaucgggagcggagagcgcguggaaagauucgagauguuuccuaaauccacaugggccggcgucgacaccucucggggcgugacaaaugcuugucccagcuauaccauugauuccagcuucuaccgcaaccuuguuuggaucgugaagacggacucugccaccuauccugucauuaaagggacauacaauaacaccggaacacagcccauccuguauuuuuggggcgugcaccauccucucgauaccacggugcaagacaaucuguacggguccggagauaaguacgucagaaugggcacagagagcaugaacuucgcgaagucuccggaaaucgccgcucggcccgccguuaaugggcagcgcuccagaauugacuauuacuggagcgugcuucggccuggagagacccugaacguggaaucuaacggcaaucucaucgcucccugguaugccuacaaauuugucuccacaaacaagaaaggcgcgguguucaagagcgaucugccuauugagaauugcgacgccaccugucagaccaucacagggguucugcgcacgaacaaaaccuuucagaaugugucuccccucuggauuggagaaugcccgaaguaugucaaauccgagagccugagacuugcuacaggccugcggaacgugccucaaaucgccacccgcgggaucuucggagcuauugccggcuuuaucgagggaggguggacaggcaugauugacggcugguacggguaucaccaugaaaauucccagggaagcggcuacgccgcugauagagagucuacccagaaggcgaucgacgggauuacgaacaagguuaauuccaucaucaacaaaaugaauacacaguucgaagccguggaucacgaguuuagcaaccucgaacggcgcauuggaaaucugaacaagagaauggaggacggcuuccuugaugucuggaccuacaaugcugagcugcucgugcugcuggaaaacgagcggacccucgaccugcacgaugccaacgucaaaaaucuuuaugaaaaggugaaaucucaacugagagacaacgccaaugaucucgggaacggcuguuucgaguuuuggcauaagugcgacaaugaauguauggagagcguuaagaacggaacauacgauuaucccaaauaccagaaggaguccaaacugaaucgccagggcaucgaaucugugaaacuugagaaccugggggucuaucaaauucucgcuaucuacagcaccguguccagcucucugguucuggugggacucauuauggccaucggccuguggaugugcuccaaugggagcaugcagugccggauuuguaucuga

SEQ ID NO: 197038 - RNA, 1704 nt, Artificial Sequence; identical to SEQ ID NO: 197037
  derived and/or modified sequence opt5 from hemagglutinin__InfluenzaA__EPI459855/m1

SEQ ID NO: 197039 - RNA, 1692 nt, Artificial Sequence
  derived and/or modified sequence opt5 from hemagglutinin__InfluenzaA__ACZ36872
augaacacccagauccugguguucgcccucgucgcuguuauucacacaaaugccgacaagaucugccugggccaucacgcggugagcaacgggacgaaagugaauacccuuacagagagaggagucgaagugguuaacgcuaccgagacaguggaacggaccaauauucccaagaucuguuccaaaggcaagcgcacagucgaucuggggcaaugcggacuccugggcaccauuacggggccuccgcagugugaccaguuucuugaguucucugccgaucugaucaucgaaagacgggacggaaacgaugugugcuaccccggcaaauuuguuaauggcgaggcccuccgccagauucugagaaagagcgggggaaucaacaaggagaccaugggcuucacauauuccgggauucggaccaauggaacaaccucugcuugucgcagaagcggcuccucuuuuuacgccgaaaugaaauggcugcucagcgacacggauaacgcugccuucccucaaaugacaaaguccuauaaaaauacccggcgcgagcccgcgcugaucgugugggggauucaucacagcggaucuacaaccgaacagaccaaacuuuacggcuccggcaacaagcuggucacaguggggagcucuaaguaucagcaguccuuugugccuagccccggaacgagaccucaagucaauggccagucugggcggaucgacuuccauuggcucauucuggauuccaacgacaccguuacauuuagcuucaauggagccuuuaucgcuccggaucgcgccuccuuccuuaagggcaaaucuauggggauccagagcgacguccagguggaugcuaacugcgagggagaguguuaccacuccggcggcaccauuacaagcucucugcccuuucaaaacaucaauuccagagccguggggaagugcccucgguaugugaaacaggaaagccuccugcuggcgaccggaaugaagaacguucccgagcucccuaaaaagcgcagaaaacggggccuguucggggccauugcuggauucaucgaaaauggcugggaggggcuuguggacggcugguacggauuuagacaccagaacgcccaaggcgaagggacggcugccgacuacaagucuacacagagcgccauugaucagaucaccggaaagcugaaucgccucaucgagaaaaccaaccagcaauucgagcugauugacaaugaauuuacagaggucgaaaagcagaucggcaacgugauuaauuggacccgggauuccaucacagagguuuggucuuauaacgcugaacuucugguggcgauggagaaucagcauacgauugaccucgccgauagcgagaugaacaaacuguacgaaagaguccgcaagcagcugcgggagaaugcugaagaggacgggaccggauguuucgaaaucuuucacaaaugcgaugacgauuguauggccuccaucagaaacaauacauaugaccauagcaaguaccgcgaggaggccaugcaaaaccggauucagaucgaucccgugaagcucucuggcggguauaaagacgucauucugugguucuccuuuggcgcuagcugcuuccuucugcucgccaucgcgaugggacugguguuuauuugcguuaagaacggcaauaugagauguaccaucugcauuuga

SEQ ID NO: 197040 - RNA, 1692 nt, Artificial Sequence
  derived and/or modified sequence opt5 from hemagglutinin__InfluenzaA__AGB51388
augaacacccagauccugguguucgcccucgucgcuguuauucacacaaaugccgacaagaucugccugggccaucacgcggugagcaacgggacgaaagugaauacccuuacagagagaggagucgaagugguuaacgcuaccgagacaguggaacggaccaauauucccaagaucuguuccaaaggcaagcgcacagucgaucuggggcaaugcggacuccugggcaccauuacggggccuccgcagugugaccaguuucuugaguucucugccgaucugaucaucgaaagacgggacggaaacgaugugugcuaccccggcaaauuuguuaauggcgaggcccuccgccagauucugagaaagagcgggggaaucaacaaggagaccaugggcuucacauauuccgggauucggaccaauggaacaaccucugcuugucgcagaagcggcuccucuuuuuacgccgaaaugaaauggcugcucagcgacacggauaacgcugccuucccucaaaugacaaaguccuauaaaaauacccggcgcgagcccgcgcugaucgugugggggauucaucacagcggaucuacaaccgaacagaccaaacuuuacggcuccggcaacaagcuggucacaguggggagcucuaaguaucagcaguccuuugugccuaaucccgagacgagaccucaagucaacggacagagcggccggaucgacuuccauuggcucauucuggauucuaaugacaccguuacauuuuccuucaacggggccuuuaucgcuccggaucgcgccagcuuccuuaagggaaaauccaugggcauccagucugacguccagguggaugcuaacugcgagggggaauguuaccacagcggaggcaccauuacauccagccugcccuuucaaaauaucaacucuagagccgugggcaagugcccucgguaugugaaacaggagucccuccugcuggcgaccgggaugaagaauguucccgaacucccuaaaaagcgcagaaaacggggacuguucggcgccauugcuggguucaucgagaacggaugggaaggccuuguggacgggugguacggcuuuagacaccagaaugcccaaggagagggcacggcugccgacuacaagagcacacagucugccauugaucagaucaccgggaagcugaaccgccucaucgagaaaaccaaucagcaauucgaacugauugacaacgaguuuacagaagucgagaagcagaccggaaaugugaucaacuggacacgggauagcauuacggaaguuugguccuauaaugcugagcuucugguggcgauggagaaccagcauaccaucgaccucgccgauucugaaaugaauaaacuguacgagagaguccgcaagcagcugcgggaaaacgcugaggaagacggcacaggguguuucgagauuuuucacaaaugcgaugacgauuguauggccagcaucagaaauaacaccuaugaccauuccaaguaccgcgaggaagccaugcaaaaccggauccagauugaucccgugaagcucagcggaggcuauaaagacgucauccugugguucucuuuuggggcuuccugcuuccuucugcucgccauugcgaugggccugguguuuaucugcguuaagaauggaaacaugagauguacaauuugcaucuga

SEQ ID NO: 197041 - RNA, 1683 nt, Artificial Sequence; identical to SEQ ID NO: 193012
  derived and/or modified sequence opt5 from hemagglutinin__InfluenzaA__EPI439507

SEQ ID NO: 197042 - RNA, 1704 nt, Artificial Sequence
  derived and/or modified sequence opt5 from hemagglutinin__InfluenzaA__EPI164216
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugagagauugcagcguugcgggcuggcuccuggggaacccuaugugugacgaguucaucaaugugccggaaugguccuauauugucgagaaggcuaaccccgccaaugaucugugcuacccuggaaacuuuaaugacuaugaggaacucaagcaucugcuuucucggaucaaccacuucgagaaaauucagaucauucccaagagcuccuggucugaucaugaagccagcuccggcgugagcucugcuuguccuuaccaggggacccccuccuuuuuccgcaauguuguguggcugaucaaaaagaacaauacauauccuaccauuaaaagaagcuacaacaauacaaaccaagaggaccuccugauccuuuggggaauccaccacucuaacgaugccgcugagcagaccaagcuguaucagaauccgacgaccuacauuuccgucggcacaagcacccucaaccagcggcuggugcccaagaucgccacacgcucuaaagugaauggccaauccgggagaauggacuuuuucuggaccauucugaagccuaacgaugcgaucaauuuugaaagcaacggaaauuucauugcccccgaguacgcuuauaaaaucgucaagaaaggcgacuccgccaucguuaagucugaaguggaguacgggaacugcaauacgaaaugucagacaccuauuggagcuaucaacagcuccaugcccuuucauaauauucacccgcucaccaucggcgaaugcccuaaguaugugaaaagcaacaaacugguccuugccacagggcugcgcaauucuccccuccgggagagacggcgcaagagaggacuguucggcgcgauugccggcuuuaucgaagggggauggcagggcaugguggacgggugguacggauaucaucacuccaacgaacagggcagcggguacgcugccgauaaagagucuacccaaaaggcuaucgacggaguuaccaauaaagugaacagcauuaucgauaagaugaacacacaguucgaagccgucggccgggaguuuaauaaccuugaacgcagaauugagaaucugaacaagaaaauggaggacggcuuccucgauguguggacguauaaugccgaacugcugguucucauggagaacgaacggacccuggacuuccacgauuccaaugugaagaaccuuuacgacaaaguccgccugcagcucagagauaaugcuaaggagcuggggaacggauguuuugaguucuaccauaaaugcgacaaugaguguauggagucugugcggaacggcacauaugauuacccucaauauagcgaagaggcgagacuuaagcgcgaagagaucuccggggucaagcuggagagcauuggaaccuaccagauccucucuauuuauuccacaguggccagcucucuggcucuggccaucaugguugccggccucucccuguggaugugcagcaaugggucccuucagugccggaucuguauuuga

SEQ ID NO: 197043 - RNA, 1683 nt, Artificial Sequence; identical to SEQ ID NO: 195375
  derived and/or modified sequence opt5 from hemagglutinin__InfluenzaA__EPI486492

SEQ ID NO: 197044 - RNA, 1683 nt, Artificial Sequence
  derived and/or modified sequence opt5 from hemagglutinin__InfluenzaA__EPI740738
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccaauauuccucgcaucuguuccaagggcaaaagaacaguugaucuggggcaaugcggacuccugggcaccaucacggggccgccccagugugaccaguuucuugaguucucugccgaucugauuaucgaacggcgcgagggaagcgacgugugcuacccuggcaaguuugucaacgaggaagcccucagacagauucugcgggaguccggcgggaucgauaaagaaaccaugggauucacauauucuggcauucgcaccaauggggugacaagcgcuuguaagagauccggaucuagcuuuuacgccgagaugaaguggcugcucuccaacaccgacaaugcugccuucccccaaaugacgaaaagcuauaagaacacacggaaaucuccugcgaucauuguuuggggcauccaccauuccgugagcaccgccgagcagacaaagcuguacgggucuggaaauaaacuugucaccgugggcuccagcaacuaucagcagucuuuugugcccuccccuggcgcucgcccgcaagucaaugggcugagcggaagaaucgauuuccacuggcucauucugaaccccaaugacaccguuacauuuuccuucaacggcgccuuuaucgcuccugaucgggccucuuuccuucgcggaaagagcauggggauucaguccggcguccagguggacgcgaacugcgaaggggauuguuaccauagcggaggcacgaucauuucuaaucugcccuuucagaacaucgacuccagagccgugggcaagugcccucgguaugugaaacaacgcagccuccugcuggcuaccgggaugaagaauguucccgagaucccgaaaggaagaggccucuucggggccauugcuggauucaucgaaaacggcugggaggggcugauugauggcugguacggauuucggcaccagaaugcccagggcgaagggacagccgcugacuacaagucuacccaaagcgcgaucgaccagauuacaggaaaacuuaacagacugaucgccaagaccaaucagcaguucgagcucaucgauaacgaguuuaaugaaguggagaaacaaauuggcaacgucaucaauuggacgcgcgacuccauuacagaaguguggucuuauaacgcugagcugcuuaucgccauggaaaaucagcacaccauugaucuggccgacagcgagauggauaagcucuacgagcggguuaagagacagcugcgcgaaaacgcugaggaagacgggaccggauguuucgagaucuuucauaaaugcgaugacgauuguauggccuccauucggaauaacacauaugaccacagaaaguaccgcgaagaggcgaugcagaaccggauccaaaucgauccugugaaacugagcucuggcuauaaggacgucauucucugguucuccuuuggggcuagcugcuucauccugcuugccauugugaugggccuggucuuuaucugcgugaaaaauggaaacaugagauguaccauuugcaucuga

SEQ ID NO: 197045 - RNA, 1683 nt, Artificial Sequence
  derived and/or modified sequence opt5 from hemagglutinin__InfluenzaA__EPI730495
augaacauccagauucugguguucgcccucaucgcuauuauccccaccgacgccgauaagauuugccugggccaccaugcggucagcaaugggacaaaaguuaacacgcuuaccgagagaggaguggaaguggucaaugcuacagagaccguggaacggacaaacaucccucgcaucuguuccaagggcaaaagaaccguugaccuggggcaaugcggacuccugggcacaauuaccgggccgccccagugugaucaguuucuugaguucucugccgaccugaucauugaacggcgcgagggaagcgaugugugcuacccuggcaaguuugucaaugaggaagcccucagacagauccugcggaaauccggcgggauugacaaggaggcuaugggauucacguauucuggcauccgcaccaacggggccacaagcgcuuguagacgguccggaucuagcuuuuacgccgaaaugaaguggcugcucuccaauaccgauaacgcggccuucccccaaaugacaaaaagcuauaagaauacccgcaaaucuccugcuauuaucguguggggcauccaccauuccguuagcacggccgagcagacaaagcuguacgggucuggauccaaacuugugaccgucggcagcucuaacuaucagcaguccuuugugcccagcccuggcgcuagaccgcaagugaaugggcuguccggacggauugacuuccacuggcucauccugaaccccaaugauacagucaccuuuucuuucaacggcgccuuuauugcgccugaccgcgccagcuuccuuagagggaaguccaugggaauccagagcggcguucagguggaugcugacugcgagggggauuguuaccauucuggaggcaccauuaucuccaaucugcccuuucagaacaucgacagccgggccgugggcaagugcccucgcuaugucaaacaaagaucucuccugcuggcuacagggaugaagaacgugcccgaaauuccgaaaggacggggccucuucggggccaucgccggauucauugagaauggcugggaagggcugaucgacggcugguacggauuuagacaccagaacgcucagggcgaggggacggcggccgauuacaagagcacccaauccgcuauugaccagaucacaggaaaacuuaaucgccugaucgaaaagaccaaccagcaguucgagcucauugauaaugaguuuaucgaaguugagaaacaaauuggcaacgugaucaauuggacacgggacucuauuaccgaagucuggagcuauaacgccgagcugcuuguggccauggaaaaucagcacacgaucgaucuggcugacuccgagauggauaagcucuacgagagaguuaagcgccagcugcgggaaaacgccgaggaagacgggacaggauguuucgagauuuuucauaaaugcgaugacgauuguauggcgagcaucagaaauaacaccuaugaccacucuaaguaccgcgaagaggcuaugcagaaucggauccaaauugacccugugaaacuguccagcggcuauaaggaugucauccucugguucucuuuuggggccuccugcuucauucugcccgccaucgugaugggccuugucuuuaugugcgugaaaaacggaaauaugagauguaccauuugcaucuga

SEQ ID NO: 197046 - RNA, 1683 nt, Artificial Sequence
  derived and/or modified sequence opt5 from hemagglutinin__InfluenzaA__EPI712926
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccaauauuccucgcaucuguuccaagggcaaaagaacaguugaucuggggcaaugcggacuccugggcaccaucacggggccgccccagugugaccaguuucuugaguucucugccgaucugauuaucgaacggcgcgagggaagcgacgugugcuacccuggcaaguuugucaacgaggaagcccucagacagauucugcgggaguccggcgggaucgauaaagaaaccaugggauucacauauaauggcauucgcaucaacggggugaccucugcuuguaagagaagcggauccucuuuuuacgccgagaugaaguggcugcucagcaauacagacaacgcugccuucccccaaaugaccaaauccuauaagaauacgcggaaaagcccugcgauuaucguuuggggcauccaccauucuguguccacagccgagcagaccaagcuguacgggagcggaaacaaacuugucacagugggaucuuccaauuaucagcagagcuuugugcccucuccuggcgcucgcccgcaagucaacgggcuguccggaagaauugauuuccacuggcucauccugaaucccaacgacaccguuaccuuuagcuucaacggcgccuuuauugcuccugaucgggccuccuuccuucgcgggaagucuaucggcauucagagcggcguccagguggacgcgaauugcgaaggggauuguuaccauuccggaggcacaaucaucagcaaccugcccuuucagaauauugacucuagagccgugggcaagugcccucgguaugugaaacaacgcucccuccugcuggcuacggggaugaagaacguucccgagaucccgaaaggaagaggccucuucggggccauugcuggauucaucgaaaauggcugggaggggcugauugauggcugguacggauuucggcaccagaacgcccagggcgaagggaccgccgcugacuacaagagcacacaaucugcgaucgaccagaucaccggaaaacuuaauagacugauugccaagacaaaccagcaguucgagcucaucgauaaugaguuuaacgaaguggagaaacaaauuggcaaugucaucaacuggacccgcgacagcauuacggaagugugguccuauaaugcugagcugcuuaucgccauggaaaaccagcacacaauugaucuggccgacucugagauggauaagcucuacgagcggguuaagagacagcugcgcgaaaaugcugaggaagacgggaccggauguuucgagaucuuucauaaaugcgaugacgauuguauggccagcauccggaacaacaccuaugaccacagaaaguaccgcgaagaggcgaugcagaaucggauucaaaucgauccugugaaacuguccagcggcuauaaggacgucauucucugguucucuuuuggggcuuccugcuucauccugcuugccauugugaugggccuggucuuuaucugcgugaaaaacggaaauaugagauguacaaucugcauuuga

SEQ ID NO: 197047 - RNA, 1683 nt, Artificial Sequence; identical to SEQ ID NO: 193012
  derived and/or modified sequence opt5 from hemagglutinin__InfluenzaA__AGL44438

SEQ ID NO: 197048 - RNA, 1683 nt, Artificial Sequence
  derived and/or modified sequence opt5 from hemagglutinin__InfluenzaA__EPI445996
auggagaccgugagccugaugacaauccuccugcuugucacgaccuccaacgccgacaagauuugcaucggccaccagucuacaaauagcaccgaaacaguugauacccugacagagaccaacgugcccgugacgcaugcuaaagaacuccugcacaccgaccauaaugggaugcuuugugccacaaaccugggacacccucucauucuggauaccugcaaugucgagggccugaucuacgggaacccguccugugaccuccugcuuggaggcagagaauggucuuauauuguggagcggcccagcgcgguuaaugggacaugcuacccuggaaacguggagaaucuggaggaacuccgcacccuguucuccucuagcuccagcuaucaaagaauccagaucuuucccgauacgauuuggaacgucacauacaccggcacaucuaaguccuguagcgacucuuucuaucggaauaugcgcuggcuuacccagaaaaacggccuguacccugugcaggaugcucaauuuaccaauaacagagggaaggacauccucuucguuuggggcauucaucaucccccuacagauacggcccagaccaaucuguauacacggaccgacacaaccacguccgugacaaccgaaaaccuggaucgcaccuuuaaaccgcucaucggacccagaccucuggucaacgggcuuauuggacggaucaauuacuacuggagcgugcugaagcccggccagacacuccgcgugagaucuaacgggaaucugauugccccuugguauggacacguccuuuccggcgagagccacggccggauccugaagaccaaccucaauuccgggaacugcguugugcagugucaaacagagaaaggaggccucaauucuacgcugcccuuccacaacaucagcaaguacgcuuuugggaauugcccgaaauauauuggagugaagucccugaaacuggccaucggccuucgcaacgucccugcuaagagcucuagagggcuguucggagccauugcgggcuuuaucgaaggcggguggcccggacucguggccggcugguacggguuccagcauuccaaugaccagggaguuggcauugcugccgaucgggugagcacccagaaggcugucgacaaaaucacaucuaaggugaacaauaucguugacaaaaugaacaagcaauaugagauuaucgaucacgaauuuagcgagguggaaacccgccugaauaugauuaacaacaaaaucgacgaucagauucaggacgucugggccuacaaugcggagcuucuggugcuccuggagaaccaaaagacacuggaugaacacgacgccaaugucaacaaucucuauaacaaagugaagagagcucugggguccaaugcccuugaggauggcaagggauguuucgaacuguaccauaaaugcgacgaucaguguauggagaccauccggaacggcacguacaauagacgcaaguaucaggaagagucucggcucgagagacagaaaaucgaagggauuaagcuggagagcgaaggaaccuacaaaauccugacaauuuauuccaccguugcuagcucucuugugcucgccaugggcuuugccgcuuuccuguucugggcgauguccaacgggagcugccgcugcaauaucuguauuuga

SEQ ID NO: 197049 - RNA, 1695 nt, Artificial Sequence
  derived and/or modified sequence opt5 from hemagglutinin__InfluenzaA__EPI433309
auggagaagaucgugcugcuccuggccauugcuagccuugucaaauccgaccagaucugcauuggcuaccacgccaacaauucuaccgaacaaguugauacaaucauggagaagaacgugacggugacccaugcgcaggacauucuggagaaaacacacaaugggaagcucugugaucuggacggagucaaaccccuuauccugagagauugcagcguggcuggcuggcuccuggggaacccuaugugugacaaguucaaugauguuccggaaugguccuauaucguggaaaaggccaaccccgccaaugaccugugcuacccuggaaaccucaaugauuaugaggagcugaaacaucuucugucucggauuaaccacuuugaaaagauccagaccuuccccaaaagcuccuggucugaccaugaggcuagccucggcgucuccgccgcuuguccuuaccaggggaugcccagcuuuuuccgcaaugugguuuggcugauuaagaaaaacaauacauauccuaccaucaagucuuccuacaacaauacaaaccaagaagaucuucugauucucuggggaauccaccacagcaacgacgaggccgagcagaccagacuguaucaaaauucuaacacguacauuuccgugggcaccagcacacugaaucagcggcucgucccgaagaucgcgacccgcucuaaagugaacggccaguccgggagaauggauuucuucuggacaauccugaagcccaaugacgccauuaacuuugaaagcaauggaaacuucaucgcuccugaguacgccuauaaaauugugaagaaaggcgacuccgcuaucaugaagucugaagucggguacggagauugcaauaccaaaugucagacgcccauuggcgccaucaacagcuccaugccuuuucauaauauccacccccuuacaauuggggagugcccgaaguauguuaagagcaacaaacuggugcucgcgaccggacugcgcaauucuccucagaucgaaacacggggccuuuucggcgccauugcuggguuuaucgagggaggcuggcaggggaugguggacggaugguacggcuaucaucacuccaacgagcaagggagcggauacgccgcugauaaggaaucuacccagaaagccauugacggcgucaccaauaaggugaacagcaucaucgauaaaaugaacacacaguucgaggccguugaaagagaguuuaauaaccuggaacggcgcauugagaaucucaacaagaagauggaggacggcuuccuggauguguggacguauaaugcugaacugcucguccugauggagaacgaaagaacccuugacuuccacgauuccaaugugaaaaaccuguacgacaagguucggcuccaacugcgcgauaaugcgaaagagcuugggaacggauguuuugaauuuuaccauaagugcgacaaugaguguauggagucugugagaaacggcacauaugacuacccccaguauagcgaagaggcccggcugaaacgcgaagagaucuccggggucaagcucgagagcauuggaaccuaccagauccugucuauuuauuccacaguggcuagcucucuggcccucgccaucauggucgcuggccugucccuuuggaugugcagcaaugggucccugcagugcagaauuuguaucuga

SEQ ID NO: 197050 - RNA, 1683 nt, Artificial Sequence
  derived and/or modified sequence opt5 from hemagglutinin__InfluenzaA__EPI470859
auggaggccaucccccugauuaccauccuccugguggucacagcuagcaacgccgacaagauuugcaucggcuaccaguccacgaauagcaccgaaacaguugauacccuuacagagaacaaugugccugugacccacgcgaaagaacugcuccauacagagcacaacgggaugcugugugcuaccaaucuuggaagaccgcugauucucgacacgugcaccaucgaaggccugaucuaugggaaccccagcugugaucugcuccugggaggccgggagugguccuacauugucgagcgcccuucugccgugaaugggaugugcuaucccggaaacguugaaaaucuugaggaacugagaucuuucuuuuccucugccagcuccuaccaacggauccagauuuucccugacacaaucuggaacgugagcuauucuggcaccuccaaggcuuguagcgauucuuuuuaccgcuccaugagauggcucacacagaaaaauaacgccuaucccauucaggacgcucaauacaccaauaaccggggcaagagcauccuguucaugugggggauuaaucauccuccgacggauacagcccagaccaaccuuuacacacgcaccgacaccacaacgucugucgcgaccgaggauaucaacagaacauuuaaacccgugaucggaccucggccccugguuaauggccuccaggggcgcauugacuauuacugguccgugcugaagccuggacagacccugagaguccggagcaacggcaaucucaucgcccccugguaugggcacauucuguccggagagucucauggccgcauccuuaagacagaucugaacagcggcuccugcguggugcaaugucagaccgaaagagggggacucaauacgacacugccguuccacaacgucagcaaauacgcuuuuggcaauugcccuaaguauguuggggugaaaucucuuaagcuggccgugggacuccggaacguccccgcucgcuccagcagaggccuguucggggccauugcgggauuuaucgagggcggcuggucugggcugguggccggaugguacggcuuccagcacagcaaugaccaggggguuggaaucgcugccgaucgggacuccacccaaagagcuauugacaaaaucaccucuaaggugaacaauauugucgauaagaugaacaaacaguaugaaaucauugaccaugaguuuagcgaaguggagaaucgccucaacaugaucaauaacaagaucgaugaccagauucaagauaucugggccuacaacgccgagcugcuuguucugcucgaaaaucagaaaacacuggacgagcacgaugcuaacgugaauaaccuuuacaauaaggucaaacgggcgcugggcuccaacgccauggaagacgggaagggcuguuucgagcucuaucauaaaugcgaugaccaguguauggaaaccauuagaaauggaacauacaaccgccggaaguauaaggaggagagcagacuggaacgccagaaaaucgagggcgugaagcuggaaucugaggggacguacaaaauucucaccaucuauuccacagucgcuagcucucuggugauugccaugggauuugccgcuuuccuuuucugggccauguccaauggcagcugccggugcaacaucuguaucuga

SEQ ID NO: 197051 - RNA, 1683 nt, Artificial Sequence
  derived and/or modified sequence opt5 from hemagglutinin__InfluenzaA__EPI498037
auggagaccgugagccugaucacaauucuccuggucgccacgguuuccaacgcugacaagaucugcauuggcuaccagucuaccaauagcacagaaaccguggauacacuuaccgagaacaaugugcccgucacacacgccaaagaacugcuccauaccgagcacaacgggaugcugugugcgacgucccuuggacaaccucugauccucgauaccugcacaauugaaggccugaucuaugggaauccgucuugugaccugcuccuggagggaagagaguggagcuacaucguggaacggcccuccgcuguuaacggccuuugcuauccugggaauguggagaaccuggaggaacuccgcucucuguucagcuccgccagaagcuaccagcggauucagaucuuucccgacaccauuuggaaugucucuuauaacggaacauccaaggccuguagcggcucuuucuaccgcuccaugagauggcuuacccggaaaaauggcgauuauccuauccaggacgugcaauacacgaacaaucaggggaagaacauucuguuuauguggggaaucaaucaucccccuacagauaccacacagcgcgaccucuacaccagaaccgauacaacgaccagcguugcuacagaggaaauuaaccggaucuucaaaccgcugaucggcccccgcccucuggugaacgggcucaugggaagaauugacuauuacuggucuguccugaagcccggccagacccuucggaucaaguccgaugggaaucugauugccccuugguauggacacauccucagcggcgagucccauggccgcauucugaaaacagaccuuaagagagggucuugcaccgugcaaugucagacggaaaaaggaggccugaacacaacccuccccuuucagaaugugagcaaguacgcuuucgggaacugcuccaaauauaucggaaucaagagccugaagcuggccgucggccuccggaauguuccgucucgcuccagcagagggcuguuuggagcgauugccggcuucaucgagggcggguggucuggacuuguggcuggcugguacggguuucagcacagcaacgaucaaggagugggcauggccgcugaccgggacuccacccagaaagccauugauaagaucacaucuaaagucaauaacauuguggacaagaugaauaaacaguaugaaaucaucgaucacgaguucagcgagguugaaaccagacugaacaugauuaauaacaagaucgacgaucaaauucaggacaucugggcguacaaugccgagcuccuggugcuucuggaaaaccagaaaacacucgaugagcaugacgcuaaugucaacaaccuguacaauaaggugaagcgcgcccugggguccaacgcuguugaagauggcaaaggauguuuugagcucuaucacaagugcgacaaucaguguauggagacgauucggaacggcaccuacaauaaaagaaaguaucaagaagagagcaaacuggaacgccagaagaucgagggggugaaacuugaaucugagggaacauacaagauucugaccaucuauuccacagucgccagcucucucgugaucgccaugggcuucgcugcguuucuguucugggccauguccaacgggagcugccggugcaauauuuguaucuga

SEQ ID NO: 197052 - RNA, 1683 nt, Artificial Sequence
  derived and/or modified sequence opt5 from hemagglutinin__InfluenzaA__AGO17847
auggagaccaucagccugaugacaauucuccugaucacgaccgccuccaacgcugacaagauuugcaucggccaccagucuacaaauagcaccgaaacaguggauacccuuacagagaccaacguccccguuacgcaugccaaagaacugcuccaaaccgagcacaaugggaugcugugugcgacaaaccuuggacauccucugauucucgacacgugcacaaucgaaggccugaucuacgggaauccguccugugaucugcuccuggagggaagagaguggucuuauauuguggaacggcccagcgcugugaacggaaccugcuacccugggaaugucgagaaccuugaggaacugcgcacccucuucuccucugccagcuccuaucagagaauccagauuuuucccgacacaaccuggaaugugacauacaccggaaccagccggucuuguuccggcagcuucuaucgcucuaugagauggcugacacagaaguccggcuuuuacccuguucaagaugccaaauauacgaacaaucgggggaagaacauccuuuucguguggggcauucaccauccccacaccuacacagaccagaccacacuguacauccgcaaugauaccacgacaagcgucaccaccgaggaacucaacagaauuuuuaaaccugugaucguuccgcggcugcuggugaauggccagcaggggcgcaucgacuauuacuggucuguccucaagcccggacaaacacugagagugcgguccaacggcaaccuuauugcuccuugguaugggcacgugcugagcggaggcucccauggccgcauccucaagaccgaucugaaaucugggaauugcgucguucagugucagacagagaagggaggccuuaacagcacgcugcccuuccacaauauuuccaaauacgccuuugggaccugcccuaaguaugugaaagugaacagccucaagcuggcuaucggacugagaaauguccccgcccggucuaaccgcggccucuucggggcgauugccggauuuaucgaaggcggcuggccggggcugguggcuggaugguacggcuuccagcauuccaaugaccaagggguuggaauggccgcugauagagacagcacacagaaggccguggauaaaaucaccucuaaggucaacaauauuguggacaaaaugaacaagcaguaugagaucauugaccacgaauuuagcgagguugagacacggcuuaauaugaucaacaauaaaauugaugaccaaauccaggaugugugggcguacaacgccgaacugcucguccugcuugagaaucagaagacccuggacgaacacgaugcuaacgugaacaaucucuacaacaaagucaagagagcccugggcuccaaugcuauggaggacgggaagggcuguuucgaacuguaucauaaaugcgaugaccaguguauggagacgauccgcaacggaaccuacgaucggagaaaguaucgcgaggaaucucggcucgagagacaacgcauugaaggcgugaaacuggagagcgaagggacauacaagauccuuaccauuuauuccacaguugccagcucucuggugaucgccaugggauuugcugcguuccucuucugggccauguccaauggcagcugccggugcaacauuuguaucuga

SEQ ID NO: 197053 - RNA, 1683 nt, Artificial Sequence
  derived and/or modified sequence opt5 from hemagglutinin__InfluenzaA__ANZ03807
auggagaccgugagccugaucacaauucuccuggucgccacgguuuccaacgcugacaagaucugcauuggcuaccagucuaccaauagcacagaaaccguggauacacuuaccgagaacaaugugcccgucacacacgccaaagaacugcuccauaccgagcacaacgggaugcugugugcgacgucccuuggacaaccucugauccucgauaccugcacaauugaaggccugaucuaugggaauccgucuugugaccugagccucgagggaagagagugguccuacaucguggaacggcccucugcuguuaacggccugugcuauccugggaauguggagaaccuugaggaacugcgcagccucuucuccagcgccagaucuuaccagcggauucagaucuuucccgacaccauuuggaaugucuccuaugauggaacaagcaccgccuguucuggcuccuucuaccgcagcaugagauggcugacgcggaagaacggcgacuauccuacacaggaugcucaauacaccaauaaccaggggaaaaauauccuuuuuauguggggaauuaaccaucccccuacagacgauacccagcgcaaucuguacaccagaacagacacgaccacaucuguggccaccgaggaaaucaaccggauuuucaagccgcucaucggcccccgcccucugguuaacgggcugaugggaagaaucgauuauuacugguccgugcucaaacccggccagacacugcggauuaagagcgacgggaaucuuaucgcuccuugguauggacacauucuguccggcgagucucauggccgcauccucaagaccgaucugaaaagagggagcugcacgguccaaugucagacagaaaagggaggccuuaacaccacccugcccuuucagaauguguccaaauacgccuucgggaacugcagcaaguauauuggaaucaaaucucucaagcuggcggugggccugcggaaugucccgucccgcagcucuagagggcucuuuggagccaucgcuggcuucauugagggcggguggagcggacugguugccggcugguacggguuucagcacuccaacgaccaaggagugggcauggcugccgaccgggauucuacacagaaggcgaucgacaaaauuaccagcaaggugaauaacaucgucgauaaaaugaauaagcaguaugaaauuaucgaccacgaguucuccgagguggaaacaagacuuaacaugaucaauaacaaaauugaugaccaaauccaggauauuugggccuacaaugcugagcugcucguucugcuugaaaaccagaagacgcuggacgagcaugaugccaaugugaacaaccucuacaauaaagucaagcgcgcucuggggagcaacgccguggaagacggcaagggauguuuugagcuguaucacaaaugcaaugaucaguguauggagaccauccggaacggcacauacaauagacgcaaguaucaagaagagucuaaacucgaacggcagaagauugaggggguuaaacuggaauccgagggaaccuacaagauccuuacaauuuauagcaccguggccucuucccuggucaucgcuaugggcuucgcggccuuucucuucugggcuaugagcaacggguccugcagaugcaauaucuguauuuga

SEQ ID NO: 197054 - RNA, 1683 nt, Artificial Sequence; identical to SEQ ID NO: 197053
  derived and/or modified sequence opt5 from hemagglutinin__InfluenzaA__EPI680526

SEQ ID NO: 197055 - RNA, 1683 nt, Artificial Sequence; identical to SEQ ID NO: 196709
  derived and/or modified sequence opt5 from hemagglutinin__InfluenzaA__ALT20080

SEQ ID NO: 197056 - RNA, 1410 nt, Artificial Sequence
  derived and/or modified sequence opt5 from neuraminidase__InfluenzaA__AAA43084
augaaccccaaucagaagaucauuaccaucggcagcgugucccugacaauugccacggucugcuuccucaugcaaaucgcuauucuggccaccacaguuacccuucacuuuaaacagcaugagugugacucuccugcgagcaaccaggugaugccgugcgaacccaucaucauugagagaaauaucacagaaauuguguaccugaacaauaccacaaucgagaaggaaauuuguccugaggucguggaguaucggaacugguccaaaccccagugccaaaucaccggguucgcuccuuuuucuaaggauaauagcauucgccucuccgccggaggcgacaucuggguuacgagagaacccuacgugucuugugauccugggaaaugcuaucaguucgcccugggacagggcaccacacuugacaacaagcacagcaaugggaccauccaugaucggauuccgcaccgcacacugcucaugaacgagcugggaguccccuuucaucugggcaccaaacagguguguguugcuugguccucuagcuccugccacgacggcaaggccuggcuccacgugugugucacgggggaugacagaaaugcuacagccagcuucaucuacgauggacggcugguggacucuauuggcuccuggagccaaaacauccuucgcacccaggaaucugagugcguguguauuaaugggacaugcaccgucguuaugaccgauggauccgcgagcggcagagccgacacacggauccuguuuaucaaggaggggaaaauugugcauaucuccccucucucuggaagcgcucagcacauugaagagugcuccuguuauccccgcuacccugaugugagaugcaucugucgggacaacuggaagggcagcaaucgccccgucauugacaucaacauggaagauuauucuaucgacuccggcuacgugugcagcgggcugguuggagauacgccgagaaacgacgauucuagcuccaauucuaacugucgggacccuaauaacgagcgcggcaaucccggggugaaaggaugggccuucgauaacggcgacgaugucuggauggggagaaccauuaauaaggaaagccgguccggauacgagacauuuaaggugaucggcggcuggagcaccccuaacucuaaaucccagguuaauagacaagugauugucgacaacaauaacuggagcggguauucuggaaucuucuccguggagggcaagagcugcauuaaucgcuguuuuuacgucgaacuuauccgggggagaccccaggagacacgcgugugguggaccuccaacucuauuguuguguucugcggaacgagcggcacauaugggaccggcuccuggcccgauggagcuaauaucaacuuuaugccuaucuga

SEQ ID NO: 197057 - RNA, 1362 nt, Artificial Sequence
  derived and/or modified sequence opt5 from neuraminidase__InfluenzaA__AAA43397
augaaccccaaucagaagaucauuaccaucggcagcauuugcaugguggucgggaucauuucccugauccuccaaaucggaaacauuaucucuauuuggaucagccacuccauucagacaggcaaucagaaccauacggggaucuguaaucagggaucuauuaccuacaaaguuguggccggccaagacagcacauccgugauccugaccgggaacucuagccuuugcccuaucagaggaugggcuauucacuccaaggauaauggcauccggauuggcagcaaaggggacgucuucgugauccgcgagccguuuauuucuuguucccaucuggaaugcagaacauucuuucucacccagggagcccugcuuaacgauaagcacagccggggcacauucaaagaccgcucucccuauagagcgcugauguccuguccuguuggggaggcucccagcccuuacaauucucgguuugaauccguggccuggagcgccuccgcuugccaugauggagucggcuggcucaccaucgggaucucuggacccgacgauggcgccguggcuguucugaaguauaaccgcauuaucacggagaccauuaagagcuggagaaagaauauccugcggacacaggaauccgaguguaccugcgugaacggcagcuguuucacaauuaugaccgacgggccuucugauggacucgccuccuacaagaucuuuaaaaucgagaagggcaaagucacgaaaagcauugaacugaaugcgccgaacucucacuaugaggaaugcagcuguuaccccgacacagggaaggugaugugcgugugccgcgauaauuggcacggauccaacagaccuugggucucuuucgaccagaaccuugauuauaaaaucggcuacauuuguagcgggguuuuuggagacaauccccggccuaaggacggcaccggcuccugcgggcccgugagcgccgauggagcuaacggcgugaaaggguucucuuacaaguauggaaauggcgucuggaucgggcgcacaaaauccgacagcucuagacauggcuuugagaugauuugggauccgaacggauggaccgagaccgacucccgguucagcaugcgccaagaugugguugccaucacaaauagauccggcuacucugggagcuuugugcagcacccugaacugacgggacucgacuguaugcggcccugcuucugggucgagcugauuagaggccuuccugaagaggaugcuaucuggaccuccgggucuaucauuagcuucuguggagugaacuccgacacaguugauuggagcuggcccgacggcgccgaacugcccuuuaccaucgauaaguga

SEQ ID NO: 197058 - RNA, 1365 nt, Artificial Sequence
  derived and/or modified sequence opt5 from neuraminidase__InfluenzaA__AAA43412
augaaccccaaucagaagaucauuaccaucggcagcauuugccugguggucgggcucaucucccugauucuucaaaucggaaacaucauuucuaucuggauuagccacuccauccagacaggcucucagaaucauacggggauuuguaaccagaauaucauuaccuacaaaaacagcacauggguuaaggacaccacauccgugauccugaccggaaauucuagccucugcccuaucagaggcugggccauuuauuccaaagauaacagcauccggauugggucuaagggagacguguucgucauccgcgagccguuuauuuccuguagccaccuggaaugcagaacauucuuucuuacccaaggcgcucugcucaaugaucggcauucuaacggcacggugaaagaccgcucccccuacagagcccugaugagcuguccuguuggggaggcgcccucuccuuauaauucccgguucgaaagcguggcuugguccgccucugccugccacgauggaaugggcuggcugaccaucgggaucagcggacccgacaacggcgcugucgccgugcucaaguacaaugggauuaucacagagaccauuaaguccuggcgcaaaaagauccugagaacacaggaaagcgagugugcuugcguuaacggaucuuguuuuaccauuaugacggauggcccuuccgacggccuugccagcuauaaaaucuucaagaucgagaaagggaaggugacaaagucuauugaacugaaugcgccgaacagccauuacgaggaaugcuccuguuaucccgauaccggaaaagucaugugcgugugccgggacaacuggcacggcucuaaucgcccuugggugagcuuugaucagaaccucgacuaccagaucggguacauuuguuccggagucuucggcgauaaucccagaccuaaggacgggacaggaagcugcggccccguuuauguggacggcgccaacggggugaaaggauuuucuuaccgguauggcaauggggucuggaucggacgcaccaagucccacagcucuagacauggcuucgagaugauuugggauccgaacggguggaccgagacagacuccaaauuuagcgugcggcaagauguuguggcuaugacggacugguccggcuacucuggcagcuucguccagcacccugaacugaccggacuugauuguauccgccccugcuuuuggguggagcugauuagagggcggccuaaggagaaaacaaucuggaccuccgccucuagcaucuccuucuguggaguuaauagcgacacaguggauuggucuuggcccgacggcgcugaacuccccuucaccauugauaaguga

SEQ ID NO: 197059 - RNA, 1410 nt, Artificial Sequence
  derived and/or modified sequence opt5 from neuraminidase__InfluenzaA__AAG01743
augaaccccaaucagaagaucauuacccugggcagcgugucccucacaaucgccacgauuugcuuccugaugcaaaucgcuauucuugucaccacaguuacccugcacuuuaaacaguacgagugugacuauccugccaacaaucaggcgaugccgugcgaacccaucaucauugagagaaacaucacagaaauuguguaccucaccaauacaaccaucgagaaggaaguguguccuaaacuggucgaguaucggaacuggucuaagccccagugcaaaauuacgggguucgcuccuuuuagcaaggauaauuccauccgccuuucugccggaggcgacauuugggugaccagagagcccuacguuagcugugauccugggaagugcuaucaauucgcccugggacagggcacaacccucgacaacaaacauuccaaugauacaauccacgaccggaccccgcaucgcacgcugcugaugaacgaacucggggugcccuuucaccugggaacaagacaggucuguaucgcuuggucuagcuccagcugccaugauggcaaggccuggcuucacguguguguuaccggcuacgacaaaaaugcuacagccucuuucauuuaugaugggcggcugguggacuccaucggaagcuggucucagaacauucuccgcacccaagaguccgaaugcgucuguaucaauggaaccugcacaguggugaugacggaugggagcgcgucuggcagagccgacaccaagauucuguuuaucgaggagggcaaaaucguccacacauccccucuuagcggguccgcucagcauguugaagagugcucuuguuacccccgguacccuggagugcgcugcauuuguagagauaacuggaagggcagcaaucggcccguggucgacaucaacgugaaggacuauuccauuaacagcucuuacguuugcuccggccuggugggggauaccccgcgcaauaacgacagaagcucuagcuccuauugucagaauccuaacaaugaaaaaggaacacacggcgucaaggggugggccuucgaugacggaaacgauguguggaugggccggaccaucucugaggacagccgcuccggguacgaaacguuuaaaguuauuggaggcuggagcacacccaauucuaagcuccagaucaacagacaagugaucgucgauuccgacaaucggagcggcuauucugggauuuucuccguggagggaaaaagcugcaucaacagauguuuuuacgucgagcugauucgcggccgggaacaggagaccagagugugguggaccuccaauucuaucguuguguucugcgggacaagcggaaccuauggcacaggguccuggccugauggcgcugacauuaacaucaugcccauuuga

SEQ ID NO: 197060 - RNA, 1410 nt, Artificial Sequence
  derived and/or modified sequence opt5 from neuraminidase__InfluenzaA__AAG01759
augaaccccaaucagaagaucauuaccaucggcagcgugucccugacaauugccacgaugugcuuccucaugcaaaucgcuauucuggucaccacaguuacccuucacuuuaaacaguacgaguguaacucuccuccgaauaaccaggugauccugugcgaacccacaaucauugagagaaauaucaccgaaauuguguaucucacaaacaccacgaucgagaaggaaauuuguccuaaacuggccgaguacaagaauuggagcaaaccccagugcaagaucaccggguucgcgccuuuuuccaaggacaacucuauucggcuuagcgcuggaggcgauaucugggucacacgcgagcccuauguguccugugacccugauaaaugcuaccaauucgcccuggggcagggaaccacacucaauaacagacauucuaaugacaccguucacgaucggacgccguaucgcacacugcugaugaacgaacucggcgugcccuuucaucuggggaccaagcaggucuguaucgccuggagcuccagcucuugccacgacggaaaagccuggcuucauguguguguuacaggccacgaugagaaugcuaccgcuuccuucauuuacgacggcagacugguggauagcaucgggucuugguccaagaaaauucuccggacccaggaaagcgagugcgucuguaucaacggaacaugcacgguggugaugaccgacggcucugccuccgggcgcgcggauacaaagauucuguuuaucgaggaaggaaagaucguccacauuagcccucuucugggcuccgcccaacauguugaggaaugcucuuguuaucccagauacccuggggugcggugcgugugucgcgacaauuggaaaggaagcaacagacccaucgucgauauuaacgugaaggacuacuccaucguuagcucuuaugugugcuccggccucgucggcgacaccccgcggaaaaaugaucgcagcucuagcuccaacugucugaauccuaacaaugaggaagggggacacggcgugaaggggugggcuuucgacgauggaaacgacguuuggaugggcagaacaauuucugagaaacugcggagcggguacgagaccuuuaaggugaucgaaggaugguccaaacccaauagcaagcuccagaucaaccgccaggucauuguggauagaggcaaucggucuggcuauuccgggaucuucagcgucgagggaaagucuugcauuaacagauguuuuuacguggaacugauccgcggccggaaacaggagacggaaguuugguggacauccaauagcauuguggucuucugcgggaccuccggaaccuauggcacagggucuuggccugacggcgccgauaucaaccuuaugcccauuuga

SEQ ID NO: 197061 - RNA, 1410 nt, Artificial Sequence
  derived and/or modified sequence opt5 from neuraminidase__InfluenzaA__AAG01777
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugauccugugcgaacccacaauuaucgagagaaauauuaccgaaaucguguaucucacaaacaccacgauugagaaggaaaucuguccuaaacuggccgaguacaagaauuggagcaaaccccagugcaagauuaccggguucgcgccuuuuuccaaggacaacucuauccggcuuagcgcuggaggcgauaucugggucacacgcgagcccuauguguccugugacccugauaaaugcuaccaauucgcccuggggcagggaaccacacucaauaacagacauucuaaugacaccguucacgaucggacgccguaucgcacacugcugaugaacgaacucggcgugcccuuucaucuggggaccaagcaggucuguauugccuggagcuccagcucuugccacgacggaaaagccuggcuucauguguguguuacaggccacgaugagaaugcuaccgcuuccuucaucuacgacggcagacugguggauagcauugggucuugguccaagaaaauccuccggacccaggaaagcgagugcgucuguauuaacggaacaugcacgguggugaugaccgacggcucugccuccgggcgcgcggauacaaagauccuguuuaucgaggaaggaaagauuguccacaucagcccucuucugggcuccgcccaacauguugaggaaugcucuuguuaucccagauacccuggggugcggugcgugugucgcgacaauuggaaaggaagcaacagacccauugucgauaucaacgugaaggacuacuccauuguuagcucuuaugugugcuccggccucgucggcgacaccccgcggaaaaaugaucgcagcucuagcuccaacugucugaauccuaacaaugaggaagggggacacggcgugaaggggugggcuuucgacgauggaaacgacguuuggaugggcagaacaaucucugagaaacugcggagcggguacgagaccuuuaaggugaucgaaggaugguccaaacccaauagcaagcuccagauuaaccgcccugucaucguggauagaggcgaccggucuggcuauuccgggauuuucagcgucgagggaaagucuugcaucaauagauguuuuuacguggaacugauucgcggccggaaacaggagacggaaguuugguggacauccaacagcaucguggucuucugcgggaccuccggaaccuauggcacagggucuuggcccgauggcgccgacauuaaucuuaugcccaucuga

SEQ ID NO: 197062 - RNA, 1410 nt, Artificial Sequence
  derived and/or modified sequence opt5 from neuraminidase__InfluenzaA__AAG01786
augaaccccaaucagaagaucauuaccaucggcagcgugucccugacaauugccacgaugugcuuccucaugcaaaucgcuauucuggucaccacaguuacccuucacuuuaaacaguacgaguguaacucuccuccgaauaaccaggugauccugugcgaacccacaaucauugagagaaauaucaccgaaauuguguaucucacaaacaccacgaucgagaaggaaauuuguccuaaacuggccgaguacaagaauuggagcaaaccccagugcaagaucaccggguucgcgccuuuuuccaaggacaacucuauucggcuuagcgcuggaggcgauaucugggucacacgcgagcccuauguguccugugacccugauaaaugcuaccaauucgcccuggggcagggaaccacacucaauaacagacauucuaaugacaccguucacgaucggacgccguaucgcacacugcugaugaacgaacucggcgugcccuuucaucuggggaccaagcaggucuguaucgccuggagcuccagcucuugccacgacggaaaagccuggcuucauguguguguuacaggccacgaugagaaugcuaccgcuuccuucauuuacgacggcagacugguggauagcaucgggucuugguccaagaaaauucuccggacccaggaaagcgagugcgucuguaucaacggaacaugcacgguggugaugaccgacggcucugccuccgggcgcgcggauacaaagauucuguuuaucgaggaaggaaagaucguccacauuagcccucuucugggcuccgcccaacauguugaggaaugcucuuguuaucccagauacccuggggugcggugcgugugucgcgacaauuggaaaggaagcaacagacccaucgucgauauuaacgugaaggacuacuccaucguuagcucuuaugugugcuccggccucgucggcgacaccccgcggaaaaaugaucgcagcucuagcuccaacugucugaauccuaacaaugaggaagggggacacggcgugaaggggugggcuuucgacgauggaaacgacguuuggaugggcagaacaauuucugagaaacugcggagcggguacgagaccuuuaaggugaucgaaggaugguccaaacccaauagcaagcuccagaucaaccgccaggucauuguggauagaggcgaccggucuggcuauuccgggaucuucagcgucgagggaaagucuugcauuaauagauguuuuuacguggaacugauccgcggccggaaacaggagacggaaguuugguggacauccaacagcauuguggucuucugcgggaccuccggaaccuauggcacagggucuuggccugauggcgccgacaucaaucuuaugcccauuuga

SEQ ID NO: 197063 - RNA, 1410 nt, Artificial Sequence
  derived and/or modified sequence opt5 from neuraminidase__InfluenzaA__AAK71688
augaaccccaaucagaagaucauuaccaucggcagcgugucccugacaauugccacgaugugcuuccucaugcaaaucgcuauucuggucaccacaguuacccuucacuuuaaacaguacgaguguaacucuccuccgaauaaccaggugauccugugcgaacccacaaucauugagagaaauaucaccgaaauuguguaucucacaaacgccaccaucgagaaggaaauuuguccuaaacuggcggaguaccggaauuggagcaagccccagugcaaaaucacgggguucgcuccuuuuuccaaggacaacucuauucgccuuagcgccggaggcgauaucugggucaccagagagcccuauguguccugugacccugauaagugcuaccaauucgcccuggggcagggaacaacccucaauaaccggcauucuaaugacacaguucacgaucgcaccccguauagaacgcugcugaugaacgaacucggcgugcccuuucaucuggggacaaaacaggucuguaucgcuuggagcuccagcucuugccacgacggaaaggccuggcuucauguguguguuaccggccacgaugagaaugcuacagccuccuucauuuacgacggccggcugguggauagcaucgggucuugguccaaaaagauucuccgcacccaggaaagcgagugcgucuguaucaacggaaccugcacaguggugaugacggacggcucugcguccgggagagccgauaccaaaauucuguuuaucgaggaaggaaagaucguccacauuagcccucuucugggcuccgcucaacauguugaggaaugcucuuguuauccccgguacccuggggugcgcugcguguguagagacaauuggaagggaagcaaccggcccaucgucgauauuaacgugaaagacuacuccaucguuagcucuuaugugugcuccggccucgucggcgacacaccgcgcaagaaugauagaagcucuagcuccaacugucugaauccuaacaaugaggaagggggacacggcgugaaagggugggccuucgacgauggaaacgacguuuggaugggccggaccauuucugaggagcugcgcagcggguacgaaacauuuaaggugaucgagggaugguccaaacccaauagcaagcuccagaucaacagacaggucauuguggaucggggcgacagaucuggcuauuccgggaucuucagcgucgaaggaaaaucuugcauuaaucgcuguuuuuacguggagcugauccggggcagaaagcaggaaaccgagguuugguggacguccaacagcauuguggucuucugcgggacauccggaaccuauggcaccgggucuuggccugauggcgcugacaucaaucuuaugcccauuuga

SEQ ID NO: 197064 - RNA, 1410 nt, Artificial Sequence
  derived and/or modified sequence opt5 from neuraminidase__InfluenzaA__AAN01169
augaaccccaaucagaagaucauuaccaucggcagcgugucccugacaauugccacgaucugcuuccucaugcaaauugcuauccuggucaccacaguuacccuucacuuuaaacaguacgaguguaacucucugccuaauaaccaggugaugcucugcgaaccgacaaucauugagagaaauaucaccgaaauuguguaucugacaaacaccacgaucgagaaggaaauuugucccaaacuugccgaguaccggaauuggagcaagccucagugcaaaaucaccggguucgcgcccuuuuccaaggacaacucuauucgccugagcgcuggaggcgauaucugggucacaagagagccuuauguguccugugaccccgauaagugcuaccaauucgcccucgggcagggaaccacacugaauaaccggcauucuaaugacaccguucacgaucgcacgccuuauagaacacugcucaugaacgaacugggcgugccguuucaucuugggaccaaacaggucuguaucgccuggagcuccagcucuugccacgacggaaaggcuuggcugcauguguguguuacaggccacgaugagaaugccaccgcuuccuucauuuacgacggccggcucguggauagcaucgggucuugguccaaaaagauucugcgcacccaggaaagcgagugcgucuguaucaacggaacaugcacgguggugaugaccgacggcucugccuccgggagagcggauacaaaaauucuuuuuaucgaggaaggaaagaucauucacaucagccaacuguccggcucugcccagcaugucgaggaaugcagcuguuauccccgguacccugggguucgcugcguguguagagacaauuggaagggauccaaccggcccauuguggauaucaacgucaaagacuacagcauugugucuuccuauguuugcagcggccucgugggcgacaccccucgcaagaaugauucuagcuccucuagccacugucugaaccccaauaacgaggaagggggacauggcgucaaagggugggcuuucgacgauggaaaugacguguggaugggcagaacaaucuccgagaaguuucggagcggguacgagaccuucaaaguuaucgaaggauggucuaagccgaacuccaaacugcagauuaaucgccaggugaucgucgauagagacaaccggagcggcuauucuggcauuuuuagcguggaggggaaguccugcaucaauagauguuucuacgucgaacucauucgcggacggaagcaagagacggaagugugguggacauccaacucuaucguuguguuuugcggcaccagcgggaccuauggaacaggcuccuggccugauggggccgacauuaaucugaugcccaucuga

SEQ ID NO: 197065 - RNA, 1410 nt, Artificial Sequence; identical to SEQ ID NO: 197064
  derived and/or modified sequence opt5 from neuraminidase__InfluenzaA__AAN01170

SEQ ID NO: 197066 - RNA, 1410 nt, Artificial Sequence
  derived and/or modified sequence opt5 from neuraminidase__InfluenzaA__AAN01171
augaaccccaaucagaagaucauuaccaucggcagcgugucccugacaauugccacgaucugcuuccucaugcaaauugcuauccuggucaccacaguuacccuucacuuuaaacaguacgaguguaacucucugccuaauaaccaggugaugcucugcgaaccgacaaucauugagagaaauaucaccgaaauuguguaucugacaaacaccacgaucgagaaggaaauuugucccaaacuugccgaguaccggaauuggagcaagccucagugcaaaaucaccggguucgcgcccuuuuccaaggacaacucuauucgccugagcgcuggaggcgauaucugggucacaagagagccuuauguguccugugaccccgauaagugcuaccaauucgcccucgggcagggaaccacacugaauaaccggcauucuaaugacaccguucacggccgcacgccuuauagaacacugcucaugaacgaacugggggugccguuucaucuuggaaccaaacaggucuguaucgccuggagcuccagcucuugccacgauggcaaggcuuggcugcauguguguguuacaggccacgacgagaaugccaccgcuuccuucauuuacgaugggcggcucguggacagcaucggaucuugguccaaaaagauucugcgcacccaggaaagcgagugcgucuguaucaacggcacaugcacgguggugaugaccgaugggucugccuccggcagagcggacacaaaaauucuuuuuaucgaggaaggaaagaucauucacaucagccaacuguccgggucugcccagcaugucgaggaaugcagcuguuauccccgguacccuggaguucgcugcguguguagagauaauuggaagggcuccaaccggcccauuguggacaucaacgucaaagauuacagcauugugucuuccuauguuugcagcggccucgugggggacaccccucgcaagaaugacucuagcuccucuagccacugucugaaccccaauaacgaggaaggaggccauggggucaaaggaugggcuuucgaugacggcaaugauguguggauggggagaacaaucuccgagaaguuucggagcggauacgagaccuucaaaguuaucgaaggcuggucuaagccgaacuccaaacugcagauuaaucgccaggugaucgucgacagagauaaccggagcggcuauucugggaucuuuuccguggagggaaagagcugcauuaauagauguuucuacgucgaacucauucgcggccggaagcaagagacggaagugugguggacauccaacucuaucguuguguuuugcgggaccagcggaaccuauggcacaggguccuggccugacggcgccgauauuaaucugaugcccaucuga

SEQ ID NO: 197067 - RNA, 1410 nt, Artificial Sequence; identical to SEQ ID NO: 197064
  derived and/or modified sequence opt5 from neuraminidase__InfluenzaA__AAN01172

SEQ ID NO: 197068 - RNA, 1410 nt, Artificial Sequence
  derived and/or modified sequence opt5 from neuraminidase__InfluenzaA__AAN01173
augaaccccaaucagaagaucauuaccaucggcagcgugucccugacaauugccacgaucugcuuccucaugcaaauugcuauccuggucaccacaguuacccuucacuuuaaacaguacgaguguaacucucugccuaauaaccaggugaugcucugcgaaccgacaaucauugagagaaauaucaccgaaauuguguaucugacaaacaccacgaucgagaaggaaaugugucccaaacuugccgaguaccggaauuggagcaagccucagugcaaaauuaccggguucgcgcccuuuuccaaggacaacucuauccgccugagcgcuggaggcgauauuugggucacaagagagccuuauguguccugugaccccgauaagugcuaccaauucgcccucgggcagggaaccacacugaauaaccggcauucuaaugacaccguucacgaucgcacgccuuauagaacacugcucaugaacgaacugggcgugccguuucaucuugggaccaaacaggucuguaucgccuggagcuccagcucuugccacgacggaaaggcuuggcugcauguguguguuacaggccacgaugagaaugccaccgcuuccuucaucuacgacggccggcucguggauagcauugggucuugguccaaaaagauccugcgcacccaggaaagcgagugcgucuguauuaacggaacaugcacgguggugaugaccgacggcucugccuccgggagagcggauacaaaaauccuuuuuauugaggaaggaaagaucauccacauuagccaacuguccggcucugcccagcaugucgaggaaugcagcuguuauccccgguacccugggguucgcugcguguguagagacaauuggaagggauccaaccggcccaucguggauauuaacgucaaagacuacagcaucgugucuuccuauguuugcagcggccucgugggcgacaccccucgcaagaaugauucuagcuccucuagccacugucugaaccccaauaacgaggaagggggacauggcgucaaagggugggcuuucgacgauggaaaugacguguggaugggcagaacaauuuccgagaaguuucggagcggguacgagaccuucaaaguuaucgaaggauggucuaagccgaacuccaaacugcagaucaaucgccaggugauugucgauagagacaaccggagcggcuauucuggcaucuuuuccguggagggaaagagcugcauuaauagauguuucuacgucgaacucauccgcgggcggaagcaagagacggaagugugguggacauccaacucuauuguuguguuuugcggcaccagcgggaccuauggaacaggcuccuggccugauggggccgacaucaaucugaugcccauuuga

SEQ ID NO: 197069 - RNA, 1410 nt, Artificial Sequence; identical to SEQ ID NO: 197064
  derived and/or modified sequence opt5 from neuraminidase__InfluenzaA__AAN01174

SEQ ID NO: 197070 - RNA, 1410 nt, Artificial Sequence; identical to SEQ ID NO: 197064
  derived and/or modified sequence opt5 from neuraminidase__InfluenzaA__AAN01175

SEQ ID NO: 197071 - RNA, 1410 nt, Artificial Sequence; identical to SEQ ID NO: 197064
  derived and/or modified sequence opt5 from neuraminidase__InfluenzaA__AAN01176

SEQ ID NO: 197072 - RNA, 1410 nt, Artificial Sequence; identical to SEQ ID NO: 197064
  derived and/or modified sequence opt5 from neuraminidase__InfluenzaA__AAN01177

SEQ ID NO: 197073 - RNA, 1410 nt, Artificial Sequence; identical to SEQ ID NO: 197064
  derived and/or modified sequence opt5 from neuraminidase__InfluenzaA__AAN01178

SEQ ID NO: 197074 - RNA, 1410 nt, Artificial Sequence; identical to SEQ ID NO: 197064
  derived and/or modified sequence opt5 from neuraminidase__InfluenzaA__AAN01179

SEQ ID NO: 197075 - RNA, 1410 nt, Artificial Sequence; identical to SEQ ID NO: 197064
  derived and/or modified sequence opt5 from neuraminidase__InfluenzaA__AAN01180

SEQ ID NO: 197076 - RNA, 1410 nt, Artificial Sequence
  derived and/or modified sequence opt5 from neuraminidase__InfluenzaA__AAN01181
augaaccccaaucagaagaucauuaccaucggcagcgugucccugacaauugccacgaucugcuuccucaugcaaauugcuauccuggucaccacaguuacccuucacuuuaaacaguacgaguguaacucucugccuaauaaccaggugaugcucugcgaaccgacaaucauugagagaaauaucaccgaaauuguguaucugacaaacaccacgaucgagaaggaaauuugucccaaacuugccgaguaccggaauuggagcaagccucagugcaaaaucaccggguucgcgcccuuuuccaaggacaacucuauucgccugagcgcuggaggcgauaucugggucacaagagagccuuauguguccugugaccccgauaagugcuaccaauucgcccucgggcagggaaccacacugaauaaccggcauucuaaugacaccguucacgaucgcacgccuuauagaacacugcucaugaacgaacugggcgugccguuucaucuugggaccaaacaggucuguaucgccuggagcuccagcucuugccacgacggaaaggcuuggcugcauguguguguuacaggccacgaugagaaugccaccgcuuccuucauuuacgacggccggcucguggauagcaucgggucuugguccaaaaagauucugcgcacccaggaaagcgagugcgucuguaucaacggaacaugcacgguggugaugaccgacggcucugccuccgggagagcggauacaaaaauucuuuuuaucgaggaaggaaagaucauucacaucagccaacuguccggcucugcccagcaugucgaggaaugcagcuguuauccccgguacccugggguucgcugcguguguagagacaauuggaagggauccaaccggcccauuguggauaucaacgucaaagacuacagcauugugucuuccuauguuugcagcggccucgugggcgacaccccucgcaagaaugauucuagcuccucuagccacugucugaaccccaauaacgaggaagggggacauggcgucaaagggugggcuuucgacgauggaaaugacguguggaugggcagaacaaucggggagaaguuucgguccggauacgagaccuucaaaguuaucgaaggcuggagcaagccgaacucuaaacugcagauuaaucgccaggugaucgucgauagagacaaccgguccggcuauagcgggaucuuuucuguggagggaaaguccugcauuaauagauguuucuacgucgaacucauucgcggccggaagcaagagacggaagugugguggacaagcaacuccaucguuguguuuugcgggaccucuggaaccuauggcacagggagcuggccugauggcgccgacauuaaucugaugcccaucuga

SEQ ID NO: 197077 - RNA, 1410 nt, Artificial Sequence; identical to SEQ ID NO: 197064
  derived and/or modified sequence opt5 from neuraminidase__InfluenzaA__AAN01182

SEQ ID NO: 197078 - RNA, 1410 nt, Artificial Sequence; identical to SEQ ID NO: 197064
  derived and/or modified sequence opt5 from neuraminidase__InfluenzaA__AAN01183

SEQ ID NO: 197079 - RNA, 1410 nt, Artificial Sequence; identical to SEQ ID NO: 197064
  derived and/or modified sequence opt5 from neuraminidase__InfluenzaA__AAN01184

SEQ ID NO: 197080 - RNA, 1410 nt, Artificial Sequence; identical to SEQ ID NO: 197064
  derived and/or modified sequence opt5 from neuraminidase__InfluenzaA__AAN01185

SEQ ID NO: 197081 - RNA, 1410 nt, Artificial Sequence
  derived and/or modified sequence opt5 from neuraminidase__InfluenzaA__AAN01186
augaaccccaaucagaagaucauuaccaucggcagcgugucccugacaauugccacgaucugcuuccucaugcaaauugcuauccuggucaccacaguuacccuucacuuuaaacaguacgaguguaacucucugccuaauaaccaggugaugcucugcgaaccgacaaucauugagagaaauaucaccgaaauuguguaucugacaaacaccacgaucgagaaggaaauuugucccaaacuugccgaguaccggaauuggagcaagccucagugcaaaaucaccggguucgcgcccuuuuccaaggacaacucuauucgccugagcgcuggaggcgauaucugggucacaagagagccuuauguguccugugaccccgauaagugcuaccaauucgcccucgggcagggaaccacacugaauaaccggcauucuaaugacaccguucacgaucgcacgccuuauagaacacugcucaugaacgaacugggcgugccguuucaucuugggaccaaacaggucuguaucgccuggagcuccagcucuugccacgacggaaaggcuuggcugcauguguguguuacaggccacgaugagaaugccaccgcuuccuucauuuacgacggccggcucguggauagcaucgggucuugguccaaaaagauucugcgcacccaggaaagcgagugcgucuguaucaacggaacaugcacgguggugaugaccgacggcucugccuccgggagagcggauacaaaaauucuuuuuaucgaggaaggaaagaucauucacaucagccaacuguccggcucugcccagcaugucgaggaaugcagcuguuauccccgguacccugggguucgcugcguguguagagacaauuggaagggauccaaccggcccauuguggauaucaacgucaaagacuacagcauugugucuuccuauguuugcagcggccucgugggcgacaccccucgcaagaaugauucuagcuccucuagccacugucugaaccccaauaacgaggaagggggacauggcgucaaagggugggcuuucgacgauggaaaugacguguggaugggcagaacaaucuccgagaaguuucggcugggguacgagaccuucaaaguuaucgaaggauggagcaagucuaacuccaaacuccagauuaaucgccaggugaucgucgauagagacaaccggagcggcuauucuggcauuuuuagcguggaggggaaguccugcaucaauagauguuucuacgucgaacugauucgcggacggaagcaagagacggaagugugguggacauccaacucuaucguuguguuuugcggcaccagcgggaccuauggaacaggcuccuggccggauggggccgacauuaaucuuaugccuaucuga

SEQ ID NO: 197082 - RNA, 1410 nt, Artificial Sequence
  derived and/or modified sequence opt5 from neuraminidase__InfluenzaA__AAN01187
augaaccccaaucagaagaucauuaccaucggcagcgugucccugacaauugccacgaucugcuuccucaugcaaauugcuauccuggucaccacaguuacccuucacuuuaaacaguacgagugugacucucugccuaacaaucaggugaugcucugcgaaccgacaaucauugagagaaacaucaccgaaauuguguaucugacaaauaccacgaucgagaaggaaaugugucccaaacuugccgaguaccggaacuggagcaagccucagugcaaaauuaccggguucgcgcccuuuuccaaggauaauucuauccgccugagcgcuggaggcgacauuugggucacaagagagccuuauguguccugugaucccgacaagugcuaccaauucgcccucgggcagggaaccacacugaacaaucggcauucuaacgauaccguucacgaccgcacgccuuauagaacacugcucaugaaugaacugggcgugccguuucaucuugggaccaaacaggucuguaucgccuggagcuccagcucuugccacgauggaaaggcuuggcugcauguguguguuacaggccacgacgagaacgccaccgcuuccuucaucuacgauggccggcucguggacagcauugggucuugguccaaaaagauccugcgcacccaggaaagcgagugcgucuguauuaauggaacaugcacgguggugaugaccgauggcucugccuccgggagagcggacacaaaaauccuuuuuauugaggaaggaaagaucauccacauuagccaaauguccggcucugcccagcaugucgaggaaugcagcuguuauccccgguacccugggguucgcugcguguguagagauaacuggaagggauccaaucggcccaucguggacauuaacgucaaagacuacagcaucgugucuuccuauguuugcagcggccuggugggcgauaccccucgcaagaacgacucuagcuccucuagccacugucucaaucccaacaaugaggaagggggacauggcgucaaagggugggcuuucgaugacggaaacgauguguggaugggcagaacaauuuccgagaaguuucggagcggguacgagaccuucaaaguuaucgaaggauggucuaagccgaauagcaaacugcagaucaaccgccaggugauugucgacagagauaaucggagcggcuauucuggcaucuuuuccguggaggggaaguccugcauuaacagauguuucuacgucgaacugauccgcggacggaagcaagagacggaagugugguggacauccaauucuauuguuguguuuugcggcaccagcgggaccuauggaacaggcuccuggccugacggggccgauaucaaccucaugcccauuuga

SEQ ID NO: 197083 - RNA, 1410 nt, Artificial Sequence; identical to SEQ ID NO: 197064
  derived and/or modified sequence opt5 from neuraminidase__InfluenzaA__AAN01188

SEQ ID NO: 197084 - RNA, 1410 nt, Artificial Sequence
  derived and/or modified sequence opt5 from neuraminidase__InfluenzaA__AAN64883
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagccuucuguccgggucugcccaacacguugaggaaugcagcuguuauccucgcuaccccggagugagaugcgugugucgggacaacuggaagggcuccaaucgcccuauugucgauaucaacgugaaagacuacagcauuguuucuuccuaugugugcagcggccucgucggggacacacccagaaagaaugauucuagcuccucuagccauugucuggacccgaacaaugaggaaggaggccacggggugaaaggaugggcuuucgaugacggcgaugacguuuggauggggcggaccaucuccgagaagcugcgcagcggauacgagacguuuaaagugauugaaggcuggucuaagccuaacuccaaacuccagaucaauagacaggucaucguggaucggggcaaccgcagcggguauucuggaauuuucuccgucgagggcaagagcugcaucaauagauguuuuuacguggaacugauucgggggagaaagcaggagacagaaguucuuuggaccuccaacucuaucguggucuucugcggaaccagcggcacauaugggaccggcuccuggcccgacggagccgauauuaaucugaugccuaucuga

SEQ ID NO: 197085 - RNA, 1410 nt, Artificial Sequence
  derived and/or modified sequence opt5 from neuraminidase__InfluenzaA__AAN64884
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagccuucuguccgggucugcccaacacguugaggaaugcagcuguuauccucgcuaccccggagugagaugcgugugucgggacaacuggaagggcuccaaucgcccuauugucgauaucaacgugaaagacuacagcauuguuucuuccuaugugugcagcggccucgucggggacacacccagaaagaaugauucuagcuccucuagccauugucuggacccgaacaaugaggaaggaggccacggggugaaaggaugggcuuucgaugacggcaacgauguuuggauggggcggaccaucuccgagaagcugcgcagcggauacgagacguuuaaagugauugaaggcuggucuaagccuaauuccaaacuccagaucaacagacaggucaucguggaccggggcaaucgcagcggguauucuggaauuuucuccgucgagggcaagagcugcaucaacagauguuuuuacguggaacugauucgggggagaaagcaggagacagaaguucuuuggaccuccaauucuaucguggucuucugcggaaccagcggcacauaugggaccggcuccuggcccgauggagccgacauuaaccugaugccuaucuga

SEQ ID NO: 197086 - RNA, 1410 nt, Artificial Sequence; identical to SEQ ID NO: 197085
  derived and/or modified sequence opt5 from neuraminidase__InfluenzaA__AAN64885

SEQ ID NO: 197087 - RNA, 1410 nt, Artificial Sequence; identical to SEQ ID NO: 197085
  derived and/or modified sequence opt5 from neuraminidase__InfluenzaA__AAN64886

SEQ ID NO: 197088 - RNA, 1410 nt, Artificial Sequence; identical to SEQ ID NO: 197085
  derived and/or modified sequence opt5 from neuraminidase__InfluenzaA__AAN64887

SEQ ID NO: 197089 - RNA, 1410 nt, Artificial Sequence
  derived and/or modified sequence opt5 from neuraminidase__InfluenzaA__AAN64888
augaaccccaaucagaagaucauuaccaucggcagcgugucccugacaauugccacgaucugcuuccucaugcaaauugucauccugguuaccacagugacccuucacuuuaaacaguacgaguguaacucuccuccgaauaaccaggugaugcugugcgaacccacaaucauugagagaaauaucaccgaaauugucuaucucacaaacaccacgaucgagaaggaaauuuguccuaaacuggcugaguaccggaauuggagcaagccccagugcaacaucaccggguucgccccuuuuuccaaagacaauucuauucgccuuagcgcgggaggcgauaucugggugacaagagagcccuauguuuccugugacccugauaagugcuaccaauucgcucuggggcagggaaccacacucaacaauggccauucuaacgacaccgugcacgaucggacgccguaucgcacacugcugaugaaugaacucgggguccccuuucaucugggaaccaaacagguguguaucgccuggagcuccagcucuugccacgacggcaaagccuggcuucauguuugugugacaggcgaugacaagaacgcuaccgccuccuucauuuacaaugggagacuggucgauagcaucggaucuugguccaaaaagauucuccggacccaggagagcgaaugcguguguaucaacggcacaugcacgguggucaugaccgacgggucugcuuccggaaaagccgauacaaagauucuguuuaucgaggagggcaagaucguucacaccagccuucuguccgggucugcgcaacacguggaagagugcagcuguuauccucgcuaccccggagugagaugcgucugucgggacaacuggaaaggcuccaaucgcccuauuguggauaucaacguuaaggacuacagcauugugucuuccuaugucugcagcggccucgugggggacacacccagaaagaaugauucuagcuccucuagccauugucuggacccgaacaaugaagagggaggccacgggguuaagggaugggccuucgaugacggcaacgauguguggauggggcggaccaucuccgaaaaacugcgcagcggauacgagacguuuaaggucauugagggcuggucuaaaccuaauuccaagcuccagaucaacagacaggugaucgucgaccggggcaaucgcagcggguauucuggaauuuucuccguggaaggcaagagcugcaucaacagauguuuuuacguugagcugauucgggggagaaaucaggaaacagaggugcuuuggaccuccaacucuaucgucguguucugcggaaccagcggcacauaugggaccggcuccuggcccgauggagcugacauuaaucugaugccuaucuga

SEQ ID NO: 197090 - RNA, 1410 nt, Artificial Sequence; identical to SEQ ID NO: 197085
  derived and/or modified sequence opt5 from neuraminidase__InfluenzaA__AAN64889

SEQ ID NO: 197091 - RNA, 1410 nt, Artificial Sequence
  derived and/or modified sequence opt5 from neuraminidase__InfluenzaA__AAN64890
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggaaaugcugugcgagcccacaaucauugaaagaaauaucaccgagauuguguaucucacaaacaccacgaucgaaaaggagauuuguccuaaacuggccgaguaccggaauuggagcaagccccagugcaacaucaccggguucgcgccuuuuuccaaagacaauucuauucgccuuagcgcuggaggcgauaucugggugacaagagaacccuaugucuccugugacccugauaagugcuaccaauucgcccuggggcagggaaccacacucaacaauggccauucuaacgacaccgugcacgaucggacgccguaucgcacacugcugaugaaugagcucgggguucccuuucaucugggaaccaaacagguguguaucgccuggagcuccagcucuugccacgacggcaaggcuuggcuucaugucugugugacaggcgaugacgaaaacgccaccgcuuccuucauuuacaaugggagacugguugauagcaucggaucuugguccaagaaaauucuccggacccaggagagcgagugcguguguaucaacggcacaugcacggucgugaugaccgacgggucugccuccggaaaggcggauacaaaaauucuguuuaucgaagagggcaagaucgugcacaccagccuucuguccgggucugcccaacacgucgaagagugcagcuguuauccucgcuaccccggaguuagaugcgugugucgggacaacuggaagggcuccaaucgcccuauuguggauaucaacgucaaagacuacagcauugugucuuccuauguuugcagcggccucgugggggacacacccagaaagaaugauucuagcuccucuagccauugucuggacccgaacaaugaagagggaggccacggggucaaaggaugggcuuucgaugacggcaacgauguguggauggggcggaccaucuccgagaagcugcgcagcggauacgaaacguuuaaaguuauugagggcuggucuaagccuaauuccaaacuccagaucaacagacaggugaucgucgaccggggcaaucgcagcggguauucuggaauuuucuccguggaaggcaagagcugcaucaacagauguuuuuacgucgagcugauucgggggagaaagcaggaaacagaggugcuuuggaccuccaauucuaucguuguguucugcggaaccagcggcacauaugggaccggcuccuggcccgauggagccgacauuaaccugaugccuaucuga

SEQ ID NO: 197092 - RNA, 1410 nt, Artificial Sequence; identical to SEQ ID NO: 197085
  derived and/or modified sequence opt5 from neuraminidase__InfluenzaA__AAN64891

SEQ ID NO: 197093 - RNA, 1410 nt, Artificial Sequence
  derived and/or modified sequence opt5 from neuraminidase__InfluenzaA__AAO46212
augaaccccaaucagaagaucauuaccaucggcagcgugucccugacaauugagacggucugcuuccucaugcaaaucgccauucuggcuaccacaguuacccuucacuuuaaacagcaugaaugugacucuccugccagcaaccaggugaugccgugcgagcccaucaucauugaaagaaauaucacagagauuguguaccugaacaauaccacaaucgaaaaggagauuuguccugaggucguggaauaucggaacugguccaaaccccagugccaaaucaccggguucgcgccuuuuucuaaggauaauagcauucgccucuccgcuggaggcgacaucuggguuacgagagagcccuacgugucuugugauaccgggaaaugcuaucaguucgcccugggacagggcacaacccuugacaacaagcacagcaaugggacaauccaugaucggauuccucaccgcacccugcucaugaacgaacugggagucccguuucaucugggcacgaaacagguguguguugccugguccuccucuuccugccacgacggcaaggcuuggcuccacgugugugucacaggggaugacagaaaugccaccgcuagcuucaucuacgauggacggcugguggacucuauuggcuccuggagccaaaacauccuucgcacacaggagucugagugcguguguauuaaugggaccugcaccgucguuaugacagauggauccgccagcggcagagcggacacgcggauccuguuuaucaaggaagggaaaauugugcauaucagcccccucucuggaagcgcccagcacauugaggaaugcuccuguuauccucgcuaccccgaugugagaugcaucugucgggacaacuggaagggcagcaaucgcccugucauugacaucaacauggaggauuauucuaucgacuccagcuacgugugcucuggccugguuggggauacccccagaaacgacgauagcuccucuaauagcaacugucgggacccgaauaacgaacgcggaaauccuggcgugaaagggugggcuuucgauaacggagacgaugucuggaugggcagaacaauuuccaaggaccuucggagcggguacgagaccuuuaaggugaucggaggcuggucuacacccaauuccaaaagccagguuaacagacaagugauugucgauaauaacaauuggucuggcuauuccgggaucuucagcguggagggaaaguccugcauuaaccgcuguuuuuacgucgaacugauccggggcagaccucaggagacccgcgugugguggacgucuaauagcauuguuguguucugcgggacauccggaaccuauggcaccgggucuuggcccgacggcgccaacaucaauuuuaugcccaucuga

SEQ ID NO: 197094 - RNA, 1410 nt, Artificial Sequence
  derived and/or modified sequence opt5 from neuraminidase__InfluenzaA__AAO46213
augaaccccaaucagaagaucauuaccaucgacagcgugucccugacaauugccacggucugcuuccucaugcaaaucgcuauucuggccaccacaguuacccuucacuuuaaacagcaugagugugauucuccugcgagcaaccaggugaugccgugcgaacccaucaucauugagagaaauaucacagaaauuguguaccugaacaauaccacaaucgagaaggaaauuuguccugaggucguggaguaucggaacugguccaaaccccagugccaaaucaccggcuucgcuccuuuuucuaaggacaauagcauucgccucuccgccgggggagauaucuggguuacgagagaacccuacgugucuugugacaccggcaaaugcuaucaguucgcccuggggcagggaacaacccuugauaacaagcacagcaauggcacaauccaugaccggauuccucaccgcacccugcucaugaacgagcugggggucccguuucaucugggaacgaaacagguguguguugcuugguccuccucuuccugccacgauggcaaggccuggcuccacgugugugucacaggcgacgauagaaaugcuaccgccagcuucaucuacgacgggcggcugguggauucuauuggauccuggagccaaaacauccuucgcacacaggaaucugagugcguguguauuaauggaaccugcaccgucguuaugacagacggguccgcgagcggcagagccgauacgcggauccuguuuaucaaggagggcaaaauugugcauaucagcccccucucugggagcgcucagcacauugaagagugcuccuguuauccucgcuaccccgacgugagaugcaucugucgggacaacuggaagggaagcaaucgcccugucauugauaucaacauggaagacuauucuaucgauuccagcuacgugugcucuggccugguuggcgacacccccagaaacgaugacagcuccucuaauagcaacugucgggauccgaauaacgagcgcgggaauccuggagugaaaggcugggccuucgacaacggggaugacgucuggaugggaagaacaauuuccaaggaucuucggagcggcuacgaaaccuuuaaggugaucgggggauggucuacacccaauuccaaaagccagguuaacagacaagugauugucgacaauaacaauuggucuggcuauuccggcaucuucagcguggaggggaaguccugcauuaaccgcuguuuuuacgucgagcugauccggggaagaccucaggaaacccgcgugugguggacgucuaauagcauuguuguguucugcggcacauccgggaccuauggaaccggcucuuggcccgacggggcuaacaucaauuuuaugcccaucuga

SEQ ID NO: 197095 - RNA, 1410 nt, Artificial Sequence
  derived and/or modified sequence opt5 from neuraminidase__InfluenzaA__AAO46214
augaaccccaaucagaagaucauuaccaucggcagcgugucccugacaauugccacggucugcuuccucaugcaaaucgcuauucuggccaccacaguuacccuucacuuuaaacagcaugagugugacucuccugcgagcaaccaggugaugccgugcgaacccaucaucauugagagaaauaucacagaaauuguguaccugaacaauaccacaaucgagaaggaaauuuguccugaggcugucgaguaucggaacugguccaaaccccagugccaaaucaccggguucgccccuuuuucuaaggauaauagcauucgccucuccgccggaggcgacaucugggugacgagagaacccuacguuucuugugauccugggaaaugcuaucaguucgcucugggacagggcaccacacuugacaacaagcacagcaaugggaccauccaugaucggauuccgcaccgcacacugcucaugaacgagcugggagugcccuuucaucugggcaccaagcaggucuguguggccugguccucuagcuccugccacgacggcaaggcuuggcuccacguuugugugacgggggaugacagaaaugccacagcgagcuucaucuacgauggacggcuggucgacucuauuggcuccuggagccaaaacauccuucgcacccaggaaucugagugcguguguauuaaugggaucugcacaguggucaugaccgauggauccgccagcggcagagcugacacccggauccuguuuauugaggaagggaaaaucguucauauuuccccucucucuggaagcgcccagcacguggaggaaugcuccuguuauccccgcuacccugaugugagaugcaucugucgggacaacuggaaaggcagcaaucgccccgucauugacaucaacauggaggauuauucuaucgacuccagcuacgugugcucuggccugguuggggauacaccgagaaacgacgaucggagcuccaauucuaacugucgcgacccuaauaacgaaagaggaaaucccggcgugaaggggugggcuuucgauaacggagacgaugucuggaugggccggacgauuagcaaagaccuuagauccggguacgagaccuuuaaggugaucggaggcuggagcacaccuaauucuaagucccagguuaaccgccaagugauugucgauaauaacaauuggagcggcuauucugggaucuucuccguggagggaaaaagcugcauuaaccgguguuuuuacgucgaacugaucagaggccgccagcaggagacccgggugugguggacauccaauucuauuguuguguucugcgggaccagcggaacguauggcacaggguccuggcccgacggcgccaacaucaauuuuaugcccaucuga

SEQ ID NO: 197096 - RNA, 1410 nt, Artificial Sequence
  derived and/or modified sequence opt5 from neuraminidase__InfluenzaA__AAO46215
augaaccccaaucagaagaucauuaccaucggcagcgugucccugacaauugccacggucugcuuccucaugcaaaucgcuauucuggccaccacaguuacccuucacuuuaaacagcaugagugugacucuccuacaagcaaccaggugaugccgugcgaacccaucaucauugagagaaauaucaccgaaauuguguaccugaacaauacaaccaucgagaaggaaauuuguccugaggucguggaguaucggaacugguccaaaccccagugccaaaucacgggguucgcgccuuuuucuaaggauaauagcauucgccucuccgcuggaggcgacaucuggguuaccagagaacccuacgugucuugugauccugggaaaugcuaucaguucgcccugggacagggcacaacccuugacaacaagcacagcaaugggacaauccaugaucggauuccgcaccgcacccugcucaugaacgagcugggaguccccuuucaucugggcacgaaacagguguguguugccugguccucuagcuccugccacgacggcaaggcuuggcuccacgugugugucacaggggaugacagaaaugccaccgcuagcuucaucuacgauggacggcugguggacucuauuggcuccuggagccaaaacauccuucgcacacaggaaucugagugcguguguauuaaugggaccugcaccgucguuaugacagauggauccgccagcggcagagcggacacgcggauccuguuuaucaaggaggggaaaauugugcauaucuccccucucucuggaagcgcccagcacauugaagagugcuccuguuauccccgcuacccugaugugagaugcaucugucgggacaacuggaagggcagcaaucgccccgucauugacaucaacauggaagauuauucuaucgacuccagcuacgugugcucuggccugguuggggauaccccgagaaacggagacagcuccucuaauagcaacugucgggauccuaauaacgagcgcggcaaucccggggugaaaggaugggcuuucgacaacggcgaugacgucuggauggggagaacaauuuccaaggaaagccggucuggauacgagaccuuuaaggugaucggcggcugguccacaccuaauagcaaaucucagguuaacagacaagugauugucgauaauaacaauugguccggguauagcggaaucuucuccguggagggcaagucuugcauuaaccgcuguuuuuacgucgaacuuauccgggggagaccccaggagacccgcgugugguggacgagcaauuccauuguuguguucugcggaacaucuggcaccuaugggaccggcagcuggcccgacggagccaacaucaauuuuaugccuaucuga

SEQ ID NO: 197097 - RNA, 1410 nt, Artificial Sequence
  derived and/or modified sequence opt5 from neuraminidase__InfluenzaA__AAO46216
augaaccccaaucagaagaucauuaccaucggcagcgugucccugacaauugccacggucugcuuccucaugcaaaucgcuauucuggccaccacaguuacccuucacuuuaaacagcaugagugugacucuccugcgagcaaccaggugaugccgugcgaacccaucaucauugagagaaauaucacagaaauuguguaccugaacaauaccacaaucgagaaggaaauuuguccugaggucguggaguaucggaacugguccaaaccccagugccaaaucaccggguucgcuccuuuuucuaaggauaauagcauucgccucuccgccggaggcgacaucuggguuacgagagaacccuacgugucuugugauccuagcaaaugcuaucaguucgcccuggggcagggaaccacacuugagaacaagcacuccaauggcaccaagcaugaccggaucccgcaccgcacacugcucaugaacgaacuggggguccccuuucaucugggaaccaaacagguguguguugcuuggucuagcuccagcugccacgauggcaaggccuggcuccacgugugugucacgggcgacgauagaaaugcuacagccucuuucauuuacgaggggcggcugguggacuccaucgugagcuggucucaaaacauucuucgcacccaggaguccgaaugcgucuguaucaauggaacaugcaccguugugaugaccgauggcagcgcguccgggagagccgacacacggauucuguuuaucaaagagggaaagaucgugcauauuucuccucucagcggcuccgcucagcacaucgaagagugcagcuguuauccccgcuacccugaugucagaugcauuugucgggacaacuggaaagggucuaaucgccccgugaucgauauuaacauggaagacuauuccaucgacagcucuuacguuugcagcggacuggugggcgauacgccgagaaacgacgauuccucuagcaauuccaacugucgggacccuaauaacgagcgcggcaaucccggggucaagggaugggccuucgauaacggcgacgauguguggauggggagaaccaucagcaaggacucucgguccggauacgagacauuuaaaguuauuggcggguggagcaccccuaauucuaagucccaggugaacagacaagucaucguggauagcaauaacugguccggauauucuggcauuuucagcgucgaaggcaaauccugcaucaaucgcuguuuuuacguggagcuuauucgggggagaccccaggaaacacgcguuugguggaccucuaacagcaucguggucuucugcggaacguccggcacauaugggaccggaagcuggcccgacggcgcuaauauuaacuuuaugccuaucuga

SEQ ID NO: 197098 - RNA, 1410 nt, Artificial Sequence
  derived and/or modified sequence opt5 from neuraminidase__InfluenzaA__AAO46217
augaaccccaaucagaagaucauuaccaucggcagcgugucccugacaauugccacggucugcuuccucaugcaaaucgcuauucuggccaccacaguuacccuucacuuuaaacagcaugagugugacucuccugcgagcaaccaggugaugccgugcgaacccaucaucauugagagaaauaucacagaaauuguguaccugaacaauaccacaaucgagaaggaaauuuguccugaggucguggaguaucggaacugguccaaaccccagugccaaaucaccggguucgcuccuuuuucuaaggauaauagcauucgccucuccgccggaggcgacaucuggguuacgagagaacccuacgugucuugugauccuagcaaaugcuaucaguucgcccuggggcagggaaccacacuugacaacaagcacuccaauggcaccauccaugaucggauuccgcaccgcacacugcucaugaacgagcuggggguccccuuucaucugggaaccaaacagguguguguugcuuggucuagcuccagcugccacgacggcaaggccuggcuccacgugugugucacgggcgaugacagaaaugcuacagccucuuucaucuacgaugggcggcuggaagacuccauuggaagcuggucucaaaacauccuucgcacccaggaguccgagugcguguguauuaauggcacaugcaccguggucaugaccgaugggagcgcguccgggagagccgacacacggauccuguuuaucaaggaaggcaaaauuguucauaucucuccucucagcggguccgcucagcacauugaggaaugcagcuguuauccccgcuacccugaugugagaugcaucugucgggacaacuggaagggaucuaaucgccccgugcuggacauuuccauggaggauuauagcaucgacucuagcuacgucugcuccggccuugugggcgauacgccgagaaacgacgauucuagcuccaacagcaauugucgggacccuaacaaugaacgcgggaaccccggaguuaaaggcugggccuucgauaauggggacgauguguggaugggaagaaccaucucuaaggaccugcgguccggcuacgagacauuuaaggucauugggggauggagcaccccuaacucuaaaucccaggugaauagacaaguuaucguggauaacaauaacuggagcggcuauuccggcauuuucucugucgagggaaagagcugcaucaaucgcuguuuuuacguggaacucauucggggaagaucccaggagacacgcgucugguggaccucuaacagcaucgugguuuucugcggcacguccgggacauauggaaccggcagcuggcccgacggggcuaauauuaacuuuaugcccaucuga

SEQ ID NO: 197099 - RNA, 1410 nt, Artificial Sequence
  derived and/or modified sequence opt5 from neuraminidase__InfluenzaA__AAO46218
augaaccccaaucagaagaucauuaccaucggcagcgugucccugacaauugccacggucugcuuccucaugcaaaucgcuauucuggccaccacaguuacccuucacuuuaaacagcaugagugugacucuccugcgagcaaccaggugaugccgugcgaacccaucaucauugagagaaauaucacagaaauuguguaccugaacaauaccacaaucgagaaggaaauuuguccugaggucguggaguaucggaacugguccaaaccccagugccaaaucaccggguucgcuccuuuuucuaaggauaauagcauucgccucuccgccggaggcgacaucuggguuacgagagaacccuacgugucuugugauccugggaaaugcuaucaguucgcccugggacagggcaccacacuugacaacaagcacagcaaugggaccauccaugaucggauuccgcaccgcacacugcucaugaacgagcugggaguccccuuucaucugggcaccaaacagguguguguugcuugguccucuagcuccugccacgacggcaaggccuggcuccacgugugugucacgggggaugacagaaaugcuacagccagcuucaucuacgauggacggcuggaagacucuauuggcuccuggagccaaaacauccuucgcacccaggagucugagugcguguguauuaaugggacaugcaccguggucaugaccgauggauccgcgagcggcagagccgacacacggauccuguuuaucaaggaagggaaaauuguucauaucuccccucucucuggaagcgcucagcacauugaggaaugcuccuguuauccccgcuacccugaugugagaugcaucugucgggacaacuggaagggcagcaaucgccccgugcuggacauuucuauggaggauuauuccaucggcagcucuuacgucugcagcgggcuugugggagacacgccgagaaacgaugacuccucuagcaacuccaauugucgggauccuaacaaugaacgcggcaaccccgggguuaaaggaugggccuucgacaauggcgaugacguguggauggggagaaccaucagcaaggaucugcggucuggauacgagacauuuaaggucauuggcggcugguccaccccuaacagcaaaucucaggugaauagacaaguuaucguggacaacaauaacugguccggguauagcggaauuuucuccgucgagggcaagucuugcaucaaucgcuguuuuuacguggaacucauucgggggagaagccaggagacacgcgucugguggaccuccaacucuaucgugguuuucugcggaacgagcggcacauaugggaccggcuccuggcccgauggagcuaauauuaacuuuaugcccaucuga

SEQ ID NO: 197100 - RNA, 1410 nt, Artificial Sequence
  derived and/or modified sequence opt5 from neuraminidase__InfluenzaA__AAO46220
augaaccccaaucagaagaucauuaccaucggcagcgugucccugacaauugccacggucugcuuccucaugcaaaucgcuauucuggccaccacaguuacccuucacuuuaaacagcaugagugugacucuccugcgagcaaccaggugaugccgugcgaacccaucaucauugagagaaauaucacagaaauuguguaccugaacaauaccacaaucgagaaggaaauuuguccugaggcugucgaguaucggaacugguccaaaccccagugccaaaucaccggguucgccccuuuuucuaaggauaauagcauucgccucuccgccggaggcgacaucugggugacgagagaacccuacguuucuugugauccugggaaaugcuaucaguucgcucugggacagggcaccacacuugacaacaagcacagcaaugauaccauccaugaccggauuccgcaccgcacacugcucaugaacgagcugggggugcccuuucaucugggaaccagacaggucuguguggccugguccagcagcuccugccacgauggcaaggcuuggcuccacguuugugugacgggcgacgaucggaaugccacagcgagcuucaucuacgacgggcgccuggucgauucuauuggauccuggagccaaaacauccuuagaacccaggaaucugagugcguguguauuaauggcaucugcacaguggucaugaccgacggguccgccagcggacgggcugauacccgcauccuguuuauugaggaaggcaaaaucguucauauuuccccucucucugggagcgcccagcacguggaggaaugcuccuguuaucccagauacccugacgugcggugcaucugucgcgacaacuggaagggaagcaauagacccgucauugauaucaacauggaggacuauucuaucgauuccagcuacgugugcucuggccugguuggcgacacaccgcggaacgaugaccgcagcuccaauucuaacuguagagauccuaauaacgaacgggggaaucccggagugaaaggcugggcuuucgacaacggggaugacgucuggaugggaagaacgauuagcaaggaucuucgcuccggcuacgagaccuuuaaagugaucgggggauggagcacaccuaauucuaagucccagguuaaccggcaagugauugucgacaauaacaauuggagcggcuauucuggcaucuucuccguggaggggaagucuugcauuaacagauguuuuuacgucgaacugauccgcggacggcagcaggagaccagagugugguggacauccaauucuauuguuguguucugcggcaccagcgggacguauggaacaggcuccuggcccgacggggccaacaucaauuuuaugcccaucuga

SEQ ID NO: 197101 - RNA, 1410 nt, Artificial Sequence
  derived and/or modified sequence opt5 from neuraminidase__InfluenzaA__AAO46221
augaaccccaaucagaagaucauuaccaucggcagcgugucccugacaauugccacggucugcuuccucaugcaaaucgcuauucuggccaccacaguuacccuucacuuuaaacagcaugagugugacucuccugcgagcaaccaggugaugccgugcgaacccaucaucauugagagaaauaucacagaaauuguguaccugaacaauaccacaaucgagaaggaaauuuguccugaggcugccgaguaucggaacugguccaaaccccagugccaaaucaccggguucgccccuuuuucuaaggauaauagcauucgccucuccgcuggaggcgacaucugggucacgagagaacccuacgugucuugugauccugggaaaugcuaucaguucgcccugggacagggcaccacacuugacaacaagcacagcaaugauaccauccaugaccggauuccgcaccgcacacugcucaugaacgagcuggggguucccuuucaucugggaaccagacaggugugugucgcuugguccagcagcuccugccacgauggcaaggccuggcuccacguguguguuacgggcgacgaucggaaugcgacagccagcuucaucuacgacgggcgccugguggauucuauuggauccuggagccaaaacauccuuagaacccaggaaucugagugcgucuguauuaauggcaucugcacaguggugaugaccgacggguccgcuagcggacgggccgauacccgcauccuguuuauugaggaaggcaaaaucguccauauuuccccucucucugggagcgcucagcacguugaggaaugcuccuguuaucccagauacccugacgugcggugcaucugucgcgacaacuggaagggaagcaauagacccgugauugauaucaacauggaggacuauucuaucgauuccagcuacgucugcucuggccuggugggcgacacaccgcggaacgaugaccgcagcuccaauucuaacuguagagauccuaauaacgaacgggggaaucccggaguuaaaggcugggccuucgacaacggggaugacguguggaugggaagaacgauuagcaaggaucuucgcuccggcuacgagaccuuuaaagucaucgggggauggagcacaccuaauucuaagucccaggugaaccggcaaguuauuguggacaauaacaauuggagcggcuauucuggcaucuucuccgucgaggggaagucuugcauuaacagauguuuuuacguggaacugauccgcggacggcagcaggagaccagagucugguggacauccaauucuauugugguuuucugcggcaccagcgggacguauggaacaggcuccuggcccgacggggcgaacaucaauuuuaugcccaucuga

SEQ ID NO: 197102 - RNA, 1410 nt, Artificial Sequence
  derived and/or modified sequence opt5 from neuraminidase__InfluenzaA__AAO46223
augaaccccaaucagaagaucauuaccaucggcagcgugucccugacaauugccacggucugcuuccucaugcaaaucgcuauucugguuaccacagugacccuucacuuuaaacagcaugagugugacucuccugccagcaaccaggugaugccgugcgaacccaucaucauugagagaaauaucacagaaauugucuaccugaacaauaccacaaucgagaaggaaauuuguccugaggugguugaguaucggaacugguccaaaccccagugccaaaucaccggguucgcgccuuuuucuaaggauaauagcauucgccucuccgcuggaggcgacaucugggugacgagagaacccuacgucucuugugauccugggaaaugcuaucaguucgcccugggacagggcaccacacuugacaacaagcacagcaaugauaccauccaugaccggauuccgcaccgcacacugcucaugaacgagcugggggugcccuuucaucugggaaccagacagguuuguguggccugguccucuagcuccugccacgauggcaaggcuuggcuccacgucugugugacgggcgacgauaaaaaugccacagcuagcuucaucuacgacgggcggcugguggauucuauuggauccuggagccaaaacauccuucgcacccaggaaucugagugcgucuguauuaauggcacaugcaccguugugaugaccgacggguccgccagcggcagagcggauacacggauccuguuuaucgaggaaggaaagauugugcauaucuccccucucucugggagcgcccagcacgucgaggaaugcuccuguuauccccgcuacccugacgugagaugcauuugucgggacaacuggaaaggaagcaaucgccccguuaucgauauuaacauggaggacuauucuaucgauuccagcuacgugugcucuggccuggucggcgacacgccgagaaacgaugaccggagcuccaauucuaacugucgcgauccuaauaacgaaagagggaaucccggagugaagggcugggcuuucgacaacggggaugacguuuggaugggacggaccaucagcaaagaucuuagauccggcuacgagacauuuaaggugauugggggauggagcaccccuaauucuaagucccagaucaaccgccaagucauuguggacagcaauaacuggucuggcuauuccggcaucuucagcgucgaggggaaauccugcauuaaucgguguuuuuacguggaacugaucagaggacgcaagcaggagacacggguuugguggaccucuaacagcauuguggucuucugcggcacguccgggacauauggaaccggcucuuggcccgacggggccaauaucaacuuuaugcccaucuga

SEQ ID NO: 197103 - RNA, 1410 nt, Artificial Sequence; identical to SEQ ID NO: 197102
  derived and/or modified sequence opt5 from neuraminidase__InfluenzaA__AAO46224

SEQ ID NO: 197104 - RNA, 1410 nt, Artificial Sequence
  derived and/or modified sequence opt5 from neuraminidase__InfluenzaA__AAO46225
augaaccccaaucagaagaucauuaccaucggcuucgugagccugauuaucgccacagucugcuuucucaugcaaauugcuauccuggccacgaccguuacacuucacuucaaacagcaugagugugacuccccugcgucuaaccaggugaugccgugcgaacccaucauuaucgagagaaauauuaccaagaucguguaccugaacaauacaaccauugaaaaagagaucuguccugaagucguggaguaucggaacuggagcaagccccagugccacauuacaggguuugcuccuuucuccaaagauaauucuauccgccucagcgccggaggcgacaucuggguuaccagagagcccuacguguccugugauccugggaagugcuaucaauuugcccugggacagggcacgacccuugacaacaagcauucuaaugauacaauucacgaccggaucccgcaucgcacccugcucaugaacgaacuggggguccccuuccaccugggaacaagacagguguguguugcuuggagcuccagcucuugccacgauggcaaagccuggcuccaugugugugucaccggcgacgauaagaaugcuacggccuccuuuauuuacgacgggcggcugguggauagcaucggaucuuggucccacaacauucuucgcacacaggagagcgaaugcguguguaucaauggaaccugcacagucguuaugaccgacgggucugcguccggcagagccgauacccggauccuguucauuaaagagggcaagaucgugcauauuagcccucucuccgggucugcucaacacguggaggaaugcagcuguuauccccgcuacccugacgucagaugcaucugucgggacaacuggaaaggauccaaucgccccgugauugauaucaacauggaggacuauagcaucgauucuuccuacguuugcagcggccuggugggcgacacaccgagaaacaaugaugggucuagcaacuccaauugucgggacccuaacaaugaacgcggaaaccccggcgucaaggggugggccuuugauaauggagacgauguguggaugggcagaacgauuucuaaggaccuucggagcggguacgagaccuucaaaguuaucggaggcugguccacaccuaacagcaagucucaggugaauagacaggucauuguggauaacaauaacugguccggcuauagcgggaucuuuucugucgaaggaaaauccugcauuaaucgcuguuucuacguggagcugauccggggcagacagcaagagacccgcguuugguggacaagcaacuccauuguggucuuuugcgggaccucuggaacguauggcacagggagcuggcccgacggcgcuaauaucaacuucaugcccaucuga

SEQ ID NO: 197105 - RNA, 1410 nt, Artificial Sequence
  derived and/or modified sequence opt5 from neuraminidase__InfluenzaA__AAO46226
augaaccccaaucagaagaucauuaccaucggcagcgugucccugacaauugccacggucugcuuccucaugcaaaucgcuauucugguuaccacagugacccuucacuuuaaacagcaugagugugacucuccugccagcaaccaggugaugccgugcgaacccaucaucauugagagaaauaucacagaaauugucuaccugaacaauaccacaaucgagaaggaaauuuguccugaggugguugaguaucggaacugguccaaaccccagugccaaaucaccggguucgcgccuuuuucuaaggauaauagcauucgccucuccgcuggaggcgacaucugggugacgagagaacccuacgucucuugugauccugggaaaugcuaucaguucgcccugggacagggcaccacacuugacaacaagcacagcaaugauaccauccaugaccggauuccgcaccgcacacugcucaugaacgagcugggggugcccuuucaucugggaaccagacagguuuguguggccugguccucuagcuccugccacgauggcaaggcuuggcuccacgucugugugacgggcgacgaugaaaaugccacagcuagcuucaucuacgacgggcggcugguggauucuauuggauccuggagccaaaacauccuucgcacccaggagucugagugcgucuguauuaauggcacaugcaccguugugaugaccgacggguccgccagcggcagagcggauacacggauccuguuuaucgaagagggaaaaauugugcauaucuccccucucucugggagcgcccagcacgucgaagagugcuccuguuauccccgcuacccugacgugagaugcauuugucgggacaacuggaagggaagcaaucgccccguuaucgauauuaacauggaagacuauucuaucgauuccagcuacgugugcucuggccuggucggcgacacgccgagaaacgaugaccggagcuccaauucuaacugucgcgauccuaauaacgagagagggaaucccggagugaaaggcugggcuuucgacaacggggaugacguuuggaugggacggaccaucagcaaggaucuuagauccggcuacgagacauuuaaagugauugggggauggagcaccccuaauucuaagucccagaucaaccgccaagucauuguggacagcaauaacuggucuggcuauuccggcaucuucagcgucgaagggaaguccugcauuaaucgguguuuuuacguggagcugaucagaggacgccagcaggaaacacggguuugguggaccucuaacagcauuguggucuucugcggcacguccgggacauauggaaccggcucuuggcccgacggggccaauaucaacuuuaugcccaucuga

SEQ ID NO: 197106 - RNA, 1410 nt, Artificial Sequence
  derived and/or modified sequence opt5 from neuraminidase__InfluenzaA__AAO46229
augaaccccaaucagaagaucauuaccaucggcagcgugucccugacaauugccacggucugcuuccucaugcaaaucgcuauucugguuaccacagugacccuucacuuuaaacagcaugagugugacucuccugccagcaaccaggugaugccgugcgaacccaucaucauugagagaaauaucacagaaauuauguaccugaacaauaccacaaucgagaaggaaauuuguccugaggucguggaguaucggaacugguccaaaccccagugccaaaucaccggguucgcgccuuuuucuaaggauaauagcauucgccucuccgcuggaggcgacaucuggguuacgagagaacccuacgugucuugugauccugggaaaugcuaucaguucgcccugggacagggcaccacacuugacaacaagcacagcaaugauaccauccaugaccggauuccgcaccgcacacugcucaugaacgagcuggggguccccuuucaucugggaaccagacagguguguguugccugguccucuagcuccugccacgauggcaaggcuuggcuccacgugugugucacgggcgacgauaaaaaugccacagcuagcuucaucuacgacgggcggcugguggauucuauuggauccuggagccaaaacauccuucgcacccaggaaucugagugcguguguauuaauggcacaugcaccgucguuaugaccgacggguccgccagcggcagagcggauacacggauccuguuuaucgaggaaggaaagauugugcauaucuccccucucucugggagcgcccagcacguggaggaaugcuccuguuauccccgcuacccugacgucagaugcauuugucgggacaacuggaaaggaagcaaucgccccaucauugauaucaacauggaggacuauucuaucgauuccagcuacgugugcucuggccugguuggcgacacgccgagaaacgaugaccggagcuccaauucuaacugucgcaauccuaacaaugaaagagggaaccccggagugaagggcugggcuuucgauaauggggacgaugucuggaugggacggaccauuagcaaagaccuuagauccggcuacgagacauuuaaggugaucgggggauggagcaccccuaacucuaagucccagauuaaucgccaaguuaucguggauagcaacaauuggucuggcuauuccggcauuuucagcgucgaggggaaauccugcaucaaccgguguuuuuacguggaacugauuagaggacgccagcaggagacacgggucugguggaccucuaauagcaucgugguuuucugcggcacguccgggacauauggaaccggcucuuggcccgacggggccaacaucaauuuuaugcccauuuga

SEQ ID NO: 197107 - RNA, 1410 nt, Artificial Sequence
  derived and/or modified sequence opt5 from neuraminidase__InfluenzaA__AAO46230
augaaccccaaucagaagaucauuaccaucggcagcgugucccugacaauugccacggucugcuuccucaugcaaaucgcuauucugguuaccacagugacccuucacuuuaaacagcaugagugugacucuccugccagcaaccaggugaugccgugcgaacccaucaucauugagagaaaucugacagaaaucgucuaccucaacaauaccacaauugagaaggaaaucuguccugaggugguugaguaucggaacugguccaaaccccagugccaaauuaccggguucgcgccuuuuucuaaggauaauagcauccgccuguccgcuggaggcgacauuugggugacgagagaacccuacgucucuugugauccugggaaaugcuaucaguucgcccuuggacagggcaccacacuggacaacaagcacagcaaugauaccauccaugaccggaucccgcaccgcacacuccugaugaacgagcugggggugcccuuucaucucggaaccagacagguuuguguggccugguccucuagcuccugccacgauggcaaggcuuggcugcacgucugugugacgggcgacgauaaaaaugccacagcuagcuucauuuacgacgggcggcuuguggauucuaucggauccuggagccaaaacauucugcgcacccaggaaucugagugcgucuguaucaauggcacaugcaccguugugaugaccgacggguccgccagcggcagagcggauacacggauucucuuuaucgaggaaggaaagaucgugcauauuuccccucugucugggagcgcccagcacgucgaggaaugcuccuguuauccccgcuacccugacgugagaugcaucugucgggacaacuggaaaggaagcaaucgccccguuauugauaucaacauggaggacuauucuauugauuccagcuacgugugcucuggccuugucggcgacacgccgagaaacgaugaccggagcuccaauucuaacugucgcgauccuaauaacgaaagagggaaucccggagugaagggcugggcuuucgacaacggggaugacguuuggaugggacggaccaucagcaaagaucugagauccggcuacgagacauuuaaggugaucgggggauggagcaccccuaauucuaagucccagauuaaccgccaagucaucguggacagcaauaacuggucuggcuauuccggcauuuucagcgucgaggggaaauccugcaucaaucgguguuuuuacguggaacucauuagaggacgccagcaggagacacggguuugguggaccucuaacagcaucguggucuucugcggcacguccgggacauauggaaccggcucuuggcccgacggggccaauauuaacuuuaugcccaucuga

SEQ ID NO: 197108 - RNA, 1410 nt, Artificial Sequence
  derived and/or modified sequence opt5 from neuraminidase__InfluenzaA__AAO46231
augaaccccaaucagaagaucauuaccaucggcagcgugucccugacaauugccacggucugcuuccucaugcaaaucgcuauucugguuaccacagugacccuucacuuuaaacagcaugacugugauucuccugccagcaaccaggugaugccgugcgagcccaucaucauugaaagaaauaucacagagauugucuaccugaacaauaccacaaucgaaaaggagauuuguccuaaagugguugaauaucggaacugguccaagccccagugccaaaucaccggguucgcgccuuuuucuaaagacaauagcauucgccucuccgcuggaggcgauaucugggugacgagagagcccuacgucucuugugacccugugaagugcuaucaguucgcccuggggcagggaaccacacuugauaacaagcacagcaaugacaccguucaugaucggaucccgcaccgcacacugcucaugaacgagcugggcgugcccuuucaucuggggaccagacaggucuguauugccugguccucuagcuccugccacgacggaaaggcuuggcuccacgugugugugacgggcgaugacaaaaaugccacagcuagcuucaucuacgauggccggcuggucgacucuauuggguccuggagccaaaacauccuucgcacccaggaaucugagugcguuuguauuaauggaacaugcaccguggugaugaccgauggcuccgccagcgggagagcggacacacggauccuguuuaucgaagagggaaaaauuguccauaucuccccucucucuggcagcgcccagcacguggaggaaugcuccuguuauccccgcuacccugacguuagaugcauuugucgggauaacuggaaggggagcaaucgccccgugaucgacauuaacauggaggauuauucuaucgacuccagcuacgucugcucuggacuggugggcgauacgccgagaaacgacgaucggagcuccaauucuaacugucgcaauccuaacaaugaaagaggcaaccccgggguuaaaggaugggcuuucgacaauggcgaugacguguggauggggcggaccaucagcaaggaucuuagauccggauacgagacauuuaaggucauuggcggguggagcaccccuaacucuaaaucccagaucaaucgccaagugauugucgacagcaacaauuggucuggauauuccggcaucuucagcguggaaggcaaguccugcauuaaccgguguuuuuacguugagcugaucagagggcgccagcaggagacacgggugugguggaccucuaauagcauugucguguucugcggaacguccggcacauaugggaccggaucuuggcccgacggcgccaacaucaauuuuaugcccaucuga

SEQ ID NO: 197109 - RNA, 1410 nt, Artificial Sequence
  derived and/or modified sequence opt5 from neuraminidase__InfluenzaA__AAO46232
augaaccccaaucagaagaucauuaccaucggcagcgugucccugacaauugccacggucugcuuccucaugcaaaucgcuauucugguuaccacagugacccuucacuuuaaacagcaugagugugacucuccugccagcaaccaggugaugccgugcgaacccacaaucaucgagagaaauauuaccgaaaucgucuaccugaacaauacaaccauugagaaggaaaucuguccuaaagugguugaguaucggaacugguccaagccccagugccaaauuacgggguucgcgccuuuuucuaaagauaauagcauccgccucuccgcuggaggcgacauuugggugaccagagagcccuacgucucuugugauccugggaagugcuaucaguucgcccugggacagggcacaacccuugacaacaagcacagcaaugauacaauccaugaccggaucccgcaccgcacccugcucaugaacgaacugggggugcccuuucaucugggaacgagacagguuuguauugccugguccucuagcuccugccacgauggcaaggcuuggcuccacgugugugucacaggcgacgauaaaaaugccaccgcuagcuucaucuacgacgggcggcugguggauucuauuggauccuggagccaaaacauccuucgcacacaggagucugaaugcguguguauuaauggaaccugcaccgucguuaugacagacggguccgccagcggcagagcggauacgcggauccuguuuaucgaggagggcaaaauugugcauaucuccccucucucugggagcgcccagcacguggaagagugcuccuguuauccccgcuacccugacgucagaugcauuugucgggacaacuggaagggaagcaaucgccccaucauugauaucaacauggaagacuauucuaucgauuccagcuacgugugcucuggccugguuggcgacaccccgagaaacgaugaccggagcuccaauucuaacugucgcaauccuaacaaugagagagggaaccccggagugaaaggcugggcuuucgauaauggggacgaugucuggaugggacggacaauuagcaaggaccuuagauccggcuacgaaaccuuuaaggugaucgggggauggagcacaccuaacucuaaaucccagauuaaucgccaaguuaucguggauagcaacaauuggucuggcuauuccggcauuuucagcgucgaggggaaguccugcaucaaccgguguuuuuacguggagcugauuagaggacgccagcaggaaacccgggucugguggacgucuaauagcaucgugguuuucugcggcacauccgggaccuauggaaccggcucuuggcccgacggggccaacaucaauuuuaugcccauuuga

SEQ ID NO: 197110 - RNA, 1410 nt, Artificial Sequence
  derived and/or modified sequence opt5 from neuraminidase__InfluenzaA__AAO46233
augaaccccaaucagaagaucauuaccaucggcagcgugucccugacaauugccgcugucugcuuccucaugcaaaucgccauucugguuacgaccgugacacuucacuuuaaacagcaugagugugacucuccugcgagcaaccaggugaugccgugcgaacccaucaucauugagagaaauaucaccgaaauugucuaccugaacaauacaaccaucgagaaggaaauuuguccuaaagugguugaguaucggaacugguccaagccccagugccaaaucacaggguucgcuccuuuuucuaaagauaauagcauucgccucuccgccggaggcgacaucugggugaccagagagcccuacgucucuugugauccugggaagugcuaucaguucgcccugggacagggcacgacccuugacaacaagcacagcaaugauacaauccaugaccggauuccgcaccgcacccugcucaugaacgaacugggggugcccuuucaucugggaacaagacagguuuguaucgcuugguccucuagcuccugccacgauggcaaagccuggcuccacgugugugucaccggcgacgauaagaaugcuacggccagcuucauuuacgacgggcggcugguggauucuaucggauccuggagccaaaacauucuucgcacacaggagucugaaugcguguguaucaauggaaccugcacagucguuaugaccgacggguccgcgagcggcagagccgauacccggauccuguuuauugaggagggcaaaaucgugcauauuuccccucucucugggagcgcucagcacguggaagagugcuccuguuauccccgcuacccugacgucagaugcaucugucgggacaacuggaagggaagcaaucgccccgugguugauauuaacauggaagacuauucuaucgauuccagcuacgugugcucuggccuggucggcgacacaccgagaaacgaugaccggagcuccaauucuaacugucgcaauccuaacaaugagagagggaaccccggagugaaaggcugggccuucgauaauggggacgauguuuggaugggacggacgaucagcaaggaccuuagauccggcuacgaaaccuuuaaggugauugggggauggagcacaccuaacucuaaaucccagaucaaucgccaagucauuguggauagcaacaaucggucuggcuauuccggcaucuucagcgucgaggggaagggaugcauuaacagauguuuuuacguggagcugauccgcggccggcagcaggaaaccagaguuugguggacauccaauucuauuguggucuucugcgggaccagcggaacguauggcacaggguccuggcccgacggcgcuaacaucaauuuuaugcccaucuga

SEQ ID NO: 197111 - RNA, 1410 nt, Artificial Sequence
  derived and/or modified sequence opt5 from neuraminidase__InfluenzaA__AAO46235
augaaccccaaucagaagaucauuaccaucggcagcgugucccugacaauugccacggucugcuuccucaugcaaaucgcuauucugguuaccacagugacccuucacuuuaaacagcaugagugugacucuccugccagcaaccaggugaugccgugcgaacccaucaucauugagagaaauaucacagaaauugucuaccugaacaauaccacaaucgagaaggaaauuuguccuaaagugguugaguaucggaacugguccaagccccagugccaaaucaccggguucgcgccuuuuucuaaagauaauagcauucgccucuccgcuggaggcgacaucugggugacgagagagcccuacgucucuugugauccugggaagugcuaucaguucgcccugggacagggcaccacacuugacaacaagcacagcaaugauaccauccaugaccggauuccgcaccgcacacugcucaugaacgaacugggggugcccuuucaucugggaaccagacagguuuguaucgccugguccucuagcuccugccacgauggcaaggcuuggcuccacguguguauuacgggcgacgauaaaaaugccacagcuagcuucaucuacgacgggcggcuggucgauucuauuggauccuggagccaaaacauccuucgcacccaggagucugaaugcguguguaucaauggcacaugcaccguggucaugaccgacggguccgccagcggcagagcggauacacggauucuguuuaucgaggagggaaaaauuguucauaucuccccucucucugggagcgcccagcacguggaagagugcuccuguuauccccgcuacccuggagugagaugcauuugucgggacaacuggaagggcagcaaucgccccgucguggacaucaacauggaagauuauucuaucgacuccagcuacguuugcucuggccuggugggggauacgccgagaaacgacgaucggagcuccaauucuaacugucgcaauccuaacaaugagagaggaaaccagggcgucaaagggugggcuuucgacaauggagaugacguguggaugggccggaccauuagcaaggaucuuagauccggguacgaaacauuuaagguuaucggaggcuggagcacccccaacucuaaaucccaaauuaaucgccaggugaucgucgacagcgauaaccggucuggcuauuccgggauuuucagcguggagggaaaguccugcaucaauagauguuuuuacgucgagcugauucgcggccggaaacaggaaacaagagugugguggaccucuaacagcaucguuguguucugcgggacguccggaacauauggcaccgggucuuggccugacggcgccaauaucaacuuuaugcccauuuga

SEQ ID NO: 197112 - RNA, 1410 nt, Artificial Sequence
  derived and/or modified sequence opt5 from neuraminidase__InfluenzaA__AAO46236
augaaccccaaucagaagaucauuaccaucggcagcgugucccugacaauugccacggucugcuuccucaugcacaucgcuauucugguuaccacagugacccuucauuuuaaacaacacgagugugacucuccugccagcaaccaggugaugccgugcgaacccaucaucauugagagaaauaucacagaaauugucuaccugaacaauaccacaaucgagaaggaaauuuguccuaaagugguugaguaucggaacugguccaagccccagugccagaucaccggguucgcgccuuuuucuaaagauaauagcauucgccucuccgcuggaggcgacaucugggugacgagagagcccuacgucucuugugauccugggaagugcuaucaauucgcccugggacagggcaccacacuugacaacaagcauagcaaugauaccauccacgaccggauuccgcaucgcacacugcucaugaacgaacugggggugcccuuucaccugggaaccagacagguuuguaucgccugguccucuagcuccugccacgauggcaaggcuuggcuccauguguguauuacgggcgacgauaaaaaugccacagcuagcuucaucuacgacgggcggcuggucgauucuauuggauccuggagccagaacauccuucgcacccaagagucugaaugcguguguaucaauggcacaugcaccguggucaugaccgacggguccgccagcggcagagcggauacacggauucuguuuaucgaggagggaaaaauuguucacaucuccccucucucugggagcgcccagcauguggaagagugcuccuguuauccccgcuacccuggagugagaugcauuugucgggacaacuggaagggcagcaaucgccccgucguggacaucaacauggaagauuauucuaucgacuccagcuacguuugcucuggccuggugggggauacgccgagaaacgacgaucggagcuccaauucuaacugucgcaauccuaacaaugagagaggaaaccagggcgucaaagggugggcuuucgacaauggagaugacguguggaugggccggaccauuagcaaggaucuuagauccggguacgaaacauuuaagguuaucggaggcuggagcacccccaacucuaaaucccagauuaaucgccaagugaucgucgacagcgauaaccggucuggcuauuccgggauuuucagcguggagggaaaguccugcaucaauagauguuuuuacgucgagcugauucgcggccggaaacaggaaacaagagugugguggaccucuaacagcaucguuguguucugcgggacguccggaacauauggcaccgggucuuggccugacggcgccaauaucaacuuuaugcccauuuga

SEQ ID NO: 197113 - RNA, 1410 nt, Artificial Sequence
  derived and/or modified sequence opt5 from neuraminidase__InfluenzaA__AAO46237
augaaccccaaucagaagaucauuaccaucggcagcgugucccugacaauugccacggucugcuuccucaugcaaaucgcuauucugguuaccacagugacccuucacuuuaaacagcaugagugugacucuccugccagcaaccaggugaugccgugcgaacccaucaucauugagagaaauaucacagaaauugucuaccugaacaauaccacaaucgagaaggaaauuuguccuaaaaucguggaguaucggaacugguccaagccccagugccaaauuaccggguucgcgccuuuuucuaaagauaauagcauccgccucuccgcuggaggcgacaucuggguuacgagagagcccuacgugucuugugauccugggaagugcuaucaguucgcccugggacagggcaccacacuugacaacaagcacagcaaugauaccauucaugaccggaucccgcaccgcacacugcucaugaacgaacuggggguccccuuucaucugggaaccagacagguguguauugccugguccucuagcuccugccacgauggcaaggcuuggcuccacguuuguaucacgggcgacgauaaaaaugccacagcuagcuucauuuacgacgggcggcugguggauucuaucggauccuggagccaaaacauccuucgcacccaggagucugaaugcgucuguauuaauggcacaugcaccguggugaugaccgacggguccgccagcggcagagcggauacacggauccuguuuauugaggagggaaaaaucguccauauuuccccucucucugggagcgcccagcacguugaagagugcuccuguuauccccgcuacccuggagugagaugcaucugucgggacaacuggaagggcagcaaucgccccguggucgacaucaacauggaagauuauucuauugacuccagcuacgugugcucuggccugguuggggauacgccgagaaacgacgaucggagcuccaauucuaacugucgcaauccuaacaaugagagaggaaaccagggcgugaaagggugggcuuucgacaauggagaugacgucuggaugggccggaccaucagcaaggaucuuagauccggguacgaaacauuuaaggugauuggaggcuggagcacccccaacucuaaaucccaaaucaaucgccagguuauuguggacagcgauaaccggucuggcuauuccgggaucuucagcgucgagggaaaguccugcauuaauagauguuuuuacguggagcugauccgcggccggaaacaggaaacaagagucugguggaccucuaacagcaucgugguuuucugcgggacguccggaacauauggcaccgggucuuggccugacggcgccaauauuaacuuuaugcccaucuga

SEQ ID NO: 197114 - RNA, 1410 nt, Artificial Sequence
  derived and/or modified sequence opt5 from neuraminidase__InfluenzaA__AAO46238
augaaccccaaucagaagaucauuaccaucggcagcgccucccugacaauugcuacggugugcuuccucaugcaaaucgccauucuggucaccacaguuacccuucacuuuaaacagcaugagugugacucuccugcgagcaaccaggugaugccgugcgaacccaucaucauugagagaaauaucacagaaauuguguaccugaacaauaccacaaucgagaaggaaauuuguccuaaaaucgucgaguaucggaacugguccaagccccagugcaaaauuaccggguucgcuccuuuuucuaaggauaauagcauccgccucuccgccggaggcgacaucugggugacgagagagcccuacguuucuugugauccugggaagugcuaucaauucgcccugggacagggcaccacacuugacaacaaacacagcaaugauaccauucaugaccggaucccgcaccgcacacugcucaugaacgaacugggggugcccuuucaucugggaaccagacaggucuguauugcuugguccucuagcuccugccacgauggcaaggccuggcuccacguguguguuacgggcgacgauaaaaaugcuacagccagcuucaucuacgacgggcggcugguggauucuauuggauccuggagccagaacauccuucgcacccaagagucugaaugcgucuguaucaauggcacaugcaccguggugaugaccgacggguccgcgagcggcagagccgauacacggauucuguuuaucgaggagggaaagauuguccauaucuccccucucucugggagcgcucagcacguugaagagugcuccuguuauccccgcuacccugacgugagaugcauuugucgggacaacuggaaaggaagcaaucgccccguggucgauaucaacauggaagacuauucuaucgauuccagcuacgugugcucuggccugguuggcgacacgccgagaaacgaugaccggagcuccaauucuaacugucgcaauccuaacaaugagaaggggaaccagggagugaagggcugggccuucgauaauggggacgaugucuggaugggaagaaccauuagcaaagaccuucgguccggcuacgaaacauuuaaggugaucgggggauggagcacccccaacucuaaaucccagauuaauagacaaguuaucguggauagcgacaaccgcucuggcuauuccggcauuuucagcgucgaggggaaguccugcaucaaucgguguuuuuacguggagcugauuagaggacgcaaacaggaaacacgggucugguggaccucuaacagcaucgugguuuucugcggcacguccgggacauauggaaccggcucuuggccugacggggcuaauaucaaccucaugcccauuuga

SEQ ID NO: 197115 - RNA, 1410 nt, Artificial Sequence
  derived and/or modified sequence opt5 from neuraminidase__InfluenzaA__AAO46241
augaaccccaaucagaagaucauuaccaucggcagcgugucccugacaauugccacggucugcuuccucaugcaaaucgcuauucugguuaccacagugacccuucacuuuaaacagcaugagugugacucuccugccagcaaccaggugaugccgugcgaacccaucaucauugagagaaauaucacagaaauugucuaccugaacaauaccacaaucgagaaggaaauuuguccuaaagugguuggguaucggaacugguccaagccccagugccaaaucaccggauucgcgccuuuuucuaaagauaauagcauucgccucuccgcuggcggggacaucugggugacgagagagcccuacgucucuugugauccuggaaagugcuaucaguucgcccugggccaggggaccacacuugacaacaagcacagcaaugauaccauccaugaccggauuccgcaccgcacacugcucaugaacgagcugggagugcccuuucaucugggcaccagacagguuuguaucgccugguccucuagcuccugccacgauggcaaggcuuggcuccacguguguauuacgggggacgauaaaaaugccacagcuagcuucaucuacgacggacggcuggucgauucuauuggcuccuggagccaaaacauccuucgcacccaggaaucugagugcguguguaucaaugggacaugcaccguggucaugaccgacggauccgccagcggcagagcggauacacggauucuguuuaucgaagaggggaaaauuguucauaucuccccucucucuggaagcgcccagcacguggaggaaugcuccuguuauccccgcuacccuggcgugagaugcauuugucgggacaacuggaagggcagcaaucgccccgucguggacaucaacauggaggauuauucuaucgacuccagcuacguuugcucugggcuggugggagauacgccgagaaacgacgaucggagcuccaauucuaacugucgcaauccuaacaaugaaagaggcaaccagggggucaaaggaugggcuuucgacaauggcgaugacguguggauggggcggaccauuagcaaggaucuuagauccggauacgagacauuuaagguuaucggcggcuggagcacccccaacucuaaaucccaaauuaaucgccaggugaucgucgacagcgauaaccggucuggguauuccggaauuuucagcguggaaggcaaguccugcaucaauagauguuuuuacgucgagcugauucgcgggcggaaacaggagacaagagugugguggaccucuaacagcaucguuguguucugcggaacguccggcacauaugggaccggcucuuggccugacggagccaauaucaacuuuaugcccauuuga

SEQ ID NO: 197116 - RNA, 1410 nt, Artificial Sequence
  derived and/or modified sequence opt5 from neuraminidase__InfluenzaA__AAO46245
augaaccccaaucagaagaucauuaccaucggcagcgugucccugacaauugccacggucugcuuccucaugcaaaucgcuauucugguuaccacagugacccuucacuuuaaacagcaugacugugauucuccugccagcaaccaggugaugccgugcgagcccaucaucauugaaagaaauaucacagagauugucuaccugaacaauaccacaaucgaaaaggagauuuguccuaaagugguugaauaucggaacugguccaagccccagugccaaaucaccggguucgcgccuuuuucuaaagacaauagcauucgccucuccgcuggaggcgauaucugggugacgagagagcccuacgucucuugugacccugugaagugcuaucaguucgcccuggggcagggaaccacacuugauaacaagcacagcaaugacaccguucaugaucggaucccgcaccgcacacugcucaugaacgagcugggcgugcccuuucaucuggggaccagacaggucuguauugccugguccucuagcuccugccacgacggaaaggcuuggcuccacguguguaucacgggcgaugacaagaaugccacagcuagcuucauuuacgauggccggcugguggacucuaucggguccuggagccaaaacauucuucgcacccaggaaucugagugcgucuguaucaauggaacaugcaccguugugaugaccgauggcuccgccagcgggagagcggacacacggauccuguuuauugaagagggaaaaaucgugcauauuuccccucucgccggcucugcucagcacgucgaggaaugcagcuguuauccccgcuacccuggggugagaugcaucugucgggacaacuggaagggauccaaucgccccguuguggauauuaacauggaggacuauagcaucgauucuuccuacgucugcagcggccuggugggcgacacgccgagaaacgaugaccggucuagcaauuccaacugucgcaauccuaacaaugaaagagggacccagggaguuaaaggcugggccuucgauaacgggaaugaccuuuggaugggacggacaaucucuaaggaucugagaagcggcuacgagaccuuuaaggugauugggggaugguccacacccaacagcaaaucucaaaucaaucgccaggucauuguggacuccgauaaccggagcggcuauucuggcaucuucuccgucgaagggaaaagcugcauuaauagauguuuuuacguggagcucauccgcggacggaaacaggagaccagaguuugguggacguccaacucuauuguggucuucugcggcacaagcgggaccuauggaaccggcuccuggccugacggggcuaauaucaacuuuaugcccaucuga

SEQ ID NO: 197117 - RNA, 1410 nt, Artificial Sequence
  derived and/or modified sequence opt5 from neuraminidase__InfluenzaA__AAO46246
augaaccccaaucagaagaucauuaccaucggcagcgugucccugacaauugccacggucugcuuccucaugcaaaucgcuauucuggccaccacaguuacccuucacuuuaaacagcaugagugugacucuccugcgagcaaccaggugaugccgugcgaacccaucaucauugagagaaauaucacagaaauuguguaccugaacaauaccaucauugagaaggaaaucuguccuaaagucguggaguaucggaacugguccaagccccagugccaaauuacaggguucgcuccuuuuucuaaagauaauagcauccgccucuccgccggaggcgacaucuggguuaccagagagcccuacgugucuugugauccugggaagugcuaucaguucgcccugggacagggcacgacccuugacaacaagcacagcaaugauacaauucaugaccggaccccgcaccgcacacugcucaugaacgaacuggggguccccuuucaucugggaaccagacagguguguaucgcuugguccucuagcuccugccacgauggcaaagccuggcuccacguuuguauuacgggcgacgauaagaaugcuacagccagcuucaucuacgacgggcggcugguggauucuauuggauccuggagccaaaacauccuucgcacccaggagucugaaugcgucuguaucaauggcacaugcaccguggugaugaccgacggguccgcgagcggcagagccgauacacggauucuguuuaucgaggagggaaaaauuguccauaucuccccucucucugggagcgcucagcacguugaagagugcuccuguuauccccgcuacccuggagugagaugcauuugucgggacaacuggaagggcagcaaucgccccguggucgacaucaacauggaagauuauucuaucgacuccagcuacgugugcucuggccugguuggggauacgccgagaaacgacgaucggagcuccaauucuaacugucgcaauccuaacaaugagagaggaaaccagggcgugaaagggugggccuucgacaauggagaugacgucuggaugggccggaccauuagcaaggaucuuagauccggguacgaaacauuuaaggugaucggaggcuggagcacccccaacucuaaaucccaaauuaaucgccagguuaucguggacagcgauaaccggucuggcuauuccgggauuuucagcgucgagggaaaguccugcaucaauagauguuuuuacguggagcugauucgcggccggaaacaggaaacaagagucugguggaccucuaacagcaucgcuguguucugcgggacguccggaacauauggcaccgggucuuggccugacggcgccaauaucaacuuuaugcccauuuga

SEQ ID NO: 197118 - RNA, 1410 nt, Artificial Sequence
  derived and/or modified sequence opt5 from neuraminidase__InfluenzaA__AAO46247
augaaccccaaucagaagaucauuaccaucggcagcgugucccugacaauugccacggucugcuuccucaugcaaaucgcuauucugguuaccacagugacccuucacuuuaaacagcaugagugugacucuccugccagcaaccaggugaugccgugcgaacccaucaucauugagagaaauaucacagaaauugucuaccugaacaauaccacaaucgagaaggaaauuuguccuaaagugguugaguaucggaacugguccaagccccagugccaaaucaccggguucgcgccuuuuucuaaagauaauagcauucgccucuccgcuggaggcgacaucugggugacgagagagcccuacgucucuugugauccugggaagugcuaucaguucgcccugggacagggcaccacacuugacaacaagcacagcaaugauaccauccaugaccggauuccgcaccgcacacugcucaugaacgaacugggggugcccuuucaucugggaaccagacagguuuguaucgccugguccucuagcuccugccacgauggcaaggcuuggcuccacguguguauuacgggcgacgauaaaaaugccacagcuagcuucaucuacgacgggcggcuggucgauucuauuggauccuggagccaaaacauccuucgcacccaggagucugaaugcguguguaucaauggcacaugcaccguggucaugaccgacggguccgccagcggcagagcggauacacggauucuguuuaucgaggagggaaaaauuguucauaucuccccucucucugggagcgcccagcacguggaagagugcuccuguuauccccgcuacccuggagugagaugcauuugucgggacaacuggaagggcagcaaucgccccgucaucgacaucaacauggaagauuauucuauugacuccagcuacgugugcucuggccugguuggggauacgccgagaaacgacgaucggagcuccaauucuaacugucgcaauccuaacaaugagagaggaaaccagggcgugaaagggugggcuuucgacaauggagaugacgucuggaugggccggaccaucagcaaggaucuuagauccggguacgaaacauuuaaggugauuggaggcuggagcacccccaacucuaaaucccaaaucaaucgccagguuauuguggacagcgauaaccggucuggcuauuccgggaucuucagcgucgagggaaaguccugcauuaauagauguuuuuacguggagcugauccgcggccggaaacaggaaacaagagucugguggaccucuaacagcaucgugguuuucugcgggacguccggaacauauggcaccgggucuuggccugacggcgccaauauuaacuuuaugcccaucuga

SEQ ID NO: 197119 - RNA, 1410 nt, Artificial Sequence
  derived and/or modified sequence opt5 from neuraminidase__InfluenzaA__AAO46462
augaaccccaaucagaagaucauuaccaucggcagcgugucccugacaauugccacggucugcuuccucaugcaaaucgcuauucugguuaccacagugacccuucacuuuaaacaguacgagugugacucuccugccagcaaccaggugaugccgugcgaacccaucaucauugagagaaauaucacagaaauugucuaucugaacaauaccacaaucgagaaggaaauuuguccuaaagugguugaguaccggaacugguccaagccccagugccaaaucaccggguucgcgccuuuuucuaaagauaauagcauucgccucuccgcuggaggcgacaucugggugacgagagagcccuaugucucuugugaucaugggaagugcuaccaguucgcccugggacagggcaccacacuugacaacaagcacagcaaugauaccauccaugaccggauuccucaccgcacacugcucaugaacgaacugggggugccguuucaucugggaaccagacagguuuguaucgccugguccuccucuuccugccacgauggcaaggcuuggcuccacguguguauuacgggcgacgauaaaaaugccacagcuagcuucaucuaugacgggcggcuggucgauucuauuggauccuggagccaaaacauccuucgcacccaggagucugaaugcguguguaucaauggcacaugcaccguggucaugaccgacggguccgccagcggcagagcggauacacggauucuguuuaucgaggagggaaaaauuguucauaucagcccccucucugggagcgcccagcacguggaagagugcuccuguuacccucgcuaucccggagugagaugcauuugucgggacaacuggaagggcagcaaucgcccugucguggacaucaacauggaagauuacucuaucgacuccagcuacguuugcucuggccuggugggggauacgcccagaaacgacgaucggagcuccaauucuaacugucgcaauccgaacaaugagagaggaaaccagggcgucaaagggugggcuuucgacaauggagaugacguguggaugggccggaccauuagcaaggaucuuagauccggguaugaaacauuuaagguuaucggaggcuggagcaccccuaacucuaaaucccaaauuaaucgccaggugaucgucgacagcgauaaccggucuggcuacuccgggauuuucagcguggagggaaaguccugcaucaauagauguuuuuaugucgagcugauucgcggccggaaacaggaaacaagagugugguggaccucuaacagcaucguuguguucugcgggacguccggaacauacggcaccgggucuuggcccgacggcgccaauaucaacuuuaugccuauuuga

SEQ ID NO: 197120 - RNA, 1410 nt, Artificial Sequence; identical to SEQ ID NO: 197119
  derived and/or modified sequence opt5 from neuraminidase__InfluenzaA__AAO46463

SEQ ID NO: 197121 - RNA, 1410 nt, Artificial Sequence; identical to SEQ ID NO: 197119
  derived and/or modified sequence opt5 from neuraminidase__InfluenzaA__AAO46464

SEQ ID NO: 197122 - RNA, 1410 nt, Artificial Sequence; identical to SEQ ID NO: 197119
  derived and/or modified sequence opt5 from neuraminidase__InfluenzaA__AAO46465

SEQ ID NO: 197123 - RNA, 1410 nt, Artificial Sequence; identical to SEQ ID NO: 197119
  derived and/or modified sequence opt5 from neuraminidase__InfluenzaA__AAO46466

SEQ ID NO: 197124 - RNA, 1410 nt, Artificial Sequence
  derived and/or modified sequence opt5 from neuraminidase__InfluenzaA__AAO46467
augaaccccaaucagaagaucauuaccaucggcagcgugucccugacaauugccacggucugcuuccucaugcaaaucgcuauucugguuaccacagugacccuucacuuuaaacaguacgagugugacucuccugccagcaaccaggugaugccgugcgaacccaucaucauugagagaaauaucacagaaauugucuaucugaacaauaccacaaucgagaaggaaauuuguccuaaagugguugaguaccggaacugguccaagccccagugccaaaucaccggguucgcgccuuuuucuaaagauaauagcauucgccucuccgcuggaggcgacaucugggugacgagagagcccuaugucucuugugaucaugggaagugcuaccaguucgcccugggacagggcaccacacuugacaacaagcacagcaaugauaccauccaugaccggauuccucaccgcacacugcucaugaacgaacugggggugccguuucaucugggaaccagacagguuuguaucgccugguccuccucuuccugccacgauggcaaggcuuggcuccacguguguauuacgggcgacgauaaaaaugccacagcuagcuucaucuaugacgggcggcuggucgauucuauuggauccuggagccaaaacauccuucgcacccaggagucugaaugcguguguaucaauggcacaugcaccguggucaugaccgacggguccgccagcggcagagcggauacacggauucuguuuaucgaggagggaaaaauuguucauaucagcccccucacggggucugcccagcacguggaagagugcagcuguuacccucgcuaucccggagugagaugcauuugucgggacaacuggaagggcuccaaucgcccugucguggacaucaacauggaagauuacagcaucgacucuuccuacguuugcagcggccuggugggggauacccccagaaacgacgaucggucuagcaauuccaacugucgcaauccgaacaaugagagaggaaaccagggcgucaaagggugggcuuucgacaauggagaugacguguggaugggccggacaauuucuaaggaucuuagaagcggguaugaaaccuuuaagguuaucggaggcugguccacaccuaacagcaaaucucaaauuaaucgccaggugaucgucgacuccgauaaccggagcggcuacucugggauuuucuccguggagggaaagagcugcaucaauagauguuuuuaugucgagcugauucgcggccggaaacaggaaaccagagugugguggacguccaacucuaucguuguguucugcgggacaagcggaaccuacggcaccggguccuggcccgacggcgccaauaucaacuuuaugccuauuuga

SEQ ID NO: 197125 - RNA, 1410 nt, Artificial Sequence
  derived and/or modified sequence opt5 from neuraminidase__InfluenzaA__AAO46468
augaaccccaaucagaagaucauuaccaucggcagcgugucccugacaauugccacggucugcuuccucaugcaaaucgcuauucugguuaccacagugacccuucacuuuaaacaguacgagugugacuucccugccucuaaccaggugaugccgugcgaacccaucaucauugagagaaauaucacagaaauugucuaucugaacaauaccacaaucgagaaggaaauuuguccuaaagugguugaguaccggaacuggagcaagccccagugccaaaucaccggguuugcgccuuucuccaaagauaauucuauucgccucagcgcuggaggcgacaucugggugacgagagagcccuaugucuccugugaucaugggaagugcuaccaguuugcccugggacagggcaccacacuugacaacaagcacucuaaugauaccauccaugaccggauuccucaccgcacacugcucaugaacgaacugggggugccguuccaucugggaaccagacagguuuguaucgccuggagcuccagcucuugccacgauggcaaggcuuggcuccacguguguauuacgggcgacgauaaaaaugccacagcuuccuuuaucuaugacgggcggcuggucgauagcauuggaucuuggucccaaaacauccuucgcacccaggagagcgaaugcguguguaucaauggcacaugcaccguggucaugaccgacgggucugccuccggcagagcggauacacggauucuguucaucgaggagggaaaaauuguucauaucagcccccucuccgggucugcccagcacguggaagagugcagcuguuacccucgcuaucccggagugagaugcauuugucgggacaacuggaagggcuccaaucgcccugucguggacaucaacauggaagauuacagcaucgacucuuccuacguuugcagcggccuggugggggauacgcccagaaacgacgaucggucuagcaauuccaacugucgcaauccgaacaaugagagaggaaaccagggcgucaaagggugggcuuuugacaauggagaugacguguggaugggccggaccauuucuaaggaucuuagaagcggguaugaaacauucaagguuaucggaggcugguccaccccuaacagcaaaucucaaauuaaucgccaggugaucgucgacuccgauaaccggagcggcuacucugggaucuuuuccguggagggaaagagcugcauuaauagauguuucuaugucgagcugauucgcggccggaaacaggaaacaagagugugguggaccuccaacucuaucguuguguuuugcgggacgagcggaacauacggcaccggguccuggcccgacggcgccaauaucaacuucaugccuauuuga

SEQ ID NO: 197126 - RNA, 1410 nt, Artificial Sequence; identical to SEQ ID NO: 197119
  derived and/or modified sequence opt5 from neuraminidase__InfluenzaA__AAO46469

SEQ ID NO: 197127 - RNA, 1410 nt, Artificial Sequence
  derived and/or modified sequence opt5 from neuraminidase__InfluenzaA__AAO46471
augaaccccaaucagaagaucauuaccaucggcagcgugucccugacaauugccacggucugcuuccucaugcaaaucgcuauucugguuaccacagugacccuucacuuuaaacaguacgagugugacucuccugccagcaaccaggugaugccgugcgaacccaucaucauugagagaaauaucacagaaauugucuaucugaacaauaccacaaucgagaaggaaauuuguccuaaagugguugaguaccggaacugguccaagccccagugccaaaucaccggguucgcgccuuuuucuaaagauaauagcauucgccucuccgcuggaggcgacaucugggugacgagagagcccuaugucucuugugauccugggaagugcuaccaguucgcccugggacagggcaccacacuugacaacaagcauagcaaugauaccauccacgaccggauuccgcaucgcacacugcucaugaacgaacugggggugcccuuucaccugggaaccagacagguuuguaucgccugguccucuagcuccugccaugauggcaaggcuuggcuccacguguguauuacgggcgacgauaaaaaugccacagcuagcuucaucuaugacgggcggcuggucgauucuauuggauccuggagccaaaacauccuucgcacccaggagucugaaugcguguguaucaauggcacaugcaccguggucaugaccgacggguccgccagcggcagagcggauacacggauucuguuuaucgaggagggaaaaauuguucacaucuccccucucucugggagcgcccagcauguggaagagugcuccuguuacccccgcuauccuggagugagaugcauuugucgggacaacuggaagggcagcaaucgccccgucguggacaucaacauggaagauuacucuaucgacuccagcuacguuugcucuggccuggugggggauacgccgagaaacgacgaucggagcuccaauucuaacugucgcaauccuaacaaugagagaggaaaccagggcgucaaagggugggcuuucgacaauggagaugacguguggaugggccggaccauuagcaaggaucuuagauccggguaugaaacauuuaagguuaucggaggcuggagcacccccaacucuaaaucccaaauuaaucgccaggugaucgucgacagcgauaaccggucuggcuacuccgggauuuucagcguggagggaaaguccugcaucaauagauguuuuuaugucgagcugauucgcggccggaaacaggaaacaagagugugguggaccucuaacagcaucguuguguucugcgggacguccggaacauacggcaccgggucuuggccugacggcgccaauaucaacuuuaugcccauuuga

SEQ ID NO: 197128 - RNA, 1410 nt, Artificial Sequence
  derived and/or modified sequence opt5 from neuraminidase__InfluenzaA__AAO46472
augaaccccaaucagaagaucauuaccaucggcagcgugucccugacaauugccacggucugcuuccucaugcaaaucgcuauucugguuaccacagugacccuucacuuuaaacaguacgagugugacucuccugccagcaaccaggugaugccgugcgaacccaucacaaucgagagaaauauuaccgaaaucgucuaucugaacaauacaaccauugagaaggaaaucuguccuaaagugguugaguaccggaacugguccaagccccagugccaaauuacgggguucgcgccuuuuucuaaagauaauagcauccgccucuccgcuggaggcgacauuugggugaccagagagcccuaugucucuugugauccugggaagugcuaccaguucgcccugggacagggcacaacccuugacaacaagcauagcaaugauacaauccacgaccggaucccgcaucgcacccugcucaugaacgaacugggggugcccuuucaccugggaacgagacagguuuguauugccugguccucuagcuccugccaugauggcaaggcuuggcuccacguguguaucacaggcgacgauaaaaaugccaccgcuagcuucauuuaugacgggcggcuggucgauucuaucggauccuggagccaaaacauucuucgcacacaggagucugaaugcguguguaucaauggaaccugcaccguggucaugacagacggguccgccagcggcagagcggauacgcggauccuguuuauugaggagggcaaaaucguucacauuuccccucucucugggagcgcccagcauguggaagagugcuccuguuacccccgcuauccuggagugagaugcaucugucgggacaacuggaagggcagcaaucgccccgucguggacauuaacauggaagauuacucuaucgacuccagcuacguuugcucuggccuggugggggauaccccgagaaacgacgaucggagcuccaauucuaacugucgcaauccuaacaaugagagaggaaaccagggcgucaaagggugggcuuucgacaauggagaugacguguggaugggccggacaaucagcaaggaucuuagauccggguaugaaaccuuuaagguuauuagcggauggucuacacccaacuccaaaagccaaaucaaucgccaggugauugucgacucugauaaccgguccggcuacagcggcaucuucuccguggaggggaagucuugcauuaauagauguuuuuaugucgagcugauccgcggacggaaacaggaaaccagagugugguggacgagcaacuccauuguuguguucugcggcacaucugggaccuacggaaccggcagcuggccugacggggccaauaucaacuuuaugcccaucuga

SEQ ID NO: 197129 - RNA, 1410 nt, Artificial Sequence; identical to SEQ ID NO: 197119
  derived and/or modified sequence opt5 from neuraminidase__InfluenzaA__AAO46473

SEQ ID NO: 197130 - RNA, 1410 nt, Artificial Sequence; identical to SEQ ID NO: 197119
  derived and/or modified sequence opt5 from neuraminidase__InfluenzaA__AAO46474

SEQ ID NO: 197131 - RNA, 1410 nt, Artificial Sequence; identical to SEQ ID NO: 197119
  derived and/or modified sequence opt5 from neuraminidase__InfluenzaA__AAO46475

SEQ ID NO: 197132 - RNA, 1410 nt, Artificial Sequence
  derived and/or modified sequence opt5 from neuraminidase__InfluenzaA__AAO46476
augaaccccaaucagaagaucauuaccaucggcagcgugucccugacaauugccacggucugcuuccucaugcaaaucgcuauucugguuaccacagugacccuucacuuuagacaguacgagugugacucuccugccaacaaucaggugaugccgugcgaacccacaaucaucgagcggaacauuaccgaaaucgucuaucugaauaacacaaccauugagaaagaaaucuguccuaagcucguggaguaccgcaauuggagcaaaccccagugcaagauuacgggguucgcgccuuuuuccaaagauaacucuaucagacugagcgcuggaggcgacauuuggguuacccgggagcccuauguguccugugauccugggaagugcuaccaauucgcccuuggacagggcacaacccuggacaauaagcauucuaacgauacaauccacgaccgcaucccgcauagaacccuccugaugaaugaacuggggguccccuuucaccucggaacgcgccagguguguauugccuggagcuccagcucuugccaugauggcaaggcuuggcugcacguuugugugacaggcgacgauaaaaacgccaccgcuuccuucaucuaugacgggcggcuugucgauagcauuggaucuuggucccagaauauccugagaacacaagagagcgaaugcguguguauuaacgggaccugcaccguggucaugacagacggcucugccuccggacgggcggauacgcgcauccucuuuaucgaggagggcaaaauuguucacaucagcccucuguccgggucugcccagcauguggaagagugcagcuguuaccccagauauccuggagugcggugcauuugucgcgacaauuggaagggcuccaacagacccgucguggacaucaacguugaagauuacagcauugacucuuccuacgugugcagcggccuugucggggauaccccgcggaauaacgaccgcucuagcaauuccaacuguagaaauccuaacaaugagcggggaaaccacggcgugaaagggugggcuuucgaugacggaaaugauguuuggaugggcagaacaaucucuaaggaccugcgcagcggguaugaaaccuuuaaggugaucggaggcugguccacacccaacagcaaaucucagauuaaucggcaggucaucguggauuccgacaacagaagcggcuacucugggauuuucuccgucgagggaaagagcugcaucaaucgcuguuuuuauguggagcucauucggggcagagaacaagagacccgcguuugguggacguccaacucuaucguggucuucugcgggacaagcggaaccuacggcaccggguccuggccugauggcgccgacauuaaucugaugcccaucuga

SEQ ID NO: 197133 - RNA, 1410 nt, Artificial Sequence; identical to SEQ ID NO: 197119
  derived and/or modified sequence opt5 from neuraminidase__InfluenzaA__AAO46477

SEQ ID NO: 197134 - RNA, 1410 nt, Artificial Sequence
  derived and/or modified sequence opt5 from neuraminidase__InfluenzaA__AAO46478
augaaccccaaucagaagaucauuaccaucggcagcgugucccugauuaucgccacagucugcuuccucaugcaaauugcuauccugguuacgaccgugacacuucacuuuaaacagcaugagugugacucuccuagcuccaaccaggugaugccgugcgaacccaucauuaucgagagaaauauuaccgaaaucgucuaccugaacaauacaaccauugagaaggaaacauguccuaaacucguggaguaucggaacuggucuaagccccagugcaaaaucaccggguucgccccuuuuagcaaggauaauuccauucgccugucugcgggaggcgacaucuggguuacgagagagcccuacgugagcugugauccugggaagugcuaucaauucgcucuuggacagggcaccacacuggacaacaaacacuccaaugauaccauccaugaccggauuccgcaccgcacacuccugaugaacgaacuggggguccccuuucaucucggaaccagacagguguguaucgccuggucuagcuccagcugccacgauggcaaggccuggcugcacguuugugugacgggcgacgauaaaaaugcuacagccucuuucauuuacgacgggcggcuugucgauuccaucggaagcuggucucagaacauucugcgcacccaagaguccgaaugcguguguaucaauggcacaugcaccguggucaugaccgacgggaacgcuagcggcagagccgauacacggauccucuuuauugaggagggaaagaucguucauauuuccccucugucugggagcgcgcagcacguggaagagugcuccuguuauccccgcuacccugacgugagaugcaucugucgggacaauuggaaaggaagcaaccgccccauugucgauaucaacaugaaggacuauucuaucgauuccagcuacgugugcucuggccuuguuggcgacacgccgagaaaugaugaccggagcuccaagucuaacugucgcaauccuaacaaugaaagagggaaccauggagugaaaggcugggccuucgauaaugggaacgacgucuggaugggacggaccauuagcaaggaucugagauccggcuacgagacauuuaaagugaucgggggauggagcacccccaauucuaagucccagauuaaccgccagguuaucguggacagcgauaaucggucuggcuauuccggcauuuucagcgucgaagggaaauccugcaucaacagauguuuuuacguggagcucauucgcggacgggagcaagaaacaagagucugguggaccucuaauagcaucgugguuuucugcggcacguccgggacauauggaaccggcucuuggccugacggggcuaacaucaauuuuaugcccauuuga

SEQ ID NO: 197135 - RNA, 1410 nt, Artificial Sequence
  derived and/or modified sequence opt5 from neuraminidase__InfluenzaA__AAO46479
augaaccccaaucagaagaucauuaccaucggcagcgugucccugacaauugccacggucugcuuccucaugcaaaucgcuauucugguuaccacagugacccuucacuuuaaacaguacgagugugacucuccugccagcaacagagugaugccgugcgaacccaucaucauugagcggaauaucacagaaauugucuaucugaacaauaccacaaucgagaaggaaauuuguccuaaagugguugaguaccgcaacugguccaagccccagugccagaucaccggguucgcgccuuuuucuaaagauaauagcauuagacucuccgcuggaggcgacaucugggugacgcgggagcccuaugucucuugugauccugggaagugcuaccaauucgcccugggacagggcaccacacuugacaacaagcauagcaaugauaccauccacgaccgcauuccgcauagaacacugcucaugaacgaacugggggugcccuuucaccugggaacccggcagguuuguaucgccugguccucuagcuccugccaugauggcaaggcuuggcuccacguguguauuacgggcgacgauaaaaaugccacagcuagcuucaucuaugacgggcgccuggucgauucuauuggauccuggagccagaacauccuuagaacccaagagucugaaugcguguguaucaauggcacaugcaccguggucaugaccgacggguccgccagcggacgggcggauacacgcauucuguuuaucgaggagggcaaaauuguucacaucuccccucucucugggagcgcccagcauguggaagagugcuccuguuaccccagauauccuggagugcggugcauuugucgcgacaacuggaagggcagcaauagacccgucguggacaucaacauggaagauuacucuaucgacuccagcuacguuugcucuggccuggugggggauacgccgcggaacgacgaucgcagcuccaauucuaacuguagaaauccuaacaaugagcggggaaaccagggcgucaaagggugggcuuucgacaauggagaugacguguggaugggcagaaccauuagcaaggaucuucgcuccggguaugaaacauuuaagguuaucggaggcuggagcacccccaacucuaaaucccagauuaaucggcaagugaucgucgacagcggcaacagaucuggguacuccggaauuuucagcguggagggcaaguccugcaucaaucgcuguuuuuaugucgagcugauucgggggagaaaacaggaaacacgcgugugguggaccucuaacagcaucguuguguucugcggaacguccggcacauacgggaccggcucuuggccugauggagccaauaucaacuuuaugcccauuuga

SEQ ID NO: 197136 - RNA, 1410 nt, Artificial Sequence
  derived and/or modified sequence opt5 from neuraminidase__InfluenzaA__AAO46481
augaaccccaaucagaagaucauuaccaucggcagcgugucccugacaauugccacggucugcuuccucaugcaaaucgcuauucugguuaccacagugacccuucacuuuaaacaguacgagugugacucuccugccaacaaucaggugaugccgugcgaacccaucaucauugagagaaacaucacagaaauugucuaucugaccaauacaaccaucgagaaggaaauuuguccuaaacucguggaguaccggaacuggagcaagccccagugcaaaaucacgggguucgcgccuuuuuccaaggauaauucuauucgccugagcgcuggaggcgacaucuggguuaccagagagcccuauguguccugugauccugggaagugcuaccaauucgcccuuggacagggcacaacccuggacaacaaacauucuaaugauacaauccacgaccggauuccgcaucgcacccuccugaugaacgaacuggggguccccuuucaccucggaacgagacagguguguaucgccuggagcuccagcucuugccaugauggcaaggcuuggcugcacguuugugugacaggcgacgauaaaaaugccaccgcuuccuucauuuaugacgggcggcuugucgauagcaucggaucuuggucccagaacauucugcgcacacaagagagcgaaugcguguguaucaauggaaccugcaccguggucaugacagacgggucugccuccggcagagcggauacgcggauccucuuuauugaggagggcaagaucguucacauuagcccucuguccgggucugcccagcauguggaagagugcagcuguuacccccgcuauccuggagugagaugcaucugucgggacaacuggaaaggcuccaaucgccccgucguggacauuaacguuaaggauuacagcaucgacucuagauacgugugcuccggccuugucggggauaccccgcggaacaaugaccgcagcucuaacagcaauuguagaaacccuaauaacgaacggggaaaucacggcgugaaggggugggcuuucgaugacggaaacgauguuuggaugggcagaacaaucuccaaagacucucgcagcggguaugagaccuuuaaggugauuggaggcugguccacacccaauagcaaaucucagaucaaccggcaggucauuguggauuccgacaauagaagcggcuacucugggaucuucuccgucgaaagcaaguccugcauuaaccgcuguuuuuauguggagcugauccggggaagagagcaagaaacccgcguuugguggacgucuaauagcauuguggucuucugcggcacauccgggaccuacggaaccggcucuuggccugauggggccgacaucaaccucaugcccaucuga

SEQ ID NO: 197137 - RNA, 1410 nt, Artificial Sequence
  derived and/or modified sequence opt5 from neuraminidase__InfluenzaA__AAO46482
augaaccccaaucagaagaucauuaccaucggcagcgugucccugacaauugccacggucugcuuccucaugcaaaucgcuauucugguuaccacagugacccuucacuuuaaacaguacgagugugacucuccugccaacaaucaggugaugccgugcgaacccaugaucaucgagagaaacauuacagaaaucgucuaucugaccaauacaaccauugagaaggaaaucuguccuaaacucguggaguaccggaacuggagcaagccccagugcaaaauuacgggguucgcgccuuuuuccaaggauaauucuauccgccugagcgcuggaggcgacauuuggguuaccagagagcccuauguguccugugauccugggaagugcuaccaauucgcccuuggacagggcacaacccuggacaacaaacauucuaaugauacaauccacgaccggaucccgcaucgcacccuccugaugaacgaacuggggguccccuuucaccucggaacgagacagguguguauugccuggagcuccagcucuugccaugauggcaaggcuuggcugcacguuugugugacaggcgacgauaaaaaugccaccgcuuccuucaucuaugacgggcggcuugucgauagcauuggaucuuggucccagaacauccugcgcacacaagagagcgaaugcguguguauuaauggaaccugcaccguggucaugacagacgggucugccuccggcagagcggauacgcggauccucuuuaucgaggagggcaagauuguucacaucagcccucuguccgggucugcccagcauguggaagagugcagcuguuacccccgcuauccuggagugagaugcauuugucgggacaacuggaaaggcuccaaucgccccgucguggacaucaacguuaaggauuacagcauugacucuagauacgugugcuccggccuugucggggauaccccgcggaacaaugaccgcagcucuaacagcaauuguagaaacccuaauaacgauaagggaaaucacggcgugaaagggugggcuuucgacgauggaaacgacguuuggaugggccggacaaucuccaaggauucuagaagcggguaugaaaccuuuaaagugaucggaggcugguccacacccaauagcaagucucagauuaaccgccaggucaucguggacuccgauaaucggagcggcuacucugggauuuucuccgucgagggaaaaagcugcaucaacagauguuuuuauguggaacugauucgcggccgggagcaagagaccagaguuugguggacguccaauucuaucguggucuucugcgggacaagcggaaccuacggcaccggguccuggccugacggcgccgacauuaaccucaugcccaucuga

SEQ ID NO: 197138 - RNA, 1410 nt, Artificial Sequence
  derived and/or modified sequence opt5 from neuraminidase__InfluenzaA__AAO46483
augaaccccaaucagaagaucauuaccaucggcagcgugucccugacaauugccacggucugcuuccucaugcaaaucgcuauucugguuaccacagugacccuucacuuuagacaguacgagugugacucuccugccaacaaucaggugaugccgugcgaacccaucaucauugagcggaacaucacagaaauugucuaucugaauaacaccacaaucgagaaagaaauuuguccuaagcucguggaguaccgcaauuggagcaaaccccagugcaagaucaccggguucgcgccuuuuuccaaagauaacucuauuagacugagcgcuggaggcgacaucuggguuacgcgggagcccuauguguccugugauccugggaagugcuaccaauucgcccuuggacagggcaccacacuggacaauaagcauucuaacgauaccauccacgaccgcauuccgcauagaacacuccugaugaaugaacuggggguccccuuucaccucggaacccgccagguguguaucgccuggagcuccagcucuugccaugauggcaaggcuuggcugcacguuugugugacgggcgacgauaaaaacgccacagcuuccuucauuuaugacgggcggcuugucgauagcaucggaucuuggucccagaauauucugagaacccaagagagcgaaugcguguguaucaacggcacaugcaccguggucaugaccgacgggucugccuccggacgggcggauacacgcauccucuuuauugaggagggcaaaaucguucacauuagcccucuguccgggucugcccagcauguggaagagugcagcuguuaccccagauauccuggagugcggugcaucugucgcgacaauuggaagggcuccaacagacccgucguggacauuaacguugaagauuacagcaucgacucuuccuacgugugcagcggccuugucggggauacgccgcggaauaacgaccgcucuagcaauuccaacuguagaaauccuaacaaugagcggggaaaccacggcgugaaagggugggcuuucgaugacggaaaugauguuuggaugggcagaaccaucucuaaggaccugcgcagcggguaugaaacauuuaaggugauuggaggcugguccacccccaacagcaaaucucagaucaaucggcaggucauuguggauuccgacaacagaagcggcuacucugggaucuucuccgucgagggaaagagcugcauuaaucgcuguuuuuauguggagcucauccggggcagagaacaagagacacgcguuugguggaccuccaacucuauuguggucuucugcgggacgagcggaacauacggcaccggguccuggccugauggcgccgacaucaaucugaugcccaucuga

SEQ ID NO: 197139 - RNA, 1410 nt, Artificial Sequence
  derived and/or modified sequence opt5 from neuraminidase__InfluenzaA__AAO46485
augaaccccaaucagaagaucauuaccaucggcagcgugucccugacaauugccacggucugcuuccucaugcaaaucgcuauucugguuaccacagugacccuucacuuuaaacaguacgagugugacucuccugccaacaaucaggugaugccgugcgaacccaucaucauugagagaaacaucacagaaauugucuaucugaccaauacaaccaucgagaaggaaauuuguccuaaacucguggaguaccggaacuggagcaagccccagugcaaaaucacgggguucgcgccuuuuuccaaggauaauucuauucgccugagcgcuggaggcgacaucuggguuaccagagagcccuauguguccugugauccugggaagugcuaccaauucgcccuuggacagggcacaacccuggacaacaaacauucuaaugauacaauccacgaccggauuccgcaucgcacccuccugaugaacgaacuggggguccccuuucaccucggaacgagacagguguguaucgccuggagcuccagcucuugccaugauggcaaggcuuggcugcacguuugugugacaggcgacgauaaaaaugccaccgcuuccuucauuuaugacgggcggcuugucgauagcaucggaucuuggucccagaacauucugcgcacacaagagagcgaaugcguguguaucaauggaaccugcaccguggucaugacagacgggucugccuccggcagagcggauacgcggauccucuuuauugaggagggcaagaucguucacauuagcccucuguccgggucugcccagcauguggaagagugcagcuguuacccccgcuauccuggagugagaugcaucugucgggacaacuggaaaggcuccaaucgccccgucguggacauuaacguuaaggauuacagcaucgacucuagauacgugugcuccggccuugucggggauaccccgcggaacaaugaccgcagcucuaacagcaauuguagaaacccuaauaacgauaagggaaaucacggcgugaaagggugggcuuucgacgauggaaacgacguuuggaugggccggacaaucuccaaggauucuagaagcggguaugaaaccuuuaaagugauuggaggcugguccacacccaauagcaagucucagaucaaccgccaggucauuguggacuccgauaaucggagcggcuacucugggaucuucuccgucgagggaaaaagcugcauuaacagauguuuuuauguggaacugauccgcggccgggagcaagagaccagaguuugguggacguccaauucuauuguggucuucugcgggacaagcggaaccuacggcaccggguccuggccugacggcgccgacaucaaccucaugcccaucuga

SEQ ID NO: 197140 - RNA, 1410 nt, Artificial Sequence
  derived and/or modified sequence opt5 from neuraminidase__InfluenzaA__AAO46486
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaaucuguccuaaacucgucgaguaccggaacuggagcaagccccagugcaaaauuacgggguucgcgccuuuuuccaaggauaauucuauccgccugagcgcuggaggcgacaucugggugaccagagagcccuauguuuccugugauccugggaagugcuaccaauucgcccuuggacagggcacaacccuggacaacaaacauucuaaugauacaauucacgaccggaucccgcaucgcacccuccugaugaacgaacugggggugcccuuucaccucggaacgagacaggucuguauugccuggagcuccagcucuugccaugauggcaaggcuuggcugcacguguguguuacaggcgacgauaaaaaugccaccgcuuccuucaucuaugacgggcggcuuguggauagcauuggaucuuggucccagaacauccugcgcacacaagagagcgaaugcgucuguaucaauggaaccugcaccguggugaugacagacgggucugccuccggcagagcggauacgcggauucucuuuaucgaggagggcaagauuguccacaucagcccucuguccgggucugcccagcauguugaagagugcagcuguuacccccgcuauccuggagugagaugcauuugucgggacaacuggaaaggcuccaaucgccccguggucgacaucaacgugaaggauuacagcaucgacucuuccuacguuugcagcggccuugugggggauaccccgagaaacaaugaccggucuagcaacuccuauugucgcaauccuaacaaugaaagaggaaaccacggcgucaaggggugggcuuucgaugacggaaaugauguguggaugggccggacaauuucuaaagacagcagauccggguacgagaccuuuaagguuaucggaggcuggagcacacccaacucuaaaucccagauuaaucgccaggugaucgucgauagcgacaaccggucuggcuauuccgggauuuucagcguggaaggaaaguccugcaucaauagauguuuuuacgucgagcugauucgcggccgggagcaagaaaccagagugugguggacgucuaacagcaucguuguguucugcgggacauccggaaccuauggcaccgggucuuggccugauggcgccgacaucaaucucaugcccauuuga

SEQ ID NO: 197141 - RNA, 1410 nt, Artificial Sequence
  derived and/or modified sequence opt5 from neuraminidase__InfluenzaA__AAO46489
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaaucuguccuaaacucgucgaguaccggaacuggagcaagccccagugcaaaauuacgggguucgcgccuuuuuccaaggauaauucuauccgccugagcgcuggaggcgacaucugggugaccagagagcccuauguuuccugugauccugggaagugcuaccaauucgcccuuggacagggcacaacccugaacaauaaacauucuaacgacacaauucacgaucggaucccgcaucgcacccuccugaugaaugaacugggggugcccuuucaccucggaacgagacaggucuguauugccuggagcuccagcucuugccaugacggcaaggcuuggcugcacguguguguuacaggcgaugacaaaaacgccaccgcuuccuucaucuaugaugggcggcuuguggacagcauuggaucuuggucccagaauauccugcgcacacaagagagcgaaugcgucuguaucaacgggaccugcaccguggugaugacagauggcucugccuccggaaaggcggacacgcggauucucuuuaucgaggagggcaaaauuguccacaucagcccucuguccgggucugcccagcauguugaagagugcagcuguuaccccagauauccuggagugcgcugcauuuguagagauaauuggaagggcuccaaccggcccguggucgacaucaacgugaaggacuacagcaucgauucuuccuacguuugcagcggccuugugggggacaccccgcgcaauaacgauagaucuagcuccucuuauugucggaauccuaacaaugaacgcggaaaccacggcgucaaagggugggcuuucgacgauggaaaugacguguggaugggcagaacaauuagcaaggauucccggagcggguacgagaccuuuaaaguuaucggaggcuggucuacacccaacuccaagagccagauuaauagacaggugaucgucgacucugauaaccgcuccggcuauagcgggauuuucuccguggaaggaaaaucuugcaucaaucgguguuuuuacgucgagcugauuagaggccgcgagcaagaaacccgggugugguggacgagcaacuccaucguuguguucugcgggacaucuggaaccuauggcaccgggagcuggccugacggcgccgauaucaaucucaugcccauuuga

SEQ ID NO: 197142 - RNA, 1410 nt, Artificial Sequence
  derived and/or modified sequence opt5 from neuraminidase__InfluenzaA__AAO46491
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaaucuguccuaaacucgucgaguaccggaacuggagcaagccccagugcaaaauuacgggguucgcgccuuuuuccaaggauaauucuauccgccugagcgcuggaggcgacaucugggugaccagagagcccuauguuuccugugauccugggaagugcuaccaauucgcccuuggacagggcacaacccuggacaacaaacauucuaaugauacaauucacgaccggaccccgcaucgcacgcuccugaugaacgaacugggggugcccuuucaccucggaacaagacaggucuguaucgccuggagcuccagcucuugccaugauggcaaggcuuggcugcacguguguguuaccggcuaugacaaaaaugccacagcuuccuucauuuacgaugggcggcuuguggacagcaucggaucuuggucccagaacauucugcgcacccaagagagcgaaugcgucuguaucaauggaaccugcacaguggugaugacggaugggucugccuccggcagagcggacaccaagauccucuuuauugaggagggcaaaaucguccacauuagcccucuguccgggucugcccagcauguugaagagugcagcuguuauccccgguacccuggagugcgcugcaucuguagagauaacuggaagggcuccaaucggcccguggucgacauuaacgugaaggacuacagcaucgauucuuccuauguuugcagcggccuugugggggacacaccgcgcaacaaugauagaucuagcaacuccuacugucggaauccuaacaaugaaaaaggaaaccacggcgucaaggggugggcuuucgacgauggaaaugacguguggaugggccgcaccaucucugaggauagcagauccggguaugaaacauuuaaaguuauuggaggcuggagcacccccaacucuaagcugcagaucaauagacaggugauugucgacuccgauaaccggagcggcuacucugggaucuucuccguggagggaaaaagcugcauuaaucgcuguuuuuaugucgagcucauccggggcagagaacaagagacgcgcgugugguggacauccaacucuauuguuguguucugcgggaccagcggaaccuacggcacaggguccuggccugacggcgccgauaucaaucugaugcccaucuga

SEQ ID NO: 197143 - RNA, 1410 nt, Artificial Sequence; identical to SEQ ID NO: 197142
  derived and/or modified sequence opt5 from neuraminidase__InfluenzaA__AAO46492

SEQ ID NO: 197144 - RNA, 1410 nt, Artificial Sequence
  derived and/or modified sequence opt5 from neuraminidase__InfluenzaA__AAO88264
augaacaccaaucagagaaucauuacaaucggcacggugugccugauugucgggaucguuagccuccugcuucaaauuggaaacaucgugucccuguggaucucucacagcauucagaccggcaagaaaaauuacuccaagaucuguucuaaaagcgugauuacauaugagaacaauaccugggucaaccagacauacgugaauaucuccaacauuaauaucgccgacgggcagggaguuaacucuauuauccucgcuggcaauagcucccugugccccaucagcgggugggccauuuauucuaaggauaacuccauccggauuggaagcaaaggcgacaucuucgugauucgcgaaccuuuuaucucuuguucccaucuugagugcagaaccuucuuucugacacaaggcgcgcuccugaaugaucggcacagcaacgggaccgucaaggaccgcucuccguacagaacgcugauguccugucccaucggagaagcuccuagccccuauaauucccgguucgagucuguggccuggagcgccuccgcuugccaugauggcaugggguggcucaccauuggaaucagcggcccugacaacggggccguugcugugcugaaguacaacggaauuaucacagauaccauuaaaucuuggcgcaauaagauccuuagaacacaggaauccgagugugucugcaucaacggcagcuguuuuaccauuaugacggacggccccucuaaugggcaggccagcuauaaaaucuucaagauggagaaaggaaagauuaucaaguccguggaacuggaugcgccuaacuaccacuacgaggaaugcucuuguuauccggacacaggcaaaguggucugcguuugcagcgauaauuggcaugccuccaaccggcccugggugagcuuugaccagaaucucgauuaccaaauuggguauaucuguucuggaguguucggcgacaacccucgcuccaaugacgggagaggaaacugcggccccguccugagcaauggcgcuaacggggugaagggauuuucuuuccgguacggcaaugggguuuggauuggacgcaccaaauccaucagcuccagaucuggcuuugagaugaucugggauccuaacggguggacagagaccgacagcuccuucucuauuaagcaggaugugaucgcccuuaccgacuggagcggcuauuccggcagcuuuguccagcaccccgaacugacaggaaugaauuguauucggccgugcuucuggguggagcucauccgcgggcagccuaaagaaucuacgauuuggaccuccggaagcucuaucuccuucuguggcguugauagcgagacagcuucuuggagcuggcccgacggggccgaucugccuuuuaccaucgacaaguga

SEQ ID NO: 197145 - RNA, 1410 nt, Artificial Sequence
  derived and/or modified sequence opt5 from neuraminidase__InfluenzaA__AAQ10334
augaaccccaaucagaagaucauuaccaucggcagcgugucccugacaauugccacgaucugcuuccucaugcaaauugcuauccuggucaccacaguuacccuucacuuuaaacaguacgaguguaacccuccgcccaauaaccaggugaugcugugcgaaccuacaaucauugagagaaauaucaccgaaauuguguaucucacaaacaccacgaucgagaaggaaauuugucccaaacuggccgaguaccggaauuggucuaagccucagugcaaaaucaccggguucgcgcccuuuagcaaggacaacuccauucgccuuucugcuggaggcgauaucugggucacaagagagccuuaugugagcugugacccggggaagugcuaccaauucgcccugggacagggcaccacacucaauaaccggcauuccaaugauaccguucacgaccgcacgcccuauagaacacugcugaugaacgaacucggggugccuuuucaucugggaaccaaacaggucuguaucgccuggucuagcuccagcugccacgauggcaaggcuuggcuucauguguguguuacaggccacaaugagaacgccaccgcuucuuucauuuacaaugggcggcugguggacuccaucggaagcuggucuaaaaacauucuccgcacccaggaauccgagugcgucuguaucaacggcacaugcacgguggugaugaccgaugggagcgccucuggcagagcggacacaaagauucuguuuaucgaggaaggaaaaaucguccacauuagcccccuuuccggguccgcccaacauguugaggaaugcucuuguuauccucgguaccccggagugcgcugcguguguagagauaauuggaagggcagcaaccggccgaucgucgacauuaaugugaaggauuacuccaucguuagcucuuaugugugcuccggccuggucggggacaccccucgcaaaaacgauagcucuagcuccucuuacugucucaaucccaacaaugaggaaggaggccacggggugaagggaugggcuuucgacgacggcaacgauguuuggauggggagaacaauuagcgagaaacugcgguccggauaugagaccuuuaaggugaucggcggcuggagcaaaccuaauucuaagcugcagaucaaccgccaggucauuguggacagagggaaucgguccggauacagcggcaucuucucugucgaagggaaauccugcauuaacagauguuuuuauguggagcucauccgcggacggaagcaggaaacggagguuugguggacaagcaauuccauuguggucuucugcggcaccucugggaccuacggcacaggaagcuggcccgauggcgccgacaucaaccugaugcccauuuga

SEQ ID NO: 197146 - RNA, 1410 nt, Artificial Sequence; identical to SEQ ID NO: 197145
  derived and/or modified sequence opt5 from neuraminidase__InfluenzaA__AAQ10335

SEQ ID NO: 197147 - RNA, 1410 nt, Artificial Sequence
  derived and/or modified sequence opt5 from neuraminidase__InfluenzaA__AAQ10336
augaaccccaaucagaagaucauuaccaucggcagcgugucccugacaauugccacgaucugcuuccucaugcaaauugcuauccuggucaccacaguuacccuucacuuuaaacaguacgaguguaacccuccgcccaauaaccaggugaugcugugcgaaccuacaaucauugagagaaauaucaccgaaauuguguaucucacaaacaccacgaucgagaaggaaauuugucccaaacuggccgaguaccggaauuggucuaagccucagugcaaaaucaccggguucgcgcccuuuagcaaggacaacuccauucgccuuucugcuggaggcgauaucugggucacaagagagccuuaugugagcugugacccggggaagugcuaccaauucgcccugggacagggcaccacacucaauaaccggcauuccaaugauaccguucacgaccgcacgcccuauagaacacugcugaugaacgaacucggggugccuuuucaucugggaaccaaacaggucuguaucgccuggucuagcuccagcugccacgauggcaaggcuuggcuucauguguguguuacaggccacaaugagaacgccaccgcuucuuucauuuacaaugggcggcugguggacuccaucggaagcuggucuaaaaacauucuccgcacccaggaauccgagugcgucuguaucaacggcacaugcacgguggugaugaccgaugggagcgccucuggcagagcggacacaaagauucuguuuaucgaggaaggaaaaaucguccacauuagcccccuuuccggguccgcccaacauguugaggaaugcucuuguuauccucgguaccccggagugcgcugcguguguagagauaauuggaagggcagcaaccggccgaucgucgacauuaaugugaaggauuacuccaucguuagcucuuaugugugcuccggccuggucggggacaccccucgcaaaaacgauagcucuagcuccucuuacugucucaaucccaacaaugaggaaggaggccacggggugaagggaugggcuuucgacgacggcaacgauguuuggauggggagaacaauuagcgagaaacugcgguccggauaugagaccuuuaaggugaucggcggcuggagcaaaccuaauucuaagcugcagaucaaccgccaggucauuguggacagagggaaucgguccggauacagcggcaucuucucugucgaagggaaauccugcauuaacagauguuuuuauguggagcucauccgcggacggaagcaggaaacggagguuugguggacaagcaauuccauuguggucuucugcggcaccucugggaccuacggcacaggaagcuggcccgauggcgccgaaaucaaccugaugcccauuuga

SEQ ID NO: 197148 - RNA, 1410 nt, Artificial Sequence; identical to SEQ ID NO: 197145
  derived and/or modified sequence opt5 from neuraminidase__InfluenzaA__AAQ10337

SEQ ID NO: 197149 - RNA, 1410 nt, Artificial Sequence
  derived and/or modified sequence opt5 from neuraminidase__InfluenzaA__AAQ10339
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugauaagugcuaccaauucgcccuggggcagggaaccacacucaauaaccggcauucuaaugacaccguucacgaucgcacgccguauagaacacugcugaugaacgaacucggcgugcccuuucaucuggggaccaaacaggucuguaucgccuggagcuccagcucuugccacgacggaaaggcuuggcuucauguguguguuacaggccacgaugagaaugccaccgcuuccuucauuuacgacggccggcugguggauagcaucgggucuugguccaaaaagauucuccgcacccaggaaagcgagugcgucuguaucaacggaacaugcacgguggugaugaccgacggcucugccuccgggagagcggauacaaaaauucuguuuaucgaggaaggaaagaucguccacauuagcccucuuuccggcucugcccaacauguugaggaaugcagcuguuauccccgguacccuggggugcgcugcguguguagagacaauuggaagggauccaaccggcccaucgucgauauuaacgugaaagacuacagcaucguuucuuccuaugugugcagcggccuggucggcgacaccccgcgcaagaaugauucuagcuccucuagccacugucucaacccuaauaacgaggaagggggacauggcgugaaagggugggcuuucgacgauggaaaugacguuuggaugggcagaacaauuuccgagacccugcggagcggguacgagacguuuaaggugaucgaaggauggucuaaacccaacuccaagcugcagaucaaucgccaggucauuguggauagaggcaaccggagcggcuauucugggaucuucuccgucgagggaaaaagcugcauuaauagauguuuuuacguggaacucauccgcggccggaagcaggagacagaaguuugguggaccuccaacucuauuguggucuucugcgggaccagcggaacauauggcaccggguccuggccugacggcgccgauaucaaucugaugcccauuuga

SEQ ID NO: 197150 - RNA, 1410 nt, Artificial Sequence
  derived and/or modified sequence opt5 from neuraminidase__InfluenzaA__AAQ10341
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugauaagugcuaccaauucgcccuggggcagggaaccacacucaauaaccggcauucuaaugacaccguucacgaucgcacgccguauagaacacugcugaugaacgaacucggcgugcccuuucaucuggggaccaaacaggucuguaucgccuggagcuccagcucuugccacgacggaaaggcuuggcuucauguguguguuacaggccacgaugagaaugccaccgcuuccuucauuuacgacggccggcugguggauagcaucgggucuugguccaaaaagauucuccgcacccaggaaagcgagugcgucuguaucaacggaacaugcacgguggugaugaccgacggcucugccuccgggagagcggauacaaaaauucuguuuaucgaggaaggaaagaucguccacauuagcccucuuuccggcucugcccaacauguugaggaaugcagcuguuauccccgguacccuggggugcgcugcguguguagagacaauuggaagggauccaaccggcccaucgucgauauuaacgugaaagacuacagcaucguuucuuccuaugugugcagcggccuggucggcgacaccccgcgcaagaaugauucuagcuccucuagccacugucucaacccuaauaacgaggaagggggacauggcgugaaagggugggcuuucgacgauggaaaugacguuuggaugggcagaacaauuuccgagaagcugcggagcggguacgagaccuuuaaagugaucgaaggauggucuaagcccaacuccaaacugcagaucaaucgccaggucauuguggauagaggcaaccggagcggcuauucugggaucuucuccgucgagggaaagagcugcauuaauagauguuuuuacguggaacucauccgcggccggaagcaggagacggaaguuugguggacauccaacucuauuguggucuucugcgggaccagcggaaccuauggcacaggguccuggccugacggcgccgauaucaaucugaugcccauuuga

SEQ ID NO: 197151 - RNA, 1410 nt, Artificial Sequence
  derived and/or modified sequence opt5 from neuraminidase__InfluenzaA__AAQ10343
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcugugcgaacccacaaucauugagagaaacaucaccgaaauuguguaucucacaaauaccacgaucgagaaggaaauuuguccuaaacuggccgaguaccggaacugguccaagccccagugcaaaaucaccggguucgcgccuuuuucuaaggacaauagcauucgccuuuccgcuggaggcgauaucugggucacaagagagcccuaugugucuugugacccugauaagugcuaccaauucgcccuggggcagggaaccacacucaacaaucggcauagcaacgacaccguucacgaucgcacgccguauagaacacugcugaugaaugaacucggcgugcccuuucaucuggggaccaaacaggucuguaucgccugguccucuagcuccugccacgacggaaaggcuuggcuucauguguguguuacaggccacgaugagaacgccaccgcuagcuucauuuacgacggccggcugguggauucuaucggguccuggagcaaaaagauucuccgcacccaggaaucugagugcgucuguaucaauggaacaugcacgguggugaugaccgacggcuccgccagcgggagagcggauacaaaaauucuguuuaucgaggaaggaaagaucguccacauuuccccucuuucuggcagcgcccaacauguugaggaaugcuccuguuauccccgguacccuggggugcgcugcguguguagagacaacuggaagggaagcaaucggcccaucgucgauauuaacgugaaagacuacucuaucguuuccagcuaugugugcucuggccuggucggcgacaccccgcgcaagaacgauagcuccucuagcucccacugucucaauccuaacaaugaggaagggggacauggcgugaaagggugggcuuucgacgauggaaacgacguuuggaugggcagaacaauuagcgagaaguuucggucuggguacgagaccuucaaagugaucgaaggaugguccaagcccaauagcaaacugcagaucaaccgccaggucauuguggauagaggcaaucggucuggcuauuccgggaucuuuagcgucgagggaaaguccugcauuaacagauguuucuacguggaacugauccgcggccggaagcaggagacggaaguuugguggacaucuaauagcauuguggccuuuugcgggaccuccggaaccuauggcacagggucuuggccugacggcgcugauaucaaccucaugcccauuuga

SEQ ID NO: 197152 - RNA, 1191 nt, Artificial Sequence
  derived and/or modified sequence opt5 from neuraminidase__InfluenzaA__AAQ10344
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggccaugcugugcgaacccacaaucauugagagaaauaucaccgaaauuguguaucucacaaacaccacgaucgagaaggaaauuuguccuaaacuggcggaguaccggaauuggagcaagccccagugcaaaaucaccggguucgcuccuuuuuccaaggacaacucuauucgccuuagcgccggaggcgauaucugggugacaagagagcccuaugucuccugugacccugauaagugcuaccaauucgcccuggggcagggaaccacacucaauaaccggcauucuaaugacaccgugcacgaucgcacgccguauagaacacugcugaugaacgaacucggcguucccuuucaucuggggaccaaacagguguguaucgcuuggagcuccagcucuugccacgacggaaaggccuggcuucaugucugugugacaggccacgaugagaaugcuaccgccuccuucauuuacgacggccggcugguugauagcaucgggucuugguccaaaaagauucuccgcacccaggaaagcgagugcguguguaucaacggaacaugcacggucgugaugaccgacggcucugcguccgggagagccgauacaaaaauucuguuuaucgaggaaggaaagaucgugcacaccagcaaacuuuccggcucugcucaacaugucgaggaaugcagcuguuauccucgguaccccgggguucgcugcguguguagagacaauuggaagggauccaaccggccuauuguggauaucaacgucaaggacuacagcauugugucuuccuauguuugcagcggccuggugggcgacacaccccgcaaaaaugauucuagcuccucuagccacugucucaacccgaauaacgaggaagggggacauggcgucaaggggugggccuucgacgauggaaaugacguguggaugggcagaaccaucuccgagaaauuucggagcggguacgagacguucaagguuauugaaggauggucuaaaccuaacuccaagcugcagaucaauagcaagucuuga

SEQ ID NO: 197153 - RNA, 1416 nt, Artificial Sequence
  derived and/or modified sequence opt5 from neuraminidase__InfluenzaA__AAR11366
augaaccccaaucagaagcuguucgcccucagcggcguggcuaucgcccuguccguccuuaaccugcucauugggaucucuaauguuggacugaacgugagccuucaccugaaagagaagggcccuaaacaagaagagaaucugaccugcacaacgauuaaccagaauaacaccacaguggucgaaaauaccuacgugaacaauacaaccaucauuacaaaggggaccgaccucaaaacgccguccuaucugcuccugaacaagucucuuuguaauguugagggauggguggucaucgcgaaggauaacgcugugagauuuggcgaaagcgagcagaucauuguuacccgggagcccuacguguccugcgacccuacaggguguaaaauguaugcccugcaucagggaaccacaauccgcaauaagcacucuaacggcaccauucaugauagaacggccuuccggggccucaucagcacaccccuggggaccccucccacagucuccaacagcgacuuuaugugcgugggauggucuuccaccaccugucacgauggcauugcucgcaugacaaucugcauucaagggaauaacgacaaugccacggcuaccguguacuauaacagacggcuuacaaccacaaucaaaaccugggcccgcaauauccugagaacgcaggaaagcgagugugucugccauaacggaacaugugcgguugugaugaccgauggcucugccuccagccaggcuuacaccaaggugauguauuuccacaaagggcucgucgugaaggaagaggagcugcggggaucugcccgccacauugaagagugcuccuguuacggccauaaucagaagguuacaugcgugugcagagacaacuggcaaggcgcuaaucggccuaucauugaaaucgauaugaacacccuggagcacacaagccgcuacgucuguacggggauucucaccgacacauccagaccgggagauaaaucuagcggcgacugcuccaaucccaucaccgggagcccuggagcccccggcgugaagggguuuggauuccugaacggcgauaauacauggcuuggccggaccaucucuccucgcuccagaagcggguuugaaaugcugaaaauucccaacgcgggaacggacccuaauucucggaucgccgagagacaggagauuguugacaacaacaauuggagcggcuauuccgggucuuucaucgauuacuggaacgacaauagcgaauguuauaacccgugcuuuuacguggagcucauucgcggacggcccgaagaggcuaaguaugucugguggaccuccaauagccugaucgcccuuuguggcucuccuuuccccguggggcccggcuccuuuccugauggagcucagauccaguacuucagcuga

SEQ ID NO: 197154 - RNA, 1350 nt, Artificial Sequence
  derived and/or modified sequence opt5 from neuraminidase__InfluenzaA__AAS89005
augaaccccaauaagaaaaucauuaccaucggcagcauuugcauggugacagggauggucucccugaugcuccagaucggaaaccugauuucuaucuggguuagccacuccauccauacgggcaaucaacagaaggccgagccuauuucuaacaccaauuuccuuacagaaaaagcuguggccagcgugaagcuggcggggaacuccucucucuguccgaucaauggaugggcugucuacagcaaagacaacuccauuagaaucggcagcaagggggauguguuuguuauucgggagcccuucaucucuugcucccaccuggaaugucgcaccuuuuuccuuacacagggagcccugcucaaugacaagcauagcaacggcaccgugaaagauagaucuccucaccggacacugauguccugccccgucggcgaggccccuagccccuauaauucucgcuuugaauccguggcuuggagcgccuccgcuugucaugacgggaccucuuggcugacgauuggaaucagcggcccugauuccggggccguugcggugcucaaguacaacggaaucauuaccgacacaaucaaaagcuggagaaauaacauucugcggacccaggagucugagugcgccugugucaauggcuccugcuucacagugaugaccgaugggccgagcaacggacaggcuucucacaagaucuuuaaaauggaaaagggcaagguggucaaaagcguugagcuugacgcccccaacuaucacuacgaagaguguuccugcuauccugaugcuggcgagauuacgugugugugccgcgacaauuggcaugggucuaacagacccugggugagcuucaaucaaaaccuggaauaccagaucggauauaucugcuccggcgucuuuggggauaauccucggcccaacgacggaacaggcagcugugggccggugucuuccaauggagccuacggcguuaagggcuucagcuuuaaauacgggaacggaguguggauuggccgcaccaagucuacaaauuccagaagcggguucgagaugaucugggauccuaacggauggauugaaaccgacuccucuuuuagcgucaaacaggacaucguggcgauuaccgauugguccggcuauucugggagcuucguucaacaccccgagcucacaggccuggacugcauccggccuuguuucuggguggaacuuauccgcggaagacccaaggaguccacgauuuggaccagcgggucuuccaucagcuuuugcggcgucaauucugauacagugggaugguccuggcccgacggcgccgagcugccuuucaccauugauaaauga

SEQ ID NO: 197155 - RNA, 1350 nt, Artificial Sequence
  derived and/or modified sequence opt5 from neuraminidase__InfluenzaA__AAS89006
augaaccccaauaagaaaaucauuaccaucggcagcauuugcauggugacagggauggucucccugaugcuccagaucggaaaccugauuucuaucuggguuagccacuccauccauacgggcaaucaacacaaggccgagccuauuucuaacaccaauuuccuuacagaaaaagcuguggccagcgugaagcuggcggggaacuccucucucuguccgaucaauggaugggcugucuacagcaaagacaacuccauuagaaucggcagcaagggggauguguuuguuauucgggagcccuucaucucuugcucccaucuggaaugucgcaccuuuuuccuuacacagggagcccugcucaaugacaagcacagcaacggcaccgugaaagauagaucuccucaucggacacugauguccugccccgucggcgaggccccuagccccuauaauucucgcuuugaauccguggcuuggagcgccuccgcuugucacgacgggaccucuuggcugacgauuggaaucagcggcccugauaacggggccguugcggugcucaaguacaauggaaucauuaccgacacaaucaaauccuggagaaacaauauucugcggacccaggagagcgagugcgccugugucaacggcucuugcuucacagugaugaccgaugggccguccaacggacaggcuagccacaagaucuuuaaaauggaaaagggcaagguggucaaaucuguugagcuugacgcccccaauuaucauuacgaagaguguagcugcuauccugaugcuggcgagauuacgugugugugccgcgacaacuggcacggguccaauagacccugggugucuuucaaccaaaaucuggaauaccagaucggauauaucugcagcggcgucuuuggggauaacccucggcccaaugacggaacaggcuccugugggccggugagcucuaacggagccuacggcguuaagggcuucuccuuuaaauacgggaauggaguguggauuggccgcaccaagagcacaaacucuagauccggguucgagaugaucugggauccuaauggauggaccgaaaccgacagcuccuuuucugucaaacaggacauuguggcgaucacagauuggagcggcuauuccgggucuuucguucagcaucccgagcucacgggccuggacugcauucggccuuguuucuggguggaacuuauccgcggaagacccaaggagagcaccaucuggacauccggcagcucuauuuccuuuugcggggucaacagcgauaccgugggauggucuuggcccgacggcgccgagcugccuuucacaaucgauaaauga

SEQ ID NO: 197156 - RNA, 1410 nt, Artificial Sequence
  derived and/or modified sequence opt5 from neuraminidase__InfluenzaA__AAT38822
augaaccccaaucagaagaucauuaccaucggcguggucaacacaacgcugagcaccauugcccucuucaucgggguuggaaaucugguguuuaacacagugauucacgagaaaaucggcgaccaucaaaucgucacccacccuacaauuaugaccccggaagugcccaauugcuccgauacaaucauuaccuacaacaauacgguuaucaacaauauuaccacaaccaucauuacagaggcugaaagaccuuucaagucuccccuuccucugugucccuuucggggguucuuuccuuuccauaaagacaacgccauccgccucggagagaauaaggaugugaucgucaccagagaaccguaugugagcugcgacaacgauaauuguugguccuuugcgcuggcucagggcgcccuucuggggacgaaacacucuaacggaacaauuaaggaccggacccccuaccgcagccucaucagauucccuauuggcacagcccccguucugggcaauuauaaggagaucugcauugcuugguccucuagcuccuguuuugaugggaaagaguggaugcaugugugcaugaccggaaacgacaacgaugccagcgcucagaucaucuacggcgggcggaugaccgacucuauuaaguccuggcgcaaagauauccugagaacacaggaaagcgagugucaaugcauugacggaacgugugucguggccgugaccgauggcccugcggccaauucugcugaccaccgggucuauuggauccgcgaagggagaauuaucaaguacgagaacguucccaaaacaaagauccagcaccucgaggaaugcuccuguuauguggacauugauguguacugcaucugccgggacaauuggaagggaagcaaccgcccguggaugagaauuaauaacgagaccauccuggaaacaggcuacgucuguucuaaauuccauuccgauaccccucggcccgccgacccuagcauuauguccugcgauucucccagcaaugugaacggcgggcccggaguuaagggcuuuggguucaaagcuggaaaugacguguggcuuggccgcacggucuccacaagcgggagaucuggauuugagaucauuaaggugaccgaaggcuggaucaacuccccuaaucacguuaaaagcaucacccagacacuggugucuaacaaugauuggagcggcuauuccgggucuuucauugucaaggccaaagacuguuuccagccgugcuuuuacguggagcucauccggggaagacccaacaagaaugaugacgucagcuggaccuccaacagcauugugacauucuguggccuggauaacgagccugggucuggaaauuggcccgacggcuccaacaucggguuuaugccuaaguga

SEQ ID NO: 197157 - RNA, 1350 nt, Artificial Sequence; identical to SEQ ID NO: 197155
  derived and/or modified sequence opt5 from neuraminidase__InfluenzaA__AAV65827

SEQ ID NO: 197158 - RNA, 1410 nt, Artificial Sequence
  derived and/or modified sequence opt5 from neuraminidase__InfluenzaA__AAX11488
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgccuuagcgccggaggcgauaucugggucaccagagagcccuacguguccugugacccugauaagugcuaucaauucgcccuggggcagggaacaacccucaacaauggccacucuaacgacacaguucaugaucggaccccguaccgcacgcugcugaugaaugaacucggggugcccuuucaccugggaacaagacaggucuguaucgcuuggagcuccagcucuugccaugacggcaaggccuggcuucacguguguguuaccggcgaugacaaaaacgcuacagccuccuucauuuauaaugggcggcugguggauagcaucggaucuugguccaagaaaauucuccgcacccaggagagcgaaugcgucuguaucaacgggaccugcacaguggugaugacggacggcucugcguccggaaaggccgauaccaaaauucuguuuaucgaggagggcaagaucguccacauuagcgcucuuuccgggucugcccaacauguugaagagugcagcuguuacccuagauaucccggagugcggugcgugugucgcgacaacuggaagggcuccaauagaccuaucgucgauauuaacgugaaagacuacagcaucguuucuuccuacgugugcagcggccuggucggggacacaccccggaagaaugauucuuucagcuccucucacugucucgacccgaacaaugaagagggaggccauggggugaaaggaugggcuuuugaugacggcaacgauguuuggauggggcgcaccauuagcgaaaagcugagauccggauaugagacauucaaagugaucgagggcuggagcaagccuaauucuaaacugcagaucaaccggcaggucauuguggaacgcggcaauagauccggguacagcggaaucuuuucugucgagggcaaguccugcauuaaccgguguuucuauguggaacucaucagagggcgcaaggaggaaaccgagguuugguggacgagcaauuccauuguggucuuuugcggaacaucuggcaccuacgggaccggcagcuggcccgacggagccgauaucaaccugaugccuauuuga

SEQ ID NO: 197159 - RNA, 1410 nt, Artificial Sequence
  derived and/or modified sequence opt5 from neuraminidase__InfluenzaA__AAX11508
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacaauaccguucaugaccggacgccguaccgcacacugcugaugaacgaacucggggugcccuuucaccugggaaccagacaggucuguaucgccuggagcuccagcucuugccaugauggcaaggcuuggcuucacguguguguuacaggcgacgauaaaaaugccaccgcuuccuucauuuauaacgggcggcugguggacagcaucggaucuugguccaagaaaauucuccgcacccaggagagcgaaugcgucuguaucaacggcacaugcacgguggugaugaccgaugggucugccuccggaaaggcggacacaaaaauucuguuuaucgaggagggcaagaucguccacauuagcacccuuuccgggucugcccaacauguugaagagugcagcuguuacccuagauaucccggagugcggugcgugugucgcgauaauuggaagggcuccaacagaccuaucgucgacauuaaugugaaagauuacagcaucguuucuuccuacgugugcagcggccuggucggggacacaccccggaagaacgacucuuucagcuccucucacugucucgauccgaauaacgaagagggaggccauggggugaaaggaugggcuuuugacgauggcaaugacguuuggauggggcgcaccauuagcgaaaagcugagauccggauaugagacguucaaagugaucgagggcuggagcaagccuaacucuaaacugcagaucaaucggcaggucauuguggaacgcggcaacagauccggguacagcggaaucuuuucugucgagggcaaguccugcauuaaucgguguuucuauguggaacucaucagagggcgcaaggaggaaacagagguuugguggaccagcaacuccauuguggucuuuugcggaaccucuggcacauacgggaccggcagcuggcccgauggagccgacaucaaucugaugccuauuuga

SEQ ID NO: 197160 - RNA, 1410 nt, Artificial Sequence
  derived and/or modified sequence opt5 from neuraminidase__InfluenzaA__AAX11538
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacgacaccguucaugaacggacgccguaccgcacacugcugaugaaugagcucggggugcccuuucaccugggaaccagacaggucuguaucgccuggagcuccagcucuugccaugauggcaaggcuuggcuucacguguguguuacaggcgacgauaaaaacgccaccgcuuccuucauuuauaaugggcggcugguggacagcaucggaucuugguccaagaaaauucuccgcacccaggaaagcgagugcgucuguaucaacggcacaugcacgguggugaugaccgaugggucugccuccggaaaggcggacacaaaaauucuguuuaucgaggaaggcaagaucguccacauuagcacccuuuccgggucugcccaacauguugaggaaugcagcuguuacccuagauaucccggagugcggugcgugugucgcgauaacuggaagggcuccaauagaccuaucgucgacauuaacgugaaagauuacagcaucguuucuuccuacgugugcagcggccuggucggggacacaccccggaagaaugacucuagcuccucuagccacugucucgauccgaacaaugaggaaggaggccauggggugaaaggaugggcuuucgacgauggcaacgacguuuggauggggcgcaccauuuccgagaagcugagaagcggauaugagacguuuaaagugaucgaaggcuggucuaagccuaauuccaaacugcagaucaaccggcaggucauuguggagcgcggcaauagaagcggguacucuggaaucuucuccgucgaaggcaagagcugcauuaaccgguguuuuuauguggagcucaucagagggcgcaaggaagagacagagguuugguggaccuccaauucuauuguggucuucugcggaaccagcggcacauacgggaccggcuccuggcccgauggagccgacaucaaccugaugccuauuuga

SEQ ID NO: 197161 - RNA, 1410 nt, Artificial Sequence
  derived and/or modified sequence opt5 from neuraminidase__InfluenzaA__AAX11548
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacgacaccguucaugaucggacgccguaccgcacacugcugaugaaugaacucggggugcccuuucaccugggaaccagacaggucuguaucgccuggagcuccagcucuugccaugacggcaaggcuuggcuucacguguguguuacaggcgaugacaaaaacgccaccgcuuccuucauuuauaaugggcggcugguggauagcaucggaucuugguccaagaaaauucuccgcacccaggagagcgaaugcgucuguaucaacggcacaugcacgguggugaugaccgacgggucugccuccggaaaggcggauacaaaaauucuguuuaucgaggagggcaagaucguccacauuagcacccuuuccgggucugcccaacauguugaagagugcagcuguuacccuagauaucccggagugcggugcgugugucgcgacaacuggaagggcuccaauagaccuaucgucgauauuaacgugaaagacuacagcaucguuucuuccuacgugugcagcggccuggucggggacacaccccggaagaaugauucuagcuccucuagccacugucucgacccgaacaaugaagagggaggccauggggugaaaggaugggcuuucgaugacggcaacgauguuuggauggggcgcaccauuuccgaaaagcugagaagcggauaugagacguuuaaagugaucgagggcuggucuaagccuaauuccaaacugcagaucaaccggcaggucauuguggaacgcggcaauagaagcggguacucuggaaucuucuccgucgagggcaagagcugcauuaaccgguguuuuuauguggaacucaucagagggcgcaaggaggaaacagagguuugguggaccuccaauucuauuguggucuucugcggaaccagcggcacauacgggaccggcuccuggcccgacggagccgauaucaaccugaugccuauuuga

SEQ ID NO: 197162 - RNA, 1410 nt, Artificial Sequence; identical to SEQ ID NO: 197159
  derived and/or modified sequence opt5 from neuraminidase__InfluenzaA__AAX11558

SEQ ID NO: 197163 - RNA, 1410 nt, Artificial Sequence
  derived and/or modified sequence opt5 from neuraminidase__InfluenzaA__AAX11568
augaaccccaaucagaagaucauuaccaucggcagcgugucccugacaauugccacgaucugcuuccucaugcaaauugcuauccuggucaccacaguuacccuucacuuuaaacagcaugaguguuacucuccuccgaacaaucaggugaugcugugcgaacccacaaucauugagagaaacaucaccgaaauuguguaucucacaaauaccacgaucgagaaggaaauuuguccuaaacuggccgaguaccggaacuggagcaagccccagugcaauaucaccggguucgcgccuuuuuccaaagacaacucuauucgccuuagcgcuggaggcgauaucugggucacaagagagcccuauguguccugugacccugauaagugcuaccaauucgcccuggggcagggaaccacacucaauaacggccacucuaaugacaccguucaugaucggacgccguaucgcacacugcugaugaacgaacucggggugcccuuucaccugggaaccagacaggucuguaucgccuggagcuccagcucuugccaugacggcaaggcuuggcuucacguguguguuacaggcgaugacaaaaaugccaccgcuuccuucauuuacaacgggcggcugguggauagcaucggaucuugguccaagaaaauucuccgcacccaggagagcgaaugcgucuguaucaauggcacaugcacgguggugaugaccgacgggucugccuccggaaaggcggauacaaaaauucuguuuaucgaggagggcaagaucguccacauuagcacccuuuccgggucugcccaacauguugaagagugcagcuguuauccuagauaccccggagugcggugcgugugucgcgacaacuggaagggcuccaacagaccuaucgucgauauuaaugugaaagacuacagcaucguuucuuccuaugugugcagcggccuggucggggacacaccccggaagaacgauucuuucagcuccucucacugucucgacccgaauaacgaagagggaggccauggggugaaaggaugggcuuuugaugacggcaaugauguuuggauggggcgcaccauuagcgaaaagcugagauccggauacgagacguucaaagugaucgagggcuggagcaagccuaacucuaaacugcagaucaaucggcaggucauuguggaacgcggcaacagauccggguauagcggaaucuuuucugucgagggcaaguccugcauuaaucgguguuucuacguggaacucaucagagggcgcaaggaggaaacagagguuugguggaccagcaacuccauuguggucuuuugcggaaccucuggcacauaugggaccggcagcuggcccgacggagccgauaucaaucugaugccuauuuga

SEQ ID NO: 197164 - RNA, 1410 nt, Artificial Sequence; identical to SEQ ID NO: 197159
  derived and/or modified sequence opt5 from neuraminidase__InfluenzaA__AAX11578

SEQ ID NO: 197165 - RNA, 1410 nt, Artificial Sequence
  derived and/or modified sequence opt5 from neuraminidase__InfluenzaA__AAX11588
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgccuuagcgccggaggcgauaucugggucaccagagagcccuacguguccugugacccugauaagugcuaucaauucgcccuggggcagggaacaacccucaacaauggccacucuaacgacacaguucaugaucggaccccguaccgcacgcugcugaugaaugaacucggggugcccuuucaccugggaacaagacaggucuguaucgcuuggagcuccagcucuugccaugacggcaaggccuggcuucacguguguguuaccggcgaugacaaaaacgcuacagccuccuucauuuauaaugggcggcugguggauagcaucggaucuugguccaagaaaauucuccgcacccaggagagcgaaugcaucuguauuaacgggaccugcacagucgugaugacggacggcucugcguccggaaaggccgauaccaaaauccuguuuaucgaggagggcaagauugugcacaucagcacacuuuccgggucugcucaacaugucgaagagugcagcuguuacccuagauaucccggaguucggugcgugugucgcgacaacuggaagggcuccaauagaccuauuguggauaucaacgucaaagacuacagcauugugucuuccuacguuugcagcggccuggugggggacacaccccggaagaaugauucuuucagcuccucucacugucucgacccgaacaaugaagagggaggccauggggucaaaggaugggccuuugaugacggcaacgauguguggauggggcgcaccaucagcgaaaagcugagauccggauaugagaccuucaaaguuaucgagggcuggagcaagccuaauucuaaacugcagauuaaccgccaggugaucgucgaacggggcaauagauccggguacagcggaaucuuuucuguggagggcaaguccugcauuaaccgguguuucuaugucgaacucauuagagggcgcaaggagaaaacggaagugugguggacaagcaauuccaucguuguguuuugcggaaccucuggcaccuacgggacaggcagcuggcccgacggagcugauauuaaccugaugccuaucuga

SEQ ID NO: 197166 - RNA, 1410 nt, Artificial Sequence; identical to SEQ ID NO: 197161
  derived and/or modified sequence opt5 from neuraminidase__InfluenzaA__AAX11598

SEQ ID NO: 197167 - RNA, 1410 nt, Artificial Sequence; identical to SEQ ID NO: 197161
  derived and/or modified sequence opt5 from neuraminidase__InfluenzaA__AAX11608

SEQ ID NO: 197168 - RNA, 1410 nt, Artificial Sequence
  derived and/or modified sequence opt5 from neuraminidase__InfluenzaA__AAX11618
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacgacaccguucaugaucggacgccguaccgcacacugcugaugaaugaacucggggugcccuuucaccugggaaccagacaggucuguaucgccuggagcuccagcucuugccaugacggcaaggcuuggcuucacguguguguuacaggcgaugacaaaaacgccaccgcuuccuucauuuauaaugggcggcugguggauagcaucggaucuugguccaagaaaauucuccgcacccaggagagcgaaugcgucuguaucaacggcacaugcacgguggugaugaccgacgggucugccuccggaaaggcggauacaaaaauucuguuuaucgaggagggcaagaucguccacauuagcgcccuuuccgggucugcucaacauguugaagagugcagcuguuacccuagauaucccggagugcggugcgugugucgcgacaacuggaagggcuccaauagaccuaucgucgauauuaacgugaaagacuacagcaucguuucuuccuacgugugcagcggccuggucggggacacaccccggaagaaugauucuagcuccucuagccacugucucgacccgaacaaugaagagggaggccauggggugaaaggaugggccuucgaugacggcaacgauguuuggauggggcgcaccauuuccgaaaagcugagaagcggauaugagaccuuuaaagugaucgagggcuggucuaagccuaauuccaaacugcagaucaaccggcaggucauuguggaacgcggcaauagaagcggguacucuggaaucuucuccgucgagggcaagagcugcauuaaccgguguuuuuauguggaacucaucagagggcgcaaggaggaaacggagguuugguggacauccaauucuauuguggucuucugcggaaccagcggcaccuacgggacaggcuccuggcccgacggagcugauaucaaccugaugccuauuuga

SEQ ID NO: 197169 - RNA, 1410 nt, Artificial Sequence
  derived and/or modified sequence opt5 from neuraminidase__InfluenzaA__AAX12744
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacgacaccguucaugaucggacgccguaccgcacacugcugaugaaugaacucggggugcccuuucaccugggaaccagacaggucuguaucgccuggagcuccagcucuugccaugacggcaaggcuuggcuucacguguguguuacaggcgaugacaaaaacgccaccgcuuccuucauuuauaaugggcggcugguggauagcaucggaucuugguccaagaaaauucuccgcacccaggagagcgaaugcgucuguaucaacggcacaugcacgguggugaugaccgacgggucugccuccggaaaggcggauacaaaaauucuguuuaucgaggagggcaagaucguccacauuagcacccuuuccgggucugcccaacauguugaagagugcagcuguuacccuagauaucccggagugcggugcgugugucgcgacaacuggaagggcuccaauagaccuaucgucgauauuaacgugaaagacuacagcaucguuucuuccuacgugugcagcggccuggucggggacacaccccggaagaaugauucuuucagcuccucucacugucucgacccgaacaaugaagagggaggccauggggugaaaggaugggcuuuugaugacggcaacgauguuuggauggggcgcaccauuagcgaaaagcugagauccggauaugagacguucaaagugaucgagggcuggagcaagccuaauucuaaacugcagaucaaccggcaggucauuguggaacgcggcaauagauccggguacagcggaaucuuuucugucgagggcaaguccugcauuaaccgguguuucuauguggaacucaucagagggcgcaaggaggaaacagagguuugguggaccagcaauuccauuguggucuuuugcggaaccucuggcacauacgggaccggcagcuggcccgacggagccgauaucaaccugaugccuauuuga

SEQ ID NO: 197170 - RNA, 1410 nt, Artificial Sequence; identical to SEQ ID NO: 197161
  derived and/or modified sequence opt5 from neuraminidase__InfluenzaA__AAX12754

SEQ ID NO: 197171 - RNA, 1410 nt, Artificial Sequence
  derived and/or modified sequence opt5 from neuraminidase__InfluenzaA__AAX12774
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccgccaucauugagagaaauaucacagaaauuguguaucucaccaacacaaccaucgagaaggaaauuuguccuaaacuggcggaguaccggaauuggagcaagccccagugcaacaucacgggguucgcuccuuuuuccaaagacaauucuauucgccuuagcgccggaggcgauaucugggucaccagagagcccuauguguccugugacccugauaagugcuaccaauucgcccuggggcagggaacaacccucaacaauggccauucuaacgacacaguucacgaucggaccccguaucgcacgcugcugaugaaugaacucggggugcccuuucaucugggaacaagacaggucuguaucgcuuggagcuccagcucuugccacgacggcaaggccuggcuucauguguguguuaccggcgaugacaaaaacgcuacagccuccuucauuuacaaugggcggcugguggauagcaucggaucuugguccaagaaaauucuccgcacccaggagagcgaaugcgucuguaucaacgggaccugcacaguggugaugacggacggcucugcguccggaaaggccgauaccaaaauucuguuuaucgaggagggcaagaucgucaacauuagcacacuuuccgggucugcucaacacguugaagagugcagcuguuauccuagauaccccggagugcggugcgugugucgcgacaauuggaagggcuccaacagaccuaucgucgauauuaaugugaaagacuacagcaucguuucuuccuaugugugcagcggccuggucggggacacaccccggaagaacgauucuuucagcuccucucacugucucgacccgaauaacgaagagggaggccauggggugaaaggaugggccuuugaugacggcaaugauguuuggauggggcgcaccauuagcgaaaagcugagauccggauacgagaccuucaaagugaucgagggcuggagcaagccuaacucuaaacugcagaucaaucggcaggucauuguggaacgcggcaacagauccggguauagcggaaucuuuucugucgagggcaaguccugcauuaaucgguguuucuacguggaacucaucagagggcgcaaggaggaaacggagguuugguggacaagcaacuccauuguggucuuuugcggaaccucuggcaccuaugggacaggcagcuggcccgacggagcugauaucaaucugaugccuauuuga

SEQ ID NO: 197172 - RNA, 1410 nt, Artificial Sequence
  derived and/or modified sequence opt5 from neuraminidase__InfluenzaA__AAX12804
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacauuagcacccuuuccgggucugcccaacacguugaggaaugcagcuguuauccuagauaccccggagugcggugcgugugucgcgacaacuggaagggcuccaauagaccuaucgucgauauuaacgugaaggacuacagcaucguuucuuccuaugugugcagcggccuggucggggacacaccccggaaaaaugauaacuucucuagcucccauugucucgacccgaauaacgaggaaggaggccacggggugaagggaugggcuuuugaugacggcaaugauguuuggauggggcgcaccauuucugagaaacugagaagcggauacgagacguucaaggugaucgaaggcugguccaaaccuaacagcaagcugcagacaaaucggcaggucaucguggagcgcggcaacagaucuggguauuccggaauuuuuagcgucgaaggcaaaucuugcaucaaucgguguuucuacguggagcucauuagagggcgcaaggaagagaccgagguuugguggaccuccaacagcaucguggucuuuugcggaacauccggcaccuaugggacaggcucuuggcccgacggagccgauauuaaucugaugccuaucuga

SEQ ID NO: 197173 - RNA, 1410 nt, Artificial Sequence
  derived and/or modified sequence opt5 from neuraminidase__InfluenzaA__AAX12814
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccgccaucauugagagaaauaucacagaaauuguguaucucaccaacacaaccaucgagaaggaaauuuguccuaaacuggcggaguaccggaauuggagcaagccccagugcaacaucacgggguucgcuccuuuuuccaaagacaauucuauucgccuuagcgccggaggcgauaucugggucaccagagagcccuauguguccugugacccugauaagugcuaccaauucgcccuggggcagggaacaacccucaacaauggccauucuaacgacacaguucacgaucggaccccguaucgcacgcugcugaugaaugaacucggggugcccuuucaucugggaacaagacaggucuguaucgcuuggagcuccagcucuugccacgacggcaaggccuggcuucauguguguguuaccggcgaugacgagaacgcuacagccuccuucauuuacaaugggcggcugguggauagcaucggaucuugguccaaaaagauucuccgcacccaggaaagcgagugcgucuguaucaacgggaccugcacaguggugaugacggacggcucugcguccggaaaagccgauaccaagauucuguuuaucgaggaaggcaaaaucgucaacauuagcacacuuuccgggucugcucaacacguugaggaaugcagcuguuauccuagauaccccggagugcggugcgugugucgcgacaauuggaagggcuccaacagaccuaucgucgauauuaaugugaaggacuacagcaucguuucuuccuaugugugcagcggccuggucggggacacaccccggaaaaacgauucuuucagcuccucucacugucucgacccgaauaacgaggaaggaggccauggggugaagggaugggccuuugaugacggcaaugauguuuggauggggcgcaccauuagcgagaaacugagauccggauacgagaccuucaaggugaucgaaggcuggagcaaaccuaacucuaagcugcagaucaaucggcaggucauuguggagcgcggcaacagauccggguauagcggaaucuuuucugucgaaggcaaauccugcauuaaucgguguuucuacguggagcucaucagagggcgcaaggaagagacggagguuugguggacaagcaacuccauuguggucuuuugcggaaccucuggcaccuaugggacaggcagcuggcccgacggagcugauaucaaucugaugccuauuuga

SEQ ID NO: 197174 - RNA, 1410 nt, Artificial Sequence
  derived and/or modified sequence opt5 from neuraminidase__InfluenzaA__AAX34064
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagcgggaaauuuguccuaagcuggccgaguaucgcaauuggagcaaaccccagugcaacaucaccggguucgcgccuuuuuccaaggacaauucuauuagacuuagcgcuggaggcgauaucugggucacacgggagcccuacguguccugugacccugauaaaugcuaucaauucgcccuggggcagggaaccacacucaacaauggccacucuaacgacaccguucaugaucgcacgccguacagaacacugcugaugaaugaacucggggugcccuuucaccugggaacccggcaggucuguaucgccuggagcuccagcucuugccaugacggcaaggcuuggcuucacguguguguuacaggcgaugacaagaacgccaccgcuuccuucauuuauaaugggcgccugguggauagcaucggaucuugguccaaaaagauucucagaacccaggagagcgaaugcgucuguaucaacggcacaugcacgguggugaugaccgacgggucugccuccggaaaagcggauacaaagauucuguuuaucgaggagggcaaaaucguccacauuagcacccuuuccgggucugcccaacauguugaagagugcagcuguuacccucgguaucccggagugcgcugcguguguagagacaacuggaagggcuccaaucggccuaucgucgauauuaacgugaaggacuacagcaucguuucuuccuacgugugcagcggccuggucggggacacaccccgcaaaaaugauucuagcuccucuagccacugucucgacccgaacaaugaagagggaggccauggggugaagggaugggcuuucgaugacggcaacgauguuuggauggggagaaccauuuccgaaaaacugcggagcggauaugagacguuuaaggugaucgagggcuggucuaaaccuaauuccaagcugcagaucaaccgccaggucauuguggaaagaggcaaucggagcggguacucuggaaucuucuccgucgagggcaaaagcugcauuaacagauguuuuuauguggaacucauccgcgggcggaaggaggaaacagagguuugguggaccuccaauucuauuguggucuucugcggaaccagcggcacauacgggaccggcuccuggcccgacggagccgauaucaaccugaugccuauuuga

SEQ ID NO: 197175 - RNA, 1410 nt, Artificial Sequence
  derived and/or modified sequence opt5 from neuraminidase__InfluenzaA__AAX35824
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucgccaacacaaccaucgagaaggaaauuuguccuaaacuggcggaguaccggaauuggagcaagccccagugcaacaucacgggguucgcuccuuuuuccaaagacaauucuauucgccuuagcgccggaggcgauaucugggucaccagagagcccuauguguccugugacccugauaagugcuaccaauucgcccuggggcagggaacaacccucaacaauggccauucuaacgacacaguucacgaucggaccccguaucgcacgcugcugaugaaugaacucggggugcccuuucaucugggaacaagacaggucuguaucgcuuggagcuccagcucuugccacgacggcaaggccuggcuucauguguguguuaccggcgaugacaaaaacgcuacagccuccuucauuuacaaugggcggcugguggauagcaucggaucuugguccaagaaaauucuccgcacccaggagagcgaaugcgucuguaucaacgggaccugcacaguggugaugacggacggcucugcguccggaaaggccgauaccaaaauucuguuuaucgaggagggcaagaucauucacaucagcacacuuuccgggucugcucaacacgucgaagagugcagcuguuauccuagauaccccggaguucggugcgugugucgcgacaacuggaagggcuccaauagaccuauuguggauaucaacgucaaagacuacagcauugugucuuccuauguuugcagcggccuggugggggacacaccccggaagaaugauucuagcuccucuagccauugucucgacccgaacaaugaagagggaggccacggggucaaaggaugggccuucgaugacggcaacgauguguggauggggcgcaccaucuccgaaaagcugagaagcggauacgagaccuuuaaaguuaucgagggcuggucuaagccuaauuccaaacugcagauuaaccgccaggugaucgucgaacggggcaauagaagcggguauucuggaauuuucuccguggagggcaagagcugcaucaaccgguguuuuuacgucgaacucauuagagggcgcaaggaggaaacggaggugugguggacauccaauucuaucguuguguucugcggaaccagcggcaccuaugggacaggcuccuggcccgacggagcugauauuaaccugaugccuaucuga

SEQ ID NO: 197176 - RNA, 1410 nt, Artificial Sequence; identical to SEQ ID NO: 197159
  derived and/or modified sequence opt5 from neuraminidase__InfluenzaA__AAX35834

SEQ ID NO: 197177 - RNA, 1410 nt, Artificial Sequence
  derived and/or modified sequence opt5 from neuraminidase__InfluenzaA__AAX35844
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacauuagcacccuuuccgggucugcccaacacguugaggaaugcagcuguuauccuagauaccccggagugcggugcgugugucgcgacaacuggaagggcuccaauagaccuaucgucgauauuaacgugaaggacuacagcaucguuucuuccuaugugugcagcggccuggucggggacacaccccggaaaaaugauucuuucagcaacucccauugucucgacccgaauaacgaggaaggaggccacggggugaagggaugggcuuuugaugacggcaaugauguuuggauggggcgcaccauuucugagaaacugagaagcggauacgagacguucaaggugaucgaaggcugguuuaaaccuaacuccaagcugcagaucaaucggcaggucauuguggagcgcggcaacagaagcggguauucuggaaucuucuccgucgaaggcaaaagcugcauuaaucgguguuuuuacguggagcucaucagagggcgcaaggaagagacagagguuugguggaccucuaacuccauuguggucuucugcggaaccagcggcacauaugggaccggcuccuggcccgacggagccgauaucaaucugaugccuauuuga

SEQ ID NO: 197178 - RNA, 1410 nt, Artificial Sequence
  derived and/or modified sequence opt5 from neuraminidase__InfluenzaA__AAX35854
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacauuagcacccuuuccgggucugcccaacacguugaggaaugcagcuguuauccuagauaccccggagugcggugcgugugucgcgacaacuggaagggcuccaauagaccuaucgucgauauuaacgugaaggacuacagcaucguuucuuccuaugugugcagcggccuggucggggacacaccccggaaaaaugauucuuucagcuccucucauugucucgacccgaacaaugaggaaggaggccacggggugaagggaugggcuuuugaugacggcaacgauguuuggauggggcgcaccauuagcgagaaacugagauccggauacgagacguucaaggugaucgaaggcuggagcaaaccuaauucuaagcugcagaucaaccggcaggucauuguggagcgcggcaauagauccggguauagcggaaucuuuucugucgaaggcaaauccugcauuaaccgguguuucuacguggagcucaucagagggcgcaaggaagagacagagguuugguggaccagcaauuccauuguggucuuuugcggaaccucuggcacauaugggaccggcagcuggcccgacggagccgauaucaaccugaugccuauuuga

SEQ ID NO: 197179 - RNA, 1410 nt, Artificial Sequence
  derived and/or modified sequence opt5 from neuraminidase__InfluenzaA__AAX35864
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccgccaucauugagagaaauaucacagaaauuguguaucucaccaacacaaccaucgagaaggaaauuuguccuaaacuggcggaguaccggaauuggagcaagccccagugcaacaucacgggguucgcuccuuuuuccaaagacaauucuauucgccuuagcgccggaggcgauaucugggucaccagagagcccuauguguccugugacccugauaagugcuaccaauucgcccuggggcagggaacaacccucaacaauggccauucuaacgacacaguucacgaucggaccccguaucgcacgcugcugaugaaugaacucggggugcccuuucaucugggaacaagacaggucuguaucgcuuggagcuccagcucuugccacgacggcaaggccuggcuucauguguguguuaccggcgaugacgagaacgcuacagccuccuucauuuacaaugggcggcugguggauagcaucggaucuugguccaaaaacauucuccgcacccaggaaagcgagugcgucuguaucaacgggaccugcacaguggugaugacggacggcucugcguccggaaaggccgauaccaaaauucuguuuaucgaggaaggcaagaucgucaauauuagcacacuuuccgggucugcucaacacguugaggaaugcagcuguuauccuagauaccccggagugcggugcgugugucgcgacaacuggaaaggcuccaauagaccuaucgucgauauuaacgugaaggacuacagcaucguuucuuccuaugugugcagcggccuggucggggacacaccccggaagaaugauucuuucagcuccucucacugucucgacccgaacaaugaggaaggaggccauggggugaaaggaugggccuuugaugacggcaacgauguuuggauggggcgcaccauuagcgagaagcugagauccggauacgagaccuucaaagugaucgaaggcuggagcaagccuaauucuaaacugcagaucaaccggcaggucauuguggagcgcggcaauagauccggguauagcggaaucuuuucugucgaaggcaaguccugcauuaaccgguguuucuacguggagcucaucagagggcgcaaagaagagacggagguuugguggacaagcaauuccauuguggucuuuugcggaaccucuggcaccuaugggacaggcagcuggcccgacggagcugauaucaaccugaugccuauuuga

SEQ ID NO: 197180 - RNA, 1410 nt, Artificial Sequence
  derived and/or modified sequence opt5 from neuraminidase__InfluenzaA__AAX47538
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccgccaucauugagagaaauaucacagaaauuguguaucucaccaacacaaccaucgaggaagagauuuguccuaagcuggcggaguaccggaauuggagcaaaccccagugcaacaucacgggguucgcuccuuuuuccaaggacaauucuauucgccuuagcgccggaggcgauaucugggucaccagagaacccuauguguccugugacccugauaaaugcuaccaauucgcccuggggcagggaacaacccucaacaauggccauucuaacgacacaguucacgaucggaccccguaucgcacgcugcugaugaaugagcucggggugcccuuucaucugggaacaagacaggucuguaucgcuuggagcuccagcucuugccacgacggcaaggccuggcuucauguguguguuaccggcgaugacaagaacgcuacagccuccuucauuuacaaugggcggcugguggauagcaucggaucuugguccaaaaagauucuccgcacccaggaaagcgagugcgucuguaucaacgggaccugcacaguggugaugacggacggcucugcguccggaaaagccgauaccaagauucuguuuaucgaggaaggcaaaaucgucaacauuagcacacuuuccgggucugcucaacacguugaggaaugcagcuguuauccuagauaccccggagugcggugcgugugucgcgacaauuggaagggcuccaacagaccuaucgucgauauuaaugugaaggacuacagcaucguuucuuccuaugugugcagcggccuggucggggacacaccccggaaaaacgauucuuucagcuccucucacugucucgacccgaauaacgaggaaggaggccauggggugaagggaugggccuuugaugacggcaaugauguuuggauggggcgcaccauuagcgagaaacugagauccggauacgagaccuucaaggugaucgaaggcuggagcaaaccuaacucuaagcugcagaucaaucggcaggucauuguggagcgcggcaacagauccggguauagcggaaucuuuucugucgaaggcaaauccugcauuaaucgguguuucuacguggagcucaucagagggcgcaaggaagagacggagguuugguggacaagcaacuccauuguggucuuuugcggaaccucuggcaccuaugggacaggcagcuggcccgacggagcugauaucaaucugaugccuauuuga

SEQ ID NO: 197181 - RNA, 1410 nt, Artificial Sequence; identical to SEQ ID NO: 197159
  derived and/or modified sequence opt5 from neuraminidase__InfluenzaA__AAX56383

SEQ ID NO: 197182 - RNA, 1410 nt, Artificial Sequence
  derived and/or modified sequence opt5 from neuraminidase__InfluenzaA__AAX56393
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggaagggaaccacacucaacaauggccacucuaacaauaccguucaugaccggacgccguaccgcacacugcugaugaacgaacucggggugcccuuucaccugggaaccagacaggucuguaucgccuggagcuccagcucuugccaugauggcaaggcuuggcuucacguguguguuacaggcgacgauaaaaaugccaccgcuuccuucauuuauaacgggcggcugguggacagcaucggaucuugguccaaaaagauucuccgcacccaggagagcgaaugcgucuguaucaacggcacaugcacgguggugaugaccgaugggucugccuccggaaaagcggacacaaagauucuguuuaucgaggagggcaagaucguccacauuagcacccuuuccgggucugcccagcauguugaagagugcagcuguuacccuagauaucccggagugcggugcgugugucgcgauaauuggaaaggcuccaacagaccuaucgucgacauuaaugugaaggauuacagcaucguuucuuccuacgugugcagcggccuggucggggacacaccccggaaaaacgacucuuucagcuccucucacugucucgauccgaauaacgaagagggaggccauggggugaagggaugggcuuuugacgauggcaaugacguuuggauggggcgcaccauuagcgaaaaacugagauccggauaugagacguucaaggugaucgagggcuggagcaaaccuaacucuaagcugcaaaucaaucggcaggucauuguggaacgcggcaacagauccggguacagcggaaucuuuucugucgagggcaaguccugcauuaaucgguguuucuauguggaacucaucagagggcgcaaagaggaaacagagguuugguggaccagcaacuccauuguggucuuuugcggaaccucuggcacauacgggaccggcagcuggcccgauggagccgacaucaaucugaugccuauuuga

SEQ ID NO: 197183 - RNA, 1410 nt, Artificial Sequence; identical to SEQ ID NO: 197159
  derived and/or modified sequence opt5 from neuraminidase__InfluenzaA__AAX56413

SEQ ID NO: 197184 - RNA, 1410 nt, Artificial Sequence; identical to SEQ ID NO: 197161
  derived and/or modified sequence opt5 from neuraminidase__InfluenzaA__AAX56423

SEQ ID NO: 197185 - RNA, 1410 nt, Artificial Sequence; identical to SEQ ID NO: 197159
  derived and/or modified sequence opt5 from neuraminidase__InfluenzaA__AAX56433

SEQ ID NO: 197186 - RNA, 1410 nt, Artificial Sequence; identical to SEQ ID NO: 197178
  derived and/or modified sequence opt5 from neuraminidase__InfluenzaA__AAX56443

SEQ ID NO: 197187 - RNA, 1410 nt, Artificial Sequence
  derived and/or modified sequence opt5 from neuraminidase__InfluenzaA__AAX56473
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacauuagcacccuuuccgggucugcccaacacguugaggaaugcagcuguuauccuagauaccccggagugcggugcgugugucgcgacaacuggaagggcuccaauagaccuaucgucgauauuaacgugaaggacuacagcaucguuucuuccuaugugugcagcggccuggucggggacacaccccggaaaaaugauucuuucagcuccucucauugucucgacccgaacaaugaggaaggaggccacggggugaagggaugggcuuuugaugacggcaacgauguuuggauggggcgcaccauuagcgagaaacugagauccggauacgagacguucaaggugaucgaaggcuggagcaaaccuaauucuaagcugcagaucaaccggcaggucauuguggagcgcggcaauagauccggguauagcggaaucuuuucugucgaaggcaaaaacugcauuaaucgguguuucuacguggagcucaucagagggcgcaaggaagagacagagguuugguggaccuccaacagcauuguggucuuuugcggaaccuccggcacauaugggaccggcucuuggcccgacggagccgauaucaaucugaugccuauuuga

SEQ ID NO: 197188 - RNA, 1410 nt, Artificial Sequence
  derived and/or modified sequence opt5 from neuraminidase__InfluenzaA__AAX56483
augaaccccaaucagaagaucauuaccaucggcagcgugucccugacaauugccacgaucugcuuccucaugcaaauugcuauccuggucaccacaguuacccuucacuuuaaacaguacgagugugacucuccuccgaacaaucaggugaugcugugcgaacccacaaucauugagagaaacaucaccgaaauuguguaucucacaaauaccacgaucgagaaggaaauuuguccuaaacuggccgaguaccggaacuggagcaagccccagugcaauaucaccggguucgcgccuuuuuccaaagauaacucuauucgccuuagcgcuggaggcgacaucugggucacaagagagcccuauguguccugugauccugacaagugcuaccaauucgcccuggggcagggaaccacacucaauaacggccauucuaaugauaccguucacgaccggacgccguaucgcacacugcugaugaacgaacucggggugcccuuucaucugggaaccagacaggucuguaucgccuggagcuccagcucuugccacgauggcaaggcuuggcuucauguguguguuacaggcgacgaugagaaugccaccgcuuccuucauuuacaacgggcggcugguggacagcaucggaucuugguccaaaaagauucuccgcacccaggaaagcgagugcgucuguaucaauggcacaugcacgguggugaugaccgaugggucugccuccggaaaagcggacacaaagauucuguuuaucgaggaaggcaaaaucguccacauuagcacccuuuccgggucugcccaacacguugaggaaugcagcuguuauccuagauaccccggagugcggugcgugugucgcgauaacuggaagggcuccaacagaccuaucgucgacauuaaugugaaggacuacagcaucguuucuuccuaugugugcagcggccuggucggggauacaccccggaaaaacgacucuuucagcuccucucauugucucgauccgaauaacgaggaaggaggccacggggugaagggaugggcuuuugacgauggcaaugacguuuggauggggcgcaccauuagcgagaaacugagauccggauacgagacguucaaggugaucgaaggcuggagcaaaccuaacucuaagcugcagaucaaucggcaggucauuguggagcgcggcaacagauccggguauagcggaaucuuuucugucgaaggcaaauccugcauuaaucgguguuucuacguggagcucaucagagggcgcaaggaagagacagagguuugguggaccagcaacuccauuguggucuuuugcggaaccucuggcacauaugggaccggcagcuggcccgauggagccgacaucaaucugaugccuauuuga

SEQ ID NO: 197189 - RNA, 1410 nt, Artificial Sequence; identical to SEQ ID NO: 197188
  derived and/or modified sequence opt5 from neuraminidase__InfluenzaA__AAX56503

SEQ ID NO: 197190 - RNA, 1410 nt, Artificial Sequence
  derived and/or modified sequence opt5 from neuraminidase__InfluenzaA__AAX56513
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacauuagcacccuuuccgggucugcccaacacguugaggaaugcagcuguuauccuagauaccccggagugcggugcgugugucgcgacaacuggaagggcuccaauagaccuaucgucgauauuaacgugaaggacuacagcaucguuucuuccuaugugugcagcggccuggucggggacacaccccggaaaaaugauucuuucagcuccucucauugucucgacccgaacaaugaggaaggaggccacggggugaagggaugggcuuuugaugacggcaacgauguuuggauggggcgcaccauuagcgagaaacugagauccggauacgagacguucaaggugaucgaaggcuggagcaaaccuaauucuaagcugcagacaaaccggcaggucaucguggagcgcggcaauagauccggguauagcggaaucuuuucugucgaaggcaaauccugcauuaaccgguguuucuacguggagcucauuagagggcgcaaggaagagaccgagguuugguggaccagcaauuccaucguggucuuuugcggaacaucuggcaccuaugggacaggcagcuggcccgacggagccgauauuaaccugaugccuaucuga

SEQ ID NO: 197191 - RNA, 1413 nt, Artificial Sequence
  derived and/or modified sequence opt5 from neuraminidase__InfluenzaA__AAX56533
augaaccccaaucagaagaucauuaccaucggcagcauuuccguggccaucgggauuaucucucugauccuccaaauuggaaacaucauuagcaucugggcuucccacucuauucagacaggcagccagaauuacacggggaucugcaaccagagaauuaucaccuaugagaaucggacaugggucaaccaaaccuacguuaauaucaacaauacaaacgugguggccggaaaagacaagaccuccaugacacuggcgggcaauucuagccuuuguccuauucgcgggugggcuaucuauaccaaagauaacuccauuagaaucggaagcaagggcgacgucuucgugauucgggaaccguuuaucucuugcucccaucuggagugucgcacguucuuucucacccagggcgcccugcuuaaugauaaacacagcaacgggacaaucaaggacagaucucccuuccgggcccugauguccugcccucucggagaagcucccagcccuuacaauucucgcuuugaguccguugccuggagcgcuuccgccugucaugauggccugggguggcugaccauuggaaucucuggccccgacaacggggcgguggccguccucaaguauaacggaauuaucacagaaaccauuaaaagcuggaagaaacagauccugagaacgcaggaguccgagugcguguguguuaauggcagcugcuucacaaucaugaccgauggcccuucuaaccgggcugccuccuaccgcauuuuuaagaucgaaaaagggagagugacaaagagcauugagcuugacgcuccgaauuaucacuacgaagaguguucuugcuaccccgauaccggaaccgucaugugugugugccgggacaacuggcauggcagcaaucgcccuuggguguccuucaaccaaaaucuggauuaucagaucggguacauuugcucuggagucuuuggcgacaaccccagaccuaaggauggggagggaagcuguaaucccguuacaguggacggcgccgacggcgugaaaggguucuccuaucgguacggaaacggcgucuggaucgggcgcaccaagagcaauagacuccggaaaggauuugaaaugauuugggauccgaacggcuggacggacacagauucugacuucuccaugaagcaggaugugguugcgaugaaugacuggagcggguauucuggcuccuuugugcagcacccugagcugaccggacuugauugcaugagacccuguuucugggucgaacuggugcgcggccucccucgggagaacacaaccaucuggacgagcggguccucuaucagcuucugcggaguuaauuccgaaacagccaacuggucuuggcccgacggcgcugagcugcccuuuaccauugauaaauga

SEQ ID NO: 197192 - RNA, 1410 nt, Artificial Sequence
  derived and/or modified sequence opt5 from neuraminidase__InfluenzaA__AAX56543
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuuccggagauaucugggucacaagagagcccuaugugucuugugacccugauaagugcuaccaauucgcccugggccaggggaccacacucaacaauggacauagcaacgacaccguucacgaucggacgccguaucgcacacugcugaugaaugaacucggcgugcccuuucaucuggggaccaagcaggucuguaucgccugguccucuagcuccugccacgacggaaaagccuggcuucauguguguguuacaggcgaugacgagaacgcuaccgcuagcuucauuuacaauggcagacugguggauucuaucggguccuggagcaagaaaauucuccggacccaggaaucugagugcgucuguaucaacggaacaugcacgguggugaugaccgacggcuccgccagcgggaaggcggauacaaaaauucuguuuaucgaggaaggaaagaucguccacaccuccucucuuagcggcuccgcccaacacguugaggaaugcagcuguuauccucgcuaccccggggugagaugcgugugucgggacaacuggaagggaucuaaucgcccuauugucgauaucaacgugaaagacuacuccauuguuagcucuuaugugugcagcggccuggucggcgacacacccagaaagaaugauuccucuagcuccagccauugucucgacccgaacaaugaggaagggggacacggcgugaaagggugggcuuucgaugacggaaacgauguuuggaugggccggaccaucucugaggagcugcgcuccggguacgaaacguuuaaggugauugagggauggagcaaaccuaauucuaagcugcagaucaacagacaggucaucguggaccggggcaaucgcuccggcuauagcgggauuuucuccgucgaaggaaaaucuugcaucaacagauguuuuuacguggagcucauucggggcagaaagcaggaaacagagguucuguggaccagcaauuccaucguggucuucugcgggaccucuggaacauauggcaccgggagcuggcccgauggcgccgacauuaaccuuaugccuaucuga

SEQ ID NO: 197193 - RNA, 1410 nt, Artificial Sequence; identical to SEQ ID NO: 197085
  derived and/or modified sequence opt5 from neuraminidase__InfluenzaA__AAX56553
